United States Patent 9,976,180 (METHODS FOR DETECTING A GENETIC VARIATION IN SUBJECTS WITH PARKINSONISM) - sequence listing, part 3

SEQ ID NO: 32 - DNA, 1210248 bp, Homo sapiens
agcccaaacatcttacataatactgtgcaaatgacactattcagtttctcatcgacttgatgttgtttagggaagttatagttttatgaaatgcacatgttacatctacctagtagccatattttactattataaaatacagaggaattcatttagtggaatgtaggaatataattctctaatatgacaaaaagaaagaagattatcttccctgtcattttcaaccaattttcaagaaagtccccaaccaatgactcaccaaggccctcacaccagcccccacagttttttcaatgtgaattatgctttcccttcaagggttctacacgtcgtttctcttcagtgactttgtttttgattcttcaatgaaaaataatgttttcttctcttgccaccacctacagatttaatgctgcacttgcatcctctattttgctaataccaatacatatgtactgtttaacctgttggagaataagctacttgagcatagggacataactcatattttatttaaaatcccctccccatcaccttgtagtgttatttattttggaagccttaactttatataattttataattagaagacagcttttgatatactcacttcaaactcatgttttgtgctgtggtcagtaaataatttgccctctgcctcatcctgtctgacgtctgatgtataaatggaattggaagtatgcttccttttctttccacatggcccgttgctgatcacctcctgacccacggccacccttttattcactgctgttgtgtcaaaggagatgtatcttcaatcttctgcttataatttatccatacttttcactagaaatgatggtaaaccatggtattattcataagtgttttggaaatgttacaagataaataggggccaatgagccagctgagaaacactactctactgagatattgcttcaaaaggaaacatgtgtttcatgtttaaaaatacgtggtttgaaaaaaaatctttcaaaattaaagcaatgcagaacatcaaaaatatttcagaaaatatttgtgttgaaatcagtaccctcctatttgttggctcaatgggtcaaacaatccatagtctttccatctcagttttgttatctgtaaaatagacctctgatttttattcctgtcattaccattcatctcactcccagcaaaagcactatgtaccattattatgaacttgctgttatgtgcttgtgtgcatcccttctacttctgtagaaagttttccaccattgtgtccttaatatactgagttttacatcaaaattcaacacagatactgaatttctctgtaaaaccctaccatctattaaaaaaggtgtttaagtgctctgattagctatattcttattaccttttgcatgcaattttattaatatattatgttttcaatcatatttacttttaaaaatgccttttcccccatttgaatgtaaaattttaggggctagaactgtgtttttatgtctttccagctcagaaacttgaataatgtacataatagatgcttactaaaatcagttgaatggatggaaaaaataatttagacaattttaatatttaaatgtttttaaatattaaaattatttctatatttaaaagctctgcaaaaggaaatacattattgccagtatttgtcataattttttcataatattaaatgatccatttgtcacttcatttttttaacttctatttttgtctgttacttctatttgatgactgatatagtaaaaatattaataatactaatatttatatagtctacactgtgtcagataattcaagtgctttataaatattattttatttaatacccataataatcttatgaagtaggcaacattacaatcccaatttaatatgggtaaactatggccttgagaatatatgtattttatctgtttaactctattatttaaaaataatctatagtataataatagtaattgattttatcttaatttaaaaataattttcttatgaatttataaggacagaaaggtatcaaagtaatttcattgaaatagtctattttattttttcagggttttagataaataaaagaatatacagtttatcctctttatatgtaaactagctgaaggcaaccttgttagatagtaatgtaattgtcaagataaggtattcccagaagtttattcaatgtcatatattgtgtagagaaatcacaatgtttaacatttttcttatactatcaaaatcaccaatatagtaaaaaatgtaatgaaagttaatctttaggtaacgtggtatagtaaaaagtgctttgaattaattatcaagagattagcattacagttctttatgtctttctaataacattatggctctcataagctgttgtctgaactatggcaaaaacctgttaaccaacctcaagacccagtcctctcctaggattcttcacactgcagaattactttccccttaacagttttgattacgtcactttactgctccatgatattgcctgctccataaaattcaaactatttagcagaacattcaagacctttcaaagaatgtcactttctaattttgccatttactttacattactgcccattattaccaactcccaccaatctcttactgtaaatgccaactgcactggacaattgactcttgtctgtcacactgggcaatgcatcattccctgaactataaatgcttggctgtttgttttaaatccttttttctccaaatatgaggccactttttttgttcctgaagtttaaccttgccttagtctacagtactattcctatatttagagataatttaaagcattttaaaccagaagattaaactacttctcaacacttttaaacagctgtactgacatgctattagatactgaattatttctgtagatgctgaatttatcaggataggctaggttaaactggagtagcaaaaaacacccaaatctgcatggcataatacaataaagtttatttttttcattttcttatattgcacaaagtgaatgaactgactgttgagagccttagagagttctgaaaatattggagcaacaacaataaaaatagagcaagtctgttgtcaccaaagtgggagtttgaaatgcagcttccaaatgagcattcagattggtgtgaaaatcagtctcatgagtccgttgctatgcctcacatatacacatgcggaaatcatgggcaagctttttcaagcgagtagtaattgttctaaccctatataaaaatgttatttcattcactctctccagttgtagtggtctgctaaataccactagtaactcatgtaatactcattgaagattttttgaagtctgatatcttatacatggaagctggaaattttatttcttatgggtgtgaaccattcatatgtacacctccaggagttatagtaaatatcaattctttatctttaaatttgtcattaaacaactctattaccatatattagtcataccaatggatagctaatatgatttaaaagatgtgctaccaaattttatctcaacttgcaaacaatttaattgtggatattcttgtaaactttaaaatatattttccccacagtaattctcatccttaaaaatgggaagagtgaagaaaaagttaatctttgtgcgatgttagagttcagctaacgttgataagactaaatgaaagtttgcagcctaaggggtgacaaaacataaaatatattccagaattaagcattgattagtaagaagcaaactaaaatgtgcagattaaatgtcagatattgaaattctctgctgtttcattattgttgatagcagtaaacgttataaatctcaaatttaccaggcagaatgtcatgtaatttgtcaaatgcagtttagctaaaatgaggtttgtcgcttacacaatcaacttgttaatttggctggcacttattctactgctgttacataaattctcaactataagctacaacatacattttaatttgctggacatcaggttaaacaaaaaaatatgtattcattcaagttatgttgtagttacactgattattgtcatcagacttttccaagacttttttttcaggtattgattcaaattaaagtcagaatataccacattttcacaaataaccttgatgtctattatcctttactcttttcacaattatagtttttgaaaaagtccaatatttcaggtgaacagttttccttaaatatgacttattttggttctgaatgtatttaatgtgctgtttatttttgccattattataaaaagccactgaaaactcacagctttctctttattcagaatgcaaacagccaaaaaatcatatatatgatatatatatgattacatataatcatatgtgtttgtatatatacatctcttatgtgtatggtgtgtgtgtgtatatatatatatatatatatataattagagagcatagaaaaagcattttcagaatgataaaatagtacaaactcttcccagaatatctctgggtgtatccaaggtgatacagttaactctgttgcagagtgaaaaaaatacagaatttttttttctttttcaaaaagcctctattaattgaagaaaggtgatcattttgaatttctctgaaattcaaagcaaaaaaaattatttttgttttctcacacacacacatacacatatatacatacttaaagaaaacctcttttagagattaatacgaaatttagtataaattcagctcgaattcatgtcatagaatgttagtcctgaaacaaactcagagaacatatttaaatttctcatcttcaaagagaaaacggcctgagaggcctgaattaatgtgatcaaagaatctcggtgttacatagaagatcaaaataagaacccagatctactcaagccaagtgttcattccagtgtatcttcagtgtatgagctcaaaattccaagctattttaaaatacctactttgtgcaaataaaagttagacaaagtgcttaatatctgttctctatatttaaggatttaagtgtgatttaatgttttattagtcaggacatttcagctactaataccaaaaaagaaactcaaacagcatgttaaaagtaagttaatgcatatattcacctgggacaacggaggtgaggtgagctcaggtttggttaactcagccctattctaatgttaccaagtctctttccatagcacatttatcctgaggttaactcaatcagtgactgctagaaacaatcagaattatattttttagctcttactcaatgaaacaaaaaataaattgctttttttcttagaaggtactagcaatggggatttttctacttcattggtctaaggtaacttagcctgtccattcctgatccactcacttacaaggggaatagggtcaatattttggcttatgcagccactggggagtggatgttggggactcaaatgtccattatctatatatcagtttatttataattaggtagcattggccaccatatatgattcatttcaaaatactttgcctatatatgtgtaagttagccagggatttaactttttaagaagatagcttatttttttcaaatatggctctgccatttttattgatatgacaaaagtacttaagttctatgtgcctcagtttactcatcagtttaatggacatagtagtttctatctcacagatttttgaagaaagaatgaatacagtaaatagcttacaatgttgtatgacatatagcaaatgttttatcagtgtaatgtagaacgattattgtattatggttgttgatattgttatcattgtcttattattgatatgacaacacagaaattgtattttagcacaaagatttaagaaaaattctttttgcttacaatttgcatctggtgggaactaacatcttacaaaaagtgttgcaaacagtagctaacaatttttttacctgcagatgactaagtatattttttctatgttacttcctcaatgaacttcttgctacttcctcaaataaagtattttcataggttccaaattagaaataaaagccatagcagtggcagcgtccactgacctcctttattaaacagtgagtgggatcactgaactattctatcaacaaatttatcaagatctactctgttggccactagagctgacctgaatatgatcaagttatgtttcctgtgtctaggacagagaataacaatttttttttctgcaaagggccagatagtaaatatttcaggctttgtgggttatggggttctaacacaaatattaagctctacctctatagtgtgaaaagccatggacaatatgtaaatataataaataggcataaccatgttccaataaaattttacttaccaaaaagtatgtggaacgttctatgaaatgagggtaagacttccctgctgtctccccttcaaggagtaaaacacttaaaccctatggttaaacaaaaatgtggctgaggatatcaggtcaagagtattaaaaactgggaaacgttggaggtgctgaagaattctacattcccaacatcagtggcttctttcatgtgaaaggagttcttttaaattcttccttagctcaagcttctctctcacttctcactagggaagaggaaattatttaactgatttgtaatttcagaattagaatacacctccttttcctacctccttctctctggtgacccccaggaattaaattactctctgcttcttcatagttttgaagaggcaggctctgtttctgaatagggaagcctgccccaatctagtgccaataaccaggtaagtctgattccctgaatagatatttagcaagtcacttgccctcagatgcaagctacattctagtgttagcttcattaataataaaggtgatattttgatctctcatatttctaagccataaatcactacttatctatgatttattttatttcagactttaatagggaagggaggtgctgtttattgtgtgctttctaaaattctaacatgtattgtcttattcatgacacatagacatagattacaatttttcagaggctttttacgaactcagctagtgtttgcaacacttttgtaggtgggcattaagttttaatatggggaaaataactttgatcttggcagtcggcagaggctaaattgagcaattagatgttcttcaattgactttttaaatgtgtctttagactgagtgaaaatcacacaggattttcagcatgttaggacacatcagtttatggtgttcctgtttatagataggccaccttcctgtgtatcttaagggagtggcatgaaggccttacctactttaagcaaaagagattgcctctaatttcagtcagaccatgaataccttcacccaatactggctgtgtacaagcctactaaacaaagtcagattatgttgattcagcaaagttatggggttctgcagagactgcacctcagcaaagggcataagagcaaaaaaaaaaaagtagctgttgcaagctttagtaaaaatgctgctcatgcatgtcagaaagcacaatcatgggcttgcaagtttgaatgaagggcccactccaacgctttaactggcttggttggccttaggtataggcagctatggcttgacattgaactacttaggtttttcttacacagtcatggctgaggctaacatatgatataggaaaaggatggtattcatactggcattaagcatttgtgagtagcataacatttgttactttaaattataagatgaattattcctgtggatgctctagttaagatttacttttaaatcatctgtgcttagaccaaggcagtgttatattaagtaccccaaattccagtgggtacttaggaccgaggaaaattcaaatccttgtcctcaggattaagggccataaaactctccagagactaaatgagttgcaaagataacaaaggtaagaaatacaacacatcttcaaggacatttacggaattagggctctgaggaaaggaaagagagccaggcaagacaagccaaggcctggcctgagttaaatgctattctaataagaggtatccactagatatgattttcaaacaaaaatgtgaagggaataaatacttgattgaacagtagatgcttgtgtcagactcagagcttactgatttaggaatatgaaagaaaaaacaaatatttgggccacaaagtggcccccaaaaaaggaaagaaagggttgagaccaaggaaagaaagtgctgcctctactgtgttagaaataagggtccagcttaaggagcaggttaaattgctaagcacttgctgaattggcctgtaggaaggaagagaagaacagggaaatgttagagaaccctttaggattaagaaaagacaatgtatttagtagcccatgacagaagattgggttttctctaagccattaggaggccaaaacttgaaaaacaacagaagcttcagtttaagactgcattgaggataattctccaactgaaagaaacctaaggatgttaagagaagtttccataggcagtatgtgacagtggactgactatgtatttatttatgtttttgctcaataggcaacaactccttgtttaactattcattgatccaaaccaaggtggtgaaaaaatcactgttcagtgtgtcttttccctttccaaacctaacacccactcaatgtcctgattactaggctctagcagaaatccagagaacatttcctagttttctataatcatttcacttagaaaatcctctcaatgattatagaagattagttctgagccccaagattgctaaccaccaaatgaagcatgtcatatactcagttgaggatgctattagtaaattcctccaaaataaagcacttcagatggactgaatttcatataatgaatccaaaggcaaatatgtattaattattgggcctaagggttattgaagtagactagtgccaatgtttactattcattaatttattagtcaacaaatattcatatttctatattatgattatataaatactgaggatttatatttaaagataatagcagactcagaaagaacccaagagaaaatagacaaaggaaattatatgctggttttaaagaagtaatagctatttaaaaagtattgtttttccactgtaaccttttattgtaatcaaatgtgattaaacctagttacagagaatctcaaaattctgtgaatacagggtttgtaatattagaaataaaaaggttaaatacttaattcctgggacttagactgttttgtgacatggaaagttatgcttaaattggctcaaagtaaagcgagaatacagttatttctgtggctttgcaaaatgacatatcacaatcaattccataatattttagttttaaaaaatatcctctgtgagaaacaaagtatcttacagtatcttgcattgtcttacaactcgctccagagtatctgtcagataacaagagatcaacagctatgatgcaccaacaaaatccaaaagaattcaagggattttgaataataggttatttttaaagaggtagcattttgttagttttacaatcatcatggtgtatataactcattgtcaaattattgatttaacatatttactgctaagtagacacgggcacaattattacagttgatgaattgcttgcacattggcagagcagcaggcatgcggtctgtatgttaaaaatataaacttcaattagaagctatccctggatctgtttctaaggaaaactatccatgtgttccacatgatcaattctggaataaaccaaaagtcaacgtagaataatatagaatcatgaatccccaaggaaccctaaagggtcatctaattcagcctgtggctgccttcacataaatcatccaggcttaatgaactttggaaggcttttaagagagataactagggaaggaggtgaccatattcctagaagtggaatcttctcctgcaaagagcctacagccattctgttacaatttacactaatttattattttttacagttaatacactagaaaatacaggtcactataataaatgacatagctaggataattattctagttcagaatttcagaatattggtccaagcttttttcctcatacaccatcattatagtacaggtaaaaaggaatgcaaagataaggttttctaaacattggctcattaaaaaaatcatttagcatttgtgtgtaaactgatctatagagatttattggcacttaatcaagagagacagtttggagtgctttttcatgctaagcagacataacatttttgaagaaaatcttagaaagagagaatcttattacagccgccactttatatgacagtttattattgccaaaatgtttgttaatgtataaactgcttatacattattcttaacctgaaatcatatagagagagcaaaaagagaaagaaacaaaaaacagctgaaaaatggtaatgatatatgcacttttcagaaatataataccatagaaaactaaaaccatatctaatctatttaggtcatttccttagtacagcaacaataaaataagcataattgggaattaatatccatttaaaatgtatattaaaatattgcttatgtcctaacaaaattatcagtgaagtgtcaatataaatattttagaactaaaagaagataaaaagctgatattaatccttatcttttttcatttattttaaaactataaggatatattaaatgtgggatactatcaataatttcacagttttataatttttatgtgtactttctagtgagtatttacatatgttattttttaaactgtacaatatgcctctgtactagattgtaaaggtgtacctacagcataatattttttaatttatatcaatacctattatttgagtatttactatgtgttagtgctagaagtcaaaaccaatagaaatataaaagtagttctaggcctcaagggatatgaacaattagtcatacctttgtttttctagaataaattttacagaacttaaatctaatgtaatatatgaacccagatcccagttgaacaaaatgtctcaaaccactggatggcaacatgagattttctacatttaattacctatgttatctgtaagttcaacccaattatttgtatagttcatacttgattaaatttggttttaaatacatgaaactgttaagttgttttgacctattttcaaaaaaggatggaagatttttaggtaatacaatttaaaaaaataatctcttctgataattcaatattaataaattcaccagaagaattttcaaatacccttaatttggccaaattctaagctagaagtaggaagtcaagcaaatataatagcaagtataattgcttggctcagccaaacttggacttcagaatcactccagatataacaatcatacaattgcatgctcactggcagattctctccttttacctggaaagtgctcataaaatcaaaaagagatgtaattgtttacaaagtgctattgtggttggcaccatgggacacccagtttactgtgttgtaatagactattgttaaaatgaaattaaacagatgagtattcactatttattatttataagacactctgccatatgcaaatgcaaatagataattggccaagaaattatttcaaaacaaagtctgggaaaattctcatgtataaataactttagaacaaagaagactaactatgtttataataaaaataaaatagagtacacatgaattaattaaaacaaattatctgcttaaatattcttcagtgaaaagtaaacgtagcagaggcaacatgtagatagcatgctaaagttacaagactttgtcatcgtatccatggaaaagtatataggctttggaaatatgcttctaatattcaacctttctgtgcttctttgtaataggagaataaaatccagagttgttaggagaagtaacaagttaatactcgtaaagtgatttgtatggtgccaggcacatagtaaacctttaggaattatttgatattatttaatctatttctatatgatctgatactttgtttcttacttagcacagtagagcacatttttcattatgttatggtaatgctttagttggagaagaatgatgaaaaaatgctgtctcatagaaagacaaaagaactatgaagaacccagctttctgttctttagttttcagtgctcacatactgcttttttatggagagatttattagagattagagaacttgcaatgtaagaaaatatgttcacaggttttactgaaatttataatatatcattgtacatagaccatagaaatataaaatctaacttcaaaatactttttgctaagtggattttaactgtggttaaggggctttcaaattcaaatttgtaaaacactagtctctagtggtcagacaattgagcttttcttttttgtatacacatgtgtacttgtggtgtgttaagtgtacatatcaatatgcataatattttcacgatgtaaataaatccatttactagttattcaaaatagaaaaaagtatgccaatattggaaatataaaaatttactatagattttatattaaaatatcaatataaatattttaattaatataaaaattttaatataaaaatattttatgttaaaatattaaattttaatataaaatattcagttttaatataaaatctactaatttcttatttttgttttaggtacttgttaatgcaatgtttcttctatcagcttagactgatagaatattgacattagataaattgaaattctgatttttttaaaataacgtacttcatcaaaaggcataacatgaaccatttgtttcctcattaaaatgttaaggagttggcatctaacattacatatttttatatacttctggttacatattgtggagccctttacaaaggttgtcttctttctgaattcatgattaatctttagaggacacatgcttcatgaagaggcctcacaaatgaataacgtaatgatagtgactcaagcacactttggcacagtctgaaaaggcagtcacccagcaaagcaattaatgtcagaactaatttagttctcagcgaattttattaatgattagaatgtttattcatttaaaaaactctgtctctctatagcatgaattgaaactgtgaattaagaagtgaacaataggtatccttccttttcatgaaagtggaaatctagggttcagaccgaattgcaatgtagggaacctgggccatataagactattgccccgaataacaatataatacactaaaactgaaaatgaatggtcaacagttaataaatattgagcatctaccatataccaagcacaataccatatgttttataagatttcctcaagtaaaatattttcttttagtgactagttataaaatatgtcatggtagttaaaagatagaaggtaatgtctaactgtttaattttgtcatacaaatcaatattttacaatacacattaaaagcaatttttatcatcaataacagaggcaaactcttataactcagagtccaaatatttatgcttttaatttatttgtaattaatgatgacagaaacctctggtttgtggtatgtgtatctctccagcattcaaattaagatgtgaatgcttcaagtcagattacaaggaataataatataaggccttttaaaattcaacgcagtgcaataaaatgtgtagtattacaagaaatgaagtaactagacagacgaaagattcataaatattgaaaaagcaaaggaactttttaaatttttttcagtatattaatgactaaaatgttgggaactgagattagcattaaccacagacaaatggacagtgcttggaagaataaaaatgtattttaaaacttctatataaagcatcagtttttactatgcataaaaccacacttttttgttttaatcatgcatattatgtggtagaactattaaaagagaggaaacctttaaatacatcaacaccacagacactaaaatcaacagaaaattttaagttttaaaaattgcacaaagtctacagaaacccagtaatttatcctaccaatgaactaattatttattaggttgaaatgaccaacattaactaatatttggaggaaaaggatggggtggataataataagaagaagaatatcatccaatatgaagagcttttaatgggatctatgtaattgtttggagacaactatatccacaagcttataaagcaatttaaatgttaaacctaaatttagaaaaaatattatgtttgcacataaagctttgttaccctaaaatgaaaagtaacaaaataaaccacaactccttatttaactatggaatatttctgaccatcttatcttagaaaaaaaaatctttaaactcctcaaaatatatatttacttgatagaaattagatttttcaaattattatctccttgagtatcaggcaagtttcaattctaatagacattttcaaattttcagaaatatttttactgaacccagagaatactaagaaaatatttgaaatttttatttaaactttatgcaaataatagctaacaaaaaatatttatttacatttctttgtgccagtactggtctagacactttttacggtctcaactttaacggctaatgtaatattcataaactatcttataaaataagtaccattatcctctctttgcagatgagtaaactgaggcacagagagtgctaaaatatattgcctgagataacacatatagtgtttcaaagacataactcacaagcagagcttatacccttaaactcttataagctatgttataaaggtgactttgtactgcaggtttcttataaaagtaaattattcttctctctgttaatgtcataatgcaagaaaataagataaacattaataatcattaagcatacacttaaatagcatgtgctattccttgttctaaacactttacatatattaatccctttaatgccaagagattttaatcatagaacttcaagcctggaatgtacagcacccttattttatgagaatgctatagccaagagaaaacaagcaacacccagaaaattgttaactttgacaattgaagaaatttgaagtaatttttgtattacttattgtactatgcatataacctatatcttttttcaataataaatcaatttattagttacataaaagagtatgtaattgctacatcagaaatgagaaagtgggaaatgtgaaaggtaaattgtcaaaagttcataaatataattaaataggatcaatgtctgaagtccatgtattcataaccaaattctaatgatttctgctgagtattattcaatacttaacatacatttgtagacatttttgtttcacagtcatttttaagaacgtgttgtatgtctaaaactatgctaggcaattttgacacagattaaaatatgcccctttgcttacatatggagccatctgaagtcccagttcatgctggtcctgtttttttgttgttgttgttgttgttgttttctatttagcctttgtcttgaatgagagtgtcctaatttggatgttgcccccacacacaccaaaagattctggattttagtcatgacgaagacaaggaattatgtaattaaccttcttaaatattagtttgaagaatatacaagatgctgggtgtgtggagaagaacaattaactctacccagggagttacttcggagatctacagctggaatggaggattaaaaatggaatgggaatccatcaggtggttaaagtgatgatagacatgaggaagtaatgtagagagaagcaaataaattagtacagatagcatttagcagagatacagtaaaaggagagactagtctgggtcaaactgaatgtttcagtcagtgccttctctgctttaagcacagttctagaggctaaagatacaatggtgaaatggagagaatttcttcttccttctgctaatgtcataatgcaagtaaattcgaaagcattgaaaggagactgaacacaaaatatgaataaactagaatagaacacctggagcaatcttaagttgtaattcctattaaaaatattttgccatgttaattcatctatgtctagagaaataactggagcattgaggaaaaaaagtaggagaggcatttctttcttttcatttataatttttatttctgattcagaagcctttattatctaataataaacagctaataaagtagcaaactacagcagacatgactctaaacaagaaggaatataaaaaccaaatagcagagctgcaaatcaaaatgattaaatataagaaatcatctagcaagactttccagagcccataaaaagggaaaatctgctcacatctagaaaagggaggcaggattataaataagaacaggcaaaagccaaactattgactaaattgcaagtaaacaaaaagaaacagtcactttatgatagaaatgtagaacatttggctaaatggaacaatgaatgcttcgttaaaaggaaatgttattaagtactttacatatagatgatcaattttcagaatttttctaacctcctgcagtctttctatatcagtaggtccccttcagtttctaagaatgttctcctcccttttgtaaaatgatttacaaggccaagttctgtattccattgtattctttttttttaattatactttaagttctagcgtacatgtgcacaacgtgcaggtttgttacacatgtatacatgcgcctatcttaactgagttagttctcaacattcagactggactcaacatcacaacatgggtgactggaataactccccttctccttacacttaagtttactatttctcctcaattaagaactgccaagaggtactgggatgaaagtagatttttccttcttttcagaaccatcttctccccaatacatgggtcccatacttgggaccaggatatacaggaactccaattgtcaaagggactaaggggtcctgaaggaaggtattatttcagcttattttgtgagctgcatggccaacagtatcttcactagaacatagtagagttggataattgtcttattcacacagtgctagaaaaactcacatcacaaggatgatttcctgcattatatgtgtaaaattcaacttctgaactgaatatatttctgtccatgctatcctcattgtctcaagaggggaaattgcctctcatctggtctcttgggtctgatttcatttatcctcaaaccattctccacagagcagctaaagttatttttaatgcaatctgattatggcacttggattattaaaatttaatgagttcattactttctatagaataaagtccaaataccttagatatattctcagactttcaccacctactttctctgaggcatctttcctgattttccaggcaaaatgtattgcacccaggactgtacccttcatatactgtgtacagttgtttgtttctctcactattctttatttctgccattctacaagttcctaatatctactcctttctctcacacttagcacgtaatgacatccaaataaactgttattagttcaatggattaatgagtgagtgagtgagtaaatgcacacacctgtctcggacaatggcttggttctgcatggaacttttggtcttttcatatttgtagttccacttggtgtaacagtggattgaaaaaaccactactcttaacattggaatatgtgaccttaaattctggtaccattttatacctcatgaatgttatattctttggcttctctgggcccattttccagtctatgaaatacagtttcttacagaagagttataagcatcaaatatgattaatgtatgcagaagcttctcaatagcttaggtaaatgtgtaaatatctaaggtaccactgttaattgttataaatatctatatgataatacaataatcaccactattgattattataaataggtaccactcttgattattctgttactacttaaaaactgataaattcctgtgatttataattactgtgatatgtaagattattattatcacatgtaaggtagcagaagtagccaagcctacttctctcagtagactgaataaatgtttatattattttaatgctaagataataaagaacagattgccctactcaccctggttggggctagagttggccatatgtgatacatacatgttggtgggaatgtaatatccatggatattactacatacatgttggtgggaatgtaatatccatggagccaggagtcaggtcagacaacaactcggcaactagcttcttgttatatacgctttttagtcacatatcctaaagtcatatcctaagtgaggatctcaacttggacttggaagatgacaataacttggaatcacctgtccttcaatagccaggaaagttggttcttgaattagggcttaaagaatcaaaatgatttggatagaatgaaatggaagctaaagggcattccagaccagaataactcttaaatgagtgagaccaatagaaaaaaacttaatgagaaatcgagcaaattagacgtgtgctgtgcttggtggcttcagcattcctttcttactttgtgtaactgatggcttttgttgtggaaacagtgtaacagatggagtcaatttgaacaaatcaaaatgagcaatgtagacaagacatagagtaagacgttaaaccttttatttcccttaactatcttttgttatttgtatttttctttttattttgtatgctatgaatcactaatgattctctagttttaattaataaacaattctaaatacatctgtcatttcaatgaacttaattaaatttccattggaagatttaataatatattttctgagtattaaatgatatcagatttttattttctcttcaatcattgttttgaaaacatattaccctgaaaaacacatacaaaagtgctgtattttaaaaatttactcttcttaacatatttttcctactagaagaggcaacatttactttcattatttaatatgaattcatgtactcatttatttaacactcattttaatcaagatatgcaaaggtgagtaaaatatgggctttgaggctagggtgtccacagctaggaaaatatatattatttaaataaagaggaaatttctgattaattctttgctttcttaacctgataccatggaatatttataaatactgaatattaagtaggaaactttgatttgcttaatattgagaaagtagcacaattagcaagttatctcttttgaattaaaaattacaactggattatagtttagtgatgaaaaatccaacaaaactaccatgtttctcttgactttcatttagttgtctgaaatgaatagtggccttgcttgtttatactgtaaacctagtagttaatttttaaggcacaagggctctgacttaattttctttgcttcattccactgataagaagaatgtctctgtgtcaaagtcattttatattttttattgtcattgtctcattctattatataagcagatattaattctaagtatatctttcttcttaagtagagttcagtcttgtttctgcctccactttgccatccattacatattttcttttggtattatctttgaaaattattcagaaaccattttagatatctattattctttttgttactgttttgagataaattataatgttaaatgttataattataagctttcatgtcaaacacattctttaaactttgcggatgctaatcattttcttttaaaattatgccacatgattattagtttcaaatttttagtttcaaaagcaacaagtttatatttttgtcttggattggattctctattttacaaattataaagttgtccacataatttagttgtctcctgtttgttgtatattgtaaaggatttatgccatagtataaaaataatgaattatggaagtgaattattttattatcctaatattgtgattttatcattcttcttcacttccactaaattctgagtaatgcctcaaatcccagtttaattaaatatatattgaagacctactactatttgccagaaaccataggagatgtagtaacagacacaatgcaagtataaaagacttcaaaatactatttgttttgggagcacacattctacaaagttattctacttgcacatagtgtacaacagaagacaaaattttatctgtgactgctttgcaaactcagaaggctgaggccttgcatagtcaagaagggctctgactgtaatctttgctcaagccaatttaaaagaagcattctgcattcaaaatacataattatccttaaacatttagttgatgatctgactctagaagaatagatagaatttggatatcttacatggttgaagaatttcataatgcattccaggcaagtaaatgaacatgagcccagaagcagatgggcacagtgtgattgcaagaacaagaaacccactgacaagagcaggattagcaaaagggcaggggacataattgataaaatagaagaaaagtataggggaagaggtattagaattagattatactgaaaagtgtaggtagaggggtgatatactaaactgatgtgtatgtaaaatctcatgggtgagtgtgacagactcacgggcaaaccagttcggaaggtatcccattaacccaggcatgttacaataacaacccagattgagatttggaaatgtggatataaaagagtgattaatgatgctgttttgattatttgttttcagaaataataaatcttggtaactatcttgacaaaaggaaggaagaagaaagatgaatcagagccattgtacatttttgagcctgggtgaacaaaaataatggtaatgacatgcatacaggcaagggcactgggaagtgagcttattaagagtctgggtatagatggagtgaaaggtaaggaaaaccaaacacaccaagttttcaaacttccatcttgggtatagttagagttaatgataaagtatattaaaaccagactcactttatttagacactttcattctctattttgatttgtggaagttttctacaatctctgttctctaagagcatcaatcagtatatttcatataaatagctattgttagtatcctttaagttatttattgctctaagtgattcatatatttaacttgtttaatgctcacaataccctatagagagttactaaattattattatacaattttatagatgagaacagggaagtacagaaaatcaaatagcttagcgaaggtaacaaagctaataggtcctgaaaacaatttttggaacccaagaatcttctgctcttatctactggtatgtagattgattccttcatgccaaatagtcggtttagtataaacaagtcacatcttctctacctcttttagctcttatatactcatttttttttttaatttaagttctgggatacatgtgcagaacatgcaggtttgttacataggtaaacatgtgccatggtagtttgctgcacccatcaacccatcatctaggttttaggccccacatgcgttaggtatttgccctaatgccctccctcccctttccccccacccaccaacaggccctggtgtgtgatgttcccctccctgtgtccatgtgttctcattgttcaactcccacttataagtgagaatatgtggtgtttggttcctgtgttagtttgctgaggatgatggtttccagcttcatccatgtccctgcaaaggacataaactcatccttttttatggttgcatagtattccatgtgtatatgtgccacattttctttatccagtctatcattagtgggcactgggttggttccaagtcttgcaatcataaatcatgctgcaataaacacgtgtgcatgtgtatttatagtagaatgatttataatcctttgggtatatacccagtaataagattgttgggcgaaatggtatttctggttctagatccttgaggaatcgccacactgtcttccacattggttgaactaatttacactcccaccaacaatgtaaaaacattcgtatttctccacatctttgccagcatctgttatttccggacattttaatggtcaccattctaactggcgtgagatggtatctcattatgaaccatcaaaataagcatagaagataaggacatttaaaatctggtgattatatgtatagctaactttatttcccaaaactcctcccaccaaatctgctctccaaacacggagactgtgtcatgttattttatgtctcttggcttttcacatattaattcaaccgaacagaaaattcccctggctaactagaaactgctaatcagcttttatgcttgtaaagcatactgtggttgtcaacaactgtctgggcctgattttgttttcatttgttttaaatctagacttttggagtcttgctgctatggcatgcctgtgcaattgagtgtactaaagaaattcaggagtgagacttttgcactgttttagtgtgtcctggcttaattatttttttatttttattttttggacaagccagaatgatctgctcatatcctacctcttatctgtcttttttttaggctgctttcttctttgtacttaaagctcttagtacctcctgcaaatccacctggcctcagagtgctttatagttccttagttgcttccccttatcaaaatgttcatgtctctgattttgagaactgtaacataacaataagttatgttaataagataaacaaatccctgctcctgagtaaatgagataatgtgctatttcttatagtttgatcatttctgcttaactctgaaatgccgtgctcattgaagaggcctttggaaagttataatgataccagaaatagtcattttggtctactgcaaggtaacttttgatggggacattactacaagtagacaagtaacactctgtttttgataaagagggcttaaaaatcaagtaaaggaaacaaatttatatggggtataaaaatttgttatgatgaaaatacattgaataaaatgataaaaaataagtacatagaactgttagctaaatgtaatcatttttttcagattccctcccctgccccagaatatcctgtatacagatccagttattttttaaaaatcttttcaggtatctttattttagtatttaacagctcaaaataccacaaggtaaatggaatagacatccattctcttgttttacttatgttgaatacagtttatagaaaaggcaatattttattaattttaaaggaccataattttcctgcttcatggtacgtatctgtttgctcttagacaagttcctaggaacaacaattttatgtttgctccaggtacacaacatctataatataaatataaagctgcatttaagctgacattcagtcatcaaatttcctcattttaaaaggctaaatcacacattcaaacaatgtgcatttctgagaaaaaaaaattgtgtaggtatggcaaaatttttttgtgtcaattaaataccaatggtgttcaaaatgtctccaacatgcatatcaaaaggaaattgtgttaattatactgattaaccctagtttattatgtttcaccaagtaagtcctcctagaaaggaattagtggaagatgcataaacattttaaattcaaatgcagagtgtggtaaattgttaccacagagacttaaatggattattttatgttctcagagcatccatcaggaaaaaaactgttttagaaaaccaatgtgattgtgtcaagatgatgggactaaattgaccatggcaaggtttagtcagtgtttttcctgttttcattattgattgcataacattgattatgttaactgtgcagagctccaatttacttattacgtttgctaaaataacagattggcattggcacaatttctttttatttgaggtttttaggtacattctacttgtcattattttgggagagttttttttttttttttttaagaaacctagaattcctcttccccatcttaaattctagggtttttttttaactttttatttactaatttcattgcttgggaatttagaaaaacccagtcattgatatcctctgattaagtaccttatttcctaagaaaaaaaaggaatagcatagggcgtattgtcttttctataaacagtattcagcataagtgaaacaagagaacaaatgtctattccatttaccttgtggtattttgagctgtcaaatactaaaataagtaatgatatctgaaaatatttaaaaaaataacaaatcattaggatagattcaacataaaaagcagaaacaaaaaacgttatggcttctttctgtgatgcagttccatattttatactattttaaatatgtatgtatgtatatacatacacatatatatgtatctatatatctctgatcattgaaaataaaacaaggttctgagaacatcctcattaaaaaaagattaaactattaatcagggatagtgagtacctattaactgaagatgccattttgggaaagaaggcatagcccatgatctagggtttcttgcttcaagctgctactcggaaatacccaaactttggataaaagaagttttgacaaattttaaggacgtaaaaccagataagtatcattagtcactaatgagaagattatgaggataaatgcaaaggcctgggttttccaggagtgtgtatgcagtgacttaacattatcaaaaatgggcaagtgagcttccctggcataaatggataagaaagcaaaagtctaacagggacctcacctctaccatgtatgaccatgtatgaccatgaggacattagcaccagactgtcagggtgccagagtggctcctgcatgtactagttctggaacttgggcaaattacttaatcattgtgcctcaattgcctcatttacagagtagtgataatataacaccgatctcatagggctgtcataaatgtcaaatgagtaaatgcatgctaagtacttatagcagtgccatacaagcagtagctgtaattattacatttgtgtttcttttatatttgggttaatggctcccttatagtgagggtgggtatacaagaaagagtgacaagactaaaggtttaaaagaaatggcagaaccagacagcaggctggttttttttttgttttgttttgttttgttttgttttttttgccggagtctccctctgtcgcccaggctggagctcagtggcgcgatctcgactcactgcaagctccgcctccggggttctcgtcattctcctgcctcagcctcccgagtagctaggactcccggctaattttttgtacttttagtagagacggggtttcaccgtattagccaggatggtctcgatctcctgacctcgtgatccgcccgcctcggcctcccaaaagtgctgggattacaggcgtgagccactgcgctcggccggaggctggtgtttttttaaggttaatcatcaatttattctatgttagcaatgcactcattttcaaaacaatatttttctatttatgtatctatcttccttttaaacagtacacatttaagttttatataaggaataaattcattttatttgtttttctctgctattgacagttttgttttttttttaatcttgtgctggactcctgcaggaaaactaacataaatccatccatcaacagtatttgaaacaattaaaaattatattgtttaaaattaaatctgtttaaaatagatgtctgatatttgtacatcataggaatttaaaattatttcaagaacaatggtagccaggaatactcttatagcacatcaaagcatagtttctcatggcataagtctgagctattttagccccttatcagcaatgcaagttcttaacgaactgatagtttttagatgagcttaacttccttcctcttgccaaatatgttgttgccatagctatctcctttacagcagtgatgttattttattagcatgagcttaaaaaattcagttatttctgtctgtcaagacacaacatacacattctctcaaaatttgcaattttctttttttacatgctttacttaatttaatagtcaatatgaaatcgttttacaaagtaagccagtttcttcacatatctatggaaacatttggcagttaaattctcctggcaggtacactagccagttcaaagacagagagtccttgggatgtattttctattgctgaggaagctggcttgatttgaaggaaaaaaaaatccaagtcaaatcatcctttcagagttttatgttataaaattctgggggatctgaatcaaaggttacttattcttaggtaaatgtgatgatgctttttgagaaaaatcttgtttttaagcttttttaaaactgcttccgtggaattaaagtgttctggtgattgttaacgataatttctcaggaagggtttcatgggtttataggtaactcccctaggcaggtatctgagatcaaatctacagattcagctccctaactcttgtaatgcagtgtccaaactgatagtttggctacccaaacatttgtcctgaaacagcagcatggggcactaatgccagaaagtcccacaaccaagagaatggccttgactccgaaccatcaaaaactcagtaatatttaagagaggaagttgagggctgataaggtttggctctgtgtccacacctaaatatcatcaaattgtaatccctacatatcaggggaggggcctggtgggaggtaattggaccctgggggaggatttctcccttgctgtactcatgatagtcagtgagttctcacaagatctgatggtttaaaagtgtgtggcacatcccccttggctctctctctctcctgctccaccacggtaagatgtgacttgcttcaccttcaccttccacaatgattgtatgtttcctgagggctcccagtgatgcttctgtacagcctgtggatctgtgagtcaactaaacctattttcttcataaattacacagtctcaagtagttccctataacagtgtgagaggagactaaaagaagggccttgacatccatcccttcctcctgatacattgagttctagccttatagctgattagatctctgaaatggtacattcttgaaattcattatctcagccctcagaatgatcatcatccttgcttttataattattccctcaagttttagaggacttttataaaattaggatatttgaaaatcaccctaacattttaggaaaacttaccaatgacacttctgttatgatgatgaatggcccaaatataagaacccatctgacaatgttttgctagaatttagcatgaagaaaaaatacttttgttgaagagtcactgctcattctttgttcatttatttatcaaagaaatattggccgactaccatgggggccagagtctgttctggatgctggacattcactactgctgtcagaaaactcactgtcaagtcacagaaagatataggaaaagctgacgctatgaggagccagggaagactggagactcaggaagaagtctatagcaagaagtggcatttggcaaggtgtttcatcataagtaaatatttgtatgtagaagaacaggaaagggccttagggacagatattagagctttggcaacagcacagatgtgaaaagtaaacagtgagaaaagttatgtgcagttgagagagagaagttccatgtggctagtaagaaacactagcaggagctgaggttgaaaaggatctctcagggtaggtcgtaaaaaacttgggatgctaagctccacagtaagttttactctgtggatgaggaagggtccataatgaacttaaatttaaggcgaacaacatggtcagatttatgagatgaactgtttgtgaattttataatggaatagactgttattgtgctttgaaaattcctgtattaccaggatgtagaacagattcaaacaaatagcatatgcttaattactatctgttgagtcgaatgcttagttatgaggctgcaagagtctaagggtagagatacagaataatgttggagttcagatatattttaccattgattcctcttttggatattgacattcccataactttttccttttcctgaaggctaggcaattcagagctatgcaataattatatgtgttcctcacagttggcatgcatgcttcttcctttttgtggcttttattttctgtttccattatattgatgttaactcttttgtagcttttatcataggccacctcaaatatgttttggaaatatgttgagtgtaaatgaacccatatttatttggaaacttttaggttaacactgctttcgtatttcaggcctattcacatggaaatgaccttaaaagatgctcacagccaccggctcaccctcaatgatgcgccccctagaggaggcctgcagcccactcaggcaggctgccagtcttattttggaagacggcaatggcaaaatgcattctccttgttatgtccacttgtctttttatttttttgtggtttcagaaatatacaagcattgagttgtcatgtacagggaaattgtctaaatgcagctttaaaaaaatgatatacatatcaattaaactctttaaccttctgggatttcttcccaactttaagaatctaaatattaaaggtaatctatggacaattcagtctgcaccatgaactataatcacataaaaacttcaattatcaacacttatgatctgaacttgctttttggtacaatagaaataataataacctaaagtgttatttggcattgttgaaggcacctcagtatgctgatatgcttgagaatcacagctatgcaggagcctacggcaggttgaaataagtgacagctttgaaatcaggaaatgtggtcctttcaacatcaccttcgcacctcattcacagtataattgggaaagtcatgcaatctcctgaaaatcttacttcctcatctgttagacagaaattattctttcatagaattatgaaaattgaaaaaatgtgtataaaagtatcccaatacagtatactgtataaaattgtattttaaaactgatgtaagtgaattatagaaattctggttatgggacattgcatttaacatagtcagtaaatttactgtaaaattaatattttcattatgaaagagacatatattttaccactctatgcccactattcatctatcctgaattaaacttggctgaaaaagttaaatttaaaaaaaagtttggtttgaagagcaagtatttcctaaatgtgatagcttaatgataacactgagttagttctaatctaacattaaaggaagaaacatgtacacttacgctttggatgggacaaatttttgttattcacatttgaaattcactttagttttagcacaataaaatttaataatttattagtccctcatagcactctgctgagaagtgaatgtcttgtcaaaggatcagttcaaagtagctttacttcctacgtttaactaatttaaaactgccttacctaggccgggcatggtggcccacgcatgcaatcccagcacgttgggaggccgaggcaggcgtatcacgaggtcaggagatggagaccatcctggctaacacggtgaaaccccgtctctactaaaaatacaaattagtcggctgtggtggcaagcggctgtagtcccagctactggggaggctgaggcaggaaaatggcgggaacccgggaggcggagcttgtagtgagctaagatcgcgccgctgcactccaacctgggcgataaagcgaggctgtgtcttaaaaaaaaaaaaaaaaactgacttacctaataaatactaaagtagtcctccctccagtttcagttttttttttttttttgagatggagtctcgctctggaatatgaaaaatctttagaattttataaaaatctgatactgcaaatattattacaaaaagttcaattaaattaaacatttttgtggtaacatggtactgacaaccatcatcttgttatcaaaatatatttgaaaataaatcaacctctaaaggattttttaatagtagaaataatataaattttttttattgttatactttaaattctagggtacatgtgcacaacttcatgtcctttgtagggacatggatgaagctggaaaccaacattctcagcaaactattgcaaggatataaaattgttgtttaagcagactacctgtttaaaagaggatgagagaagaaaatgaagtcttcatggctctgttatataatcagggtgaagcaataatttaaataactcaacaacatttataaaaactcaggtagttttaaaaattgtccattccctatatatgcataatgtaacatagaaggggctattcatcatataaggcatcttttgaaagctgaagagggaatgaagtgcatttttatttcaaatgacaaccataataagagactgcatcatattgttgttttttaaatgaatacaacttggttcctagatatataataagaatcaactgggtaaagctagaactaaacaattttaaaggcataagaatctctcaagtcgggaaaaacaaatatttggaaacttggagggaggaagagatcccactctttcttcatccccacatttatttaaaaattccactggttaattctctaaggaattctcttagggtttggcttccatgacaataagctctctttgtttagttttagtttctttcaaaaaatgacaagctaataccacagataaagaggtcagaaagaatggactcacaggcaagtacactttttaagtaaagtgacaaagcaataccaagggctttgacacttgagacggttcctgagtggaacgacaaggtgttctgtaattttactgaagttgatgagattatgctttctactactttggtagtttgggtgtctgacattgtgaatgtttgcatattttcacgttagcagagatacaagtattaggaaacaatgaaactggaatataataacaatcaagtgttctattgcctcttctaaaacatttgtttaaatgaagaaagtagcaggcatgtggccaaaaaactatacatgtatacactaaagaaatgttccaacaaataagaaaattggtcttgttgctttcagttattctgtgttgatcaaaacggggaaataatgtccgtttaaagctaaataaaatataaattccaaataaagccatgcagagtaactcaaacagtatttccctagggtcaagaattatgggttcttttcacaatgttaaatatgcagttgtttgtattctgggtctgtttctccaaccttaaaatgaattgtttaagaacgagctctaatttttcttcaagccctaagatcatatgactaaggagaaatgatatccgcatgcctggcatgagttctgcttttctaagtatttattattattattattattattattattattattattattgggcttggactcaagtgcctgttgcatttgttatcttaggcttatagtggttttcaatcttgttggtctcaggactctcctatgctcttaaaaattattgaggactccgaagagctttggtttatgtgaattacattacagtacattaaagcttaagtgatcaccaatgttaagtatcacttgccagttgctacctaagctctccagtaacctttggtctcatcagttttagcatgattcaaactgatcttcgaagaaagggagctaatttccttactgtatcattaggttaaagactgtgacttcagctgcttatgtttatgcttttagccagatctagtatctttctctgggttattctttaggcaggtttttgctaacttcgttaaacagatcaacaaaatattatttctcctgtgtctactatgtaaattatctctacctcctcttactaaaagaggatggaactttttgttcacatattttgaaagaagaaaaatgttagttttaaattttaattttaaattacaaaaattacaattttacaaacacagagctgtgacaagtccctattttaatacttttaaaaggcattatagttattccttcatctttaaattttatatttaaaaatgttttccaggctgtgtaaagtttgaaggcactgtatttgctgaaacagtcaaattttatcttggcagtaattgcttctttacgacttgtctgcctgacagtgtagtagatgatctcttgatatgtagtctgaggttgcagactcctaaagctgtctgtggctactcacagaattcctcgcacctactccaccactgcttctgtgaaattatatgttccttaaagtgtgtcatgtaattgtccttagttcttcctttgctcatggtctttgtgagaacaaacttcaaatgtattcaatggaattgatgtggctaggaaaatgtatagactgccgtcattgctacattaaaataataatcaatttcaattctacggggtacacattaatggatatggtttggtgtgcggtaatttccctgtagtgaaagagtatttttctattatgtatatcaaggggcctgagtctttcttaggagcaactctctatcatacaaaataatcatgaacagatggcttttgttctgttttagaatggcaacaattatgtgtgtgatattttcaatagcgtgcagtatagaaaggaaaagaaaaatataattgcaaacttttgttagtgctacttttggagcaatataggcaagaactaagccaattcatgaagatggttgtatgttaattcctctctcccacacaaattttagtgagggcattatttcttacaataaatattgggaatcaatctctttcatattgattttattattttgttctcccaaatgccataatgcatattcaaatctactcagtaggcaatttagtctagcagcaaatggttgcatattggtagtgataatttaaaggctgctttaagaaaaagtggagaagacaaactcaaattatttagatctaaaaaaacacaaaaggtagaatatcataaaatgatacaacatctgaatgaaatttcatggacaggctatttttggtgtaaatgttcataattaattttcagcagctatattgcttttggaaataatgaatatgtactttatcatgaatatttatgaagtgatatgaaagattaaaattattagcaaaaatgttgaaaatatttttaattccttttttctaaaaacttttaatactatcgcacattgtttttttaatgtcatgctaaaaattttgtttcttatatgatatatgcagctctttaaaattgtaagaaattattcatgaatgcatttaacttctgccttaagaagataaaggtacgtcaagagattgtacaatacttaaaaatgcagactttattaaaaacacaactatctctaaaaaatcaaaaatacctctgtataaaacgtgatttaaaggttgactattagtgcgctgcacaaaaaatgaattgctgtaaattgttttaaaatcataaattatatttaaaatttaaatatgtacacttgcataatcccaaaatattggtcaactacttggtaaaatcaggtggaaaattaatcagattttcaatttttccttagtcatgtagttagagaatctgtgcatctctcacatatgtgttagcggaaagaaaccagtaaagattatctctagaatatgttagaacctgcactgtttctctccggcaatgcctgagacaattccacggagttgatagtctttgtatcccaacagccacttggcttcccacctggggccacgcttaagagatccagaccccatccttccttgggtggagcttcagcttcatctgttctgtccttctctcctcctatgccctttcctaattctgaatagcaaagatgggagaaattggtggttgatttcaaagatctgaactatattatatagtaggcaaagatttctttataaataaaaaaaatcactaaaatcaatgataattgtttatataacactatttgcttcatccagttaaggttgcagtgtagttgaccctgaagagaaggccaccacaactctctctctacatatatatatatcatatatatatatgatatatatatcatatgtatcatatatatgatatatatgtttatatttacatttatataagttgaatatatgatccaaatggaggaattcttcatattaaaaatagtttgtttgcttccttacttatctgttaatatgtcccttaggaggaaatcgcaagatgatttaggacaaagagcagtatacaatcaaaaagatctgggaaataaactgtgttcttgaggcttcaatttaatgcatttagtgtggtacctaataaatgaatatccattatgatactatcactgtgtggtttggccacatttatgttgtgccactgagtagagatggaaggatgtacgcaactctgcatcccagtgactccagaacacgaacactgctttagttagtctccctgactttgctccttctgtacatcctctcagagatagggtgttttctgagagaacaaagaaaggcatataccgtggatggctgctattcctgcctatccagtgtctatttctccttttctcttaaaaacatctgaattttgtttgtgtgatttagccattagatactaaattttgggggggggtgttaaaatgtgtcacttctcctgaacttagttttgaaaatcagatgctagcttcctaaaatgtgcatctttaggtaaagaacatataaattaagaaatatttggaagagactcatgggaatggcagtatctgaagagaccatcaatagttcctgctaattgttctcaacttttctataccttgtcctttctgaaacctcttcagctttttccctcaatatccttctgataaatactccttttaattatatgtgcatgtgtatatatacacatttatgcacacatacatacatgcatatatacacacatatacacatacatatgtgtgtacatgtgatatgtttgtacatttaataaattacccagagttgggttccactggttaatgaagacctgtatttataataaaattctgaagagttagaatatatttcattatgtaggagaagcgtcactgcaaagcatcaccaacaaatcatgttgaaagagacaggaggagatgtggaaagaatagtaccagccaaaatacgcaatctatttcataggtaggcaataaatactgcagtagggttaagcaaaattaggctgaggaaagagcacttattttgacaatgaagacggtaatcatcagagaaaatcctgtaccctgatggcccaggggaagggggagggggccatctatactgccatggattaaggtgaggaaggaagaggttaataaagagagaagagaaaatcagccttgggaaagagagttgaagattacaatatgattaatctgtgttatttgaggaaagtgggaaaaaaaggcaaagaaagaaatgaaagatttgacacctcataataggaagaataaataataaaagagattaaaagagaagaaaacaaagcacaggtgattttcctagaggaaatagtaaacacagaagtaaggaaatgcaaagagcttaaatttacagcctgtacaattttttagaacacaatggtttttagtgttcagcattttccaaagtcaggcataagatgattctaaaaaagcaataaaacactctgttttatgtactctccatctttatacttgcacattgttttatttttaatttttttctgaaaaataaagagagtttgaaaaagcaatgaatatataattcctagtactgtgttgcattgattttacttaaaggaaaaaaaaaagaaacttaagtaggattgacccaagtatccaaacatagtacattttttctacttatacttctatataaacagtttgatacagatttgcgatcaggttcttataaatctaaaattgatcaggtaattcaatttaatttaattataaaatagctaggtagacattttcataatagataattaaaaattcataaaagagtacataattgaattaaaaatggattagctatatttgagatgctgtgtcctatactcacaaaatttataaattggcaaaagtgtcattgttaaacgtactgtttttcttttatcaaaaaaccctgttgctgttcattggacagtttacttttatactttaaactgacattctatgaaaaaatatgaaatgataaactagtatgttaagcagagagaaaagtattaatttacttttgaattctgagacctataaacttgtagtatctattaactgcatgagatcttgaacaggaaatagaaaatattttactgtccctacaacaaatgattaagtgctaaatgggtaatggataatgggcagctaatggataacactaagaaaattcctcatgccaaggcaagaaagaacgactttaaatcatcaggaacatttgaagtatcaatatttatagaatttttacaggaacaattaagagagatatagagtgcaaaatgtgagtaaatgtattaactcagtgaatattataattagtgtaaaattttggtgtgcctggactggaggaaaacaattttgattaacatgaagaaaaattataattgtcaatggcggcccaatcttgtggaactttagatctaatgagaaagactatagatttcattctatctttgtaaaagaggaagaattaagatcttagaacagaaagcagtatgaccactgctgtactatggaaagaacattcttacaagaaagtgtagcatgaatggaccagaggcagtgaggtcaaggagggggtcaataatgtagaaataattacgatgccttttaatatatccttcattgaatcattcttcatctgcattgatatcacactatgtctctgattagacatagtgtgtctaatgagaatggctcattgtctgagctcccctattgattgtgatcttctctccggccaggacataatttatgtaattatgatttatgattatgtgccctagacctacctcaggtaaaggttaattaaatatgtaaaaccaagtgtgagtgaatatcaagatgtcagaagatagaaatcattaggatattagttatcagtgtaggataatgaatttcagtgctaattaggaattgcaggagaaaacaataacagacagattgaaaattaggagactacatggttccatcgatcttaaaagaacaaacacttgccttttatttattcaggacagccgggccatggccttgtgacctaagcatggtcatttgaataatccagcagaagactttatattttaatggaacactacaaaggcataaggtttgagaaattattaatagcaactacaatgtccacctgtgtccagctgttataaggggagtaatgacatccccagttaattttctcttgtcaaagttttgcctttatctgggtattcttgaaaaaaacagattcttcaggactcctcctgtgagcagtattctgtgagcaactgtttaccaagtcaggttcaacctaaccctgtctaatatagcatcataattgtcaaaggaagggctacagagagaggagaatttgaaattcaaactccggatatgttgacagcattaaagaggtgggaggaccagaaaagtagaaaagggaacaaagatgagtaagaaaagcataagggtggaaatttttattcacaaaagcaaagcagtatcaaaaattttgccttgcacattataaacgtgtaagactcttctgtcttataattatatttatgcaatttttctctattgtcataatttttttgttgaatttattttccacacaggtctatagaatttatagctcaactgtgacttccactgttgattttctactagtagttcagttacttgtaccttgaaaataaaatttgatagcaaatttgtgtaaactagtgattagtgagcataatgtattttgactgtacattttgtaataatataggcaaaatacactattttttacattttatatggattaagaataattttatgcttctcaattgattagtaaaatataaccttactttctgtaagaataagaaaatatcttgactaagcctacagatttatttgtaaaagtaagtaaaagggaaggttttaagtatcataatgattatgtatttaatttgtaaatatctatttaattttaagtaagttatttattttttcttattttttgctaaaaaaattgttatggacacctgtcattaaatgttagtactattaaaaccttatgatctcaatttttctattttagtcattttggtattttcaaatggaaatagaccctaatttatgtgattatcaagtggcaaaaagtttaaaagttgatattaatatattgatcaatttttattggtatgtacatgttgcatgagatacatatatatatttgtatatgtgtacctacaaatgtcattatgtttgtgacaaaatctttaggcaatgctgataatgttaattactaaatttccacttaatataattttttaaagaaattaatacatttttaaaatgaaggcataaaataatcctgttgttatttaaataaaaaaaaaccttaactctggctgtaactatgctttatggcaatacccaaatatcttgagaacagcaatattgaaagttttatatgctaataagaatgtaatttacatttatagccgaactttaagtaattcccatataattttattgtatattaactaggttttcccattcatatatgtgcattaaattccagcttttaaaagtcacctaagatgtaattaatttataataattacatcaaacattctgaatttatactttccatgttgctaaatgaatctctaaacattaaatcaagtattgaagatcaaagacaactcatggacacatagagggggaacaacacacactggaccttttttggagggtggaaggtgagaggagggagagaaccaggaaaaagtaactaacagataccaggcttaatacctgtaggatgaaataatctctacaaaaaacagctatgggggaacaacacacactggaccttttttggagagtggaaggtggaaggagggagaggaccaggaaaagtaactaatgggtaccaggcttaatacctggaggatgaaataatctctacaaaaaacagctatgacacaagtttacccgtgtaacaaatctgcacctgtacccctgaacttaaaataaaagttaaataaatttttcaaaataatattttttttaaatcacaaaattgattgagctgtctacctacaaacagaactgtgtaatgggtaaacaaataatgaatcatcttaaaattacatacttcacttgaagttgagtctgaagttgagtcagtcctagaatggcagacctccacagtcctaaacccttttctctgcacagttacagtcctagattctgttacagtagagcactgagggaaataaacatcttcacatttgtacttggttaaatggaattaaaatggtttcatagatgtttagtctaataaaatttgtttttttctatgaactatttaatttcattaattttatattttactttgatatcagatctagctccaaagtaatgtagaaaaacgtttttaatttaattgtagaaaaaatatagggttaaatatcaaaacttatttggaactctatacaaaacatattatataaatatatgtaattgcattatcaatttatgttgatggcaaagtcatgctttgttaaagatatctcttaatactagcacagcataaatatctgtgaaaagaatactctttcaggtttattggagaaacgttaaaaatattcactttttcatttataagattatatactgtcatatcttgaaagtcattaatttggagttatcctggtctaagtaatatagtacaagaatagtttttctgggtttagtaatgagcagatagggccaaataattatgaatagaacctcacaaattagatacccaaaataaggcacccagatttctagtgagtaccagaacaaagatgtctgtgttggcacagaggcagacagcttgagggatgtctaactgtacactgtaggataatttgccaggagagaattttgggaagattttggtaaataagcaataggcagtgggtagtaaagccatacctgtgggaagtaaaaatgtatggcaataactgggtagggtagaaaataaaaaatggtttggcagtaattgaaacttcagtaaccaaactacaagcatatcaatcagcacaattttccagttggtaaaaaagattaaaaacatcaagagttgttggagaacaagcggacaagagcctaggtagcagaacaagggcaaagtggagagctcagttaggaatgcttccttccatttatcttgccaagggaaaggatcttcatgttcatgtgaggcatgtgaaagcctctgattaattacttctcatattgaaacttaaagggctctcagaatagaaaataaaaaaattacttttactagtatactctagcacacatgttcttctaataatagaactgtacatgtacacattattggagcacctcaaaacttccccagaaaagtatctacaagccaactcatattaaatctttgtttctttttacgtggcaaacatgaaaataacttacttggcaaagcacatttagccctttgctcttttccagctgatgttgcctatgtttcattcaggtgtcctccaaaggttacttgccttttctttgtaatctagccatttcattaacagaagcaaagatgcaaaagtgccctacaaggctggcctcatttcaaacgtttacatgctatttacaatctcccatatgtgctggaaagctgatgtttaacagcttaaaaacattatccaaatttttgatgctgtcagtgtaacaaagtgacaaattcctaaagaaattattaaacctctctctcattctctatgcagtctaagaaatagacccaattgattttggatgtaaaaaacaaaaacaaaacataacaccttacctgctaataaaaccttcagactagttcagactccttctgtacccttttatcctatggctggtctccgtcatgtaatctagcccgggctggatcttagtggatgctgctcatgacattttctgctttctcatgcatactctgagtctatgtctgatttcataccgtaagttgaaatgtatggtatgtatatgtactgctgaagaactctcttgtaagctaagtttccccctttaccatataattataaacaaagtatattttatccttaaaaatagtctttagttgataatcacatttaaatgtgacctaaagtcgctattgacccgacgggaatgatatggtttggctgcgtccccaccgaaatctcatcttgaattgtagctcccataatctccgtgtgtcatgggaggaaagaagtagagataattgaatcatgtgagcagtttcccccatcctgttcttgtgatagtaaactctaatgagctctgacgggtttataaggggccccccccttctcagggaactcattcttcgccttgctgctgccatgtgaagaaagacgtgtttgcttccctttttgccataattgtaagtttcctgaggcctccccaggcatgctgaactgtgaatcaattaaacctctttcctttataaatcacccagtctccagtatgtcttttttagcagtgtgagaacggactactacagggaataagaacaaattttactgtggagaaaataaaaccagaagcagctagagaactgaagcacatgtactttagttattaaatcctgaatgcagagcctccaggaaggttgctgtggaagaggctatgatactgggtaggtgtttgagtgagcaatagtagtagtaggacaaggctaaggaaaatgctctcatcctccaggagatgagaaagagtggctcacctttagaagagtagaaaagaccaggagaacggcacctgcgagggattatgagtggccaacatccatcaataaaatgctttgacatgagtggtgctgggagtttcttgaggaaaaaaaggacaggggactttagattgttttgtgtaagtcgttgtaagtctttgatatagagatttgcctgctcctaatttgaggatacacaaaacacgcagaagcataaatgttgaatgaagaggagaaaacacattttcctcggtaaagagataaagaggaaagaaatcctagtgggcttttaaatgcctttatgtgtacctgtgactttgtgtacctcacttttagctgagatgcctcaaaatagctgtcaattatctttaaaaaacagaggaaggcactcaatgacttttgaaggctttggaaaaacggtggctataaacaagttttgtgccccttgtccacccaccaattggaggatgtgaaaaggttaacatcagagagaccacaggagtttgaaacttgaagaatatctttagagagtattgtctgtgttctgtgagtaccttaaactatggaagagggatagtgttccatccccatagcaaaccaaactggggaggaagggatgtcaaaaaaccattcactgtgtttcctgtatctgttggaatttttataaaagggtggataaatgtctaactcacatctagaaatataaagggtaagaaacagtgactgaaactactaccatatgcaaaatgaaaagagggttgaatttagcaagaaaccgtacttctaccagaagcatggtccaacattatgtgattcttctggacccaataggaaactctaaaacagagagaaaggaggagaaacaggtttgtgctgtcctagatcctggctaagaggttcactggttcacttgcagggttaatgagaccctatcaaagagtttctgtaaacttctgtgtggaggttgtcagctggctagggtgttctcaacccattttgagaactgctggtgagactcactaatggaggagggaatgttccttaagaaaccacaaaaatgctcctatgagtcagctttgtctcatcacaaatgagtcagaaacacactttagagttatgtctgtaaagtaagactttttttctgtcatattaattgtttttctactattaccaactatagaagggccagagatcaggtaacactaggtaaacaaaaataaaataatccagccaagcattttttcccattatagacttcttctctgtagggggcctgagctacagaagggggaacttgattttgagtggggtttgcattttgattataatattgagttgtatataaatattaatgaattaatactgtagaggataaatttacttcagaacatttttatgacttgagaatgacaaaaaaaaattctgtttcattctagtgggtgagagactggatatgcacattgagtcaggagaaaagatttagtacaacattttaaaatttttttccctgaaatttttacttgtccagtgaaccacttagctttgctacggggtactgtaaacttcatagcacatacaaaattatttacttcaatatcatttcttggaacttaaaactctcagaactctggtgtatcagttaggatttgatcaggaaaagagaagccacgaggtaagaaagagtccaatcccagaaattatgggtattaaaagaaaaactttaacaaattaacttagccaagttatttgagcagagatacaattcatgaatcagaaagttccctaaaccattaaaggatcagagaccctcatccagcaatgcggacaggcaatatttattgacagaaaacgaagtgacatacaggaatagcctgattagttacagctcaacatttgccttatctgaacatgtctgagtagttttcagcctgtgactgacttaaagctaagttgctatggttggcctagactttgttacttgttacaagaatacactctcaagttgcagtttgcttacatattaggttaggttacagtttgctatgtacagaggcagatttaagccaaatttaatttagtttatcagaaaaattgaatgtcatggaagtgatggagaagtgaaagtcaggtatctcagctgcatctggtgggtttcaaaagcttgcccagaagtcactgggaattttttgactcatgaggggctaccacagattatttcagtctgcaacaccaacagaagtaattcttaagaagcaccatcttgctatctcagctacttagagtactaaagtggatgattcaaggagcttgcccatagatatgcttgaagctgcaagaattacggctgctccttctattctgccttccaaactgcacaagtgcctcattgacagactctaacacagaactacaaagggcagaaaactcaaagaaaggttcttcttgaaaagggtgacaatgattccaagttcccaaccaataatgcagcacatctaatttggcacttcttattttgtcccttttcccttatgactttttttgtagtaacatattttactattttactgctattatgttgctcttgaagtcaggagtcatagtgattcaatcacttgttcacttatccatgcagcatataatgagagctttgactatttttcagtctctcaggctctgagcacaaggagtgataagatgcaactacccagaagtatagtcgtatcattcacacttatttgcaatgagaaacagtcaagtgtttactgagagtccatgaatgaataaacatataaatacacatttttcatatgtggacagtaagcagtcctttatctctaggacaacagaatgttgtatctaaaggaagactttaagaagatatttgaagacgaggtgctgccattgatgtgttaaatgtacaaactaaaaaattgggaacataaattgaagtatgcggtgcttttcttgtgctacacaaaaacgagtgttcaatttcagttggtaatgcttattatatgaagttttgaaacatagtttcattttatgtattttttagggcagatatcaccatatatcacacatagaagcatatatgaaacatgcttatcactcagggaattatgaattgaataagccataccaagttcttaccacctctaactagtgttagaatgtagaaaagaacataaactgagacttaaaggggcagtggagtggggtgggaagaaattctcaaagtccaacctgcatccagagtaagtaagtttgttagatgaagggaatcctaggtggtgttcgaagacaaattgaatgtatctgtatggtcttttgtgaaaccagtttgataaacaatttcctgataatcccaaggcctcctgaaatctctcaagcatatgaaattggggaatccgggggcaagactgagcaggaggtgtatggcccccagtaatagctctcatctacattatgtagctctgactgactctgagctgaattactgttttcttcacatattcaggtctttttgttttcaaatatactcgatcgctgaaggttaaaaatgtaaagcacaatttgtaaataaaacagatgtcaaaggaaagtacaaaatatcattaagtgtatctgaatgccaagttctccaggtgacagcaatgtgaagtgcacagttaaagatgaaaagaaaatagctcagttatttgggtgatcaaaagaatatctggatgattaattacatatttgaaacttgaagacatttcttttgtttcattttcttttgtcttttcaaaagaaaaaaatgtcaagggttgatatgtcattttagttaaggtttatgagctgttttttttttccccctacaggtgaaatcattaacagttttagcatttaaacagagctatttgagcttacaactaaatcctcttggcatgaaagctcttgttttgctactcatggttttagtcttcctagaagctgattgattaaaaccaatgtgctcagagaattcaaaataagaaagaatacaagtaagaataacttttgacaatgtaggctaagtcagccagtttgtttcatttatgtcgcctttcttcttcacactttttacctgattaaatcccattttcactttgtgtttatttgtttcaatttgattagagtttctgaaatgaatacttagattcaaataactatccataaagccatgtgactgtaggattttaattcatatattagtactcgcatacacaattattaacaaatcaggaaatttctacatttcccttgaagcaagatactgtatatttagtaaaattccttgataaatacttggaatggaagacacaacacccatgtggtaaaagttttctggttccaaggttttagcaaggaggacataaactattctgtgtaaaaagaggaggatgaaaatttgtttgcttcttgagagaggaatgggtgtgataaaagataataaagaaagaaaggactcaggaaaatgaagagatgatttgaataggccaagtggaactccctgaatgatgaatatccaaaattcagatttagaatggtggtaagattcttctacttgatatttgtcatgttcaatcaaagcacttcctccttcctccctcccatctgaaatctttagaaaaaccatccatttaaaaagtttagccaaaatactgaaattgaaattttatctatataaataagagattttgatgattgaataattgtttggttatttctccttttagtatttataacttctgattttccagtctatggttttacattttgtatttttgtactttttacttatcatccaggaaacatgctgaaataaatatggagctaaagatcacacatattaacagcttaactctctgagatatcaccataaccaatgctaataacttatcttctttcaatttgtagataagaaatacatgcttttgtccatatacacacagaacaaatattctttgatatatagatatatttttttgccatgatgatcttaatttttacatataaaatgtttgtaaaataattccacatgtttgaactcagctataaatttaaaatccattcaaagttaaaaactttaagataaaaattaaaatgtcttataaatttgtttaaattccttatagatgctggatatgataactttgacaggggcatagtttgcaaatattttctttctgtaggttgtctatttcctctgtagatagtttcttttgctgtgcgtaagctcttaagtttaattagatcccatttgtcaatttttgcatttgttgcaattgcacttggcatctttgtcatgaaatctttgtctgttcctatgtccagaatagtattgcctaggttgtcttctagggtttttatagttttgggttttccatttaagttttactccatcttgtgttgatttttgtgtatggtaaggggtctagtttcaatcttctgcatatggctagccagttatcccatcaccatttattgtatagggagtcctttcctcattgcttgcttttgtcaactttgccaaagatcagatggttgcaagtgtgtggccttatttttgggctctctattctgttccattggtctatgggtctattatggtaccaccacttaaaagtgggcaaaacacataaacagacacttttcaaaagaagacatacacatggccaacaagcatatgaagaaaaactcaatacccccaattattagagaagtgcatatcaaaaccactatgagatatcgtctcacagcagtcagaatgctattaataaaaagtcaaaaaacaacagatgctggtgaggttgtgaagtaaagggaaactcatatactgttggtgggagtgtaaattagttcaactattgtggaaagcagtatggcaattcctcaaagagctaaaagcagaaccactattggatccagaaatttcattgctgggtatatacccaaaggaatctaaatcattccaccatgagggcacatgcacacaaatgttcattgcagcactattcacaagagcaagacatgaaatcaacctaaatgcccatcaatgacagaccggataaagaatacatggtacatatacacaatggaataccattcagccattaaaaagaatgaaatcatgtctttgtgggaacatggatggtgctggaggccattatccttagcaaactaacgcagggacagaaaaccaaataccacatgttctcacttataaatgggagctgaataatgagaactgatagacacaaaaggggggcaatagacactggggactacttgagggtggagggtgggaggaaggagaggatcagaaaaaataatacttggtactgggcttagtacctgggtgatgaaataatctgcatagcaatcccctgtgatatgagtttacctatacaacaaacctgcaagtatactcctgaacctaaattaaaagcttaaaaataaaaataaaaataaaaaacagtgacaacaccaaagactgatgaggatgcagggaaattaaatcagtcatacacttctggtaggcatgtaaacaggtacagtcactctgtaaaacagtttgccaatttcttaaaaaactaaccatgcaactaccatatgatccagaaattgtactcctgggcattcaaacccagagaaatgaaaatttgtgttcacacaaccacctgtacacaatctttatggtagttttatttgtaatagcaaaaaaatactggaaaaaaaacctctaatatcatctgtagactattactcaacaaataaatggaacaaactattaatagaagtgataacctagataaatattcagaaaattatgctaagtgaaaaaagcaaatcctaaaaggttacatattgtataattccatttatatactgtttttgaaattataaaattatagaaatcgagaacagaatagtgattgccagggtttaaggagagagctaggggtgggaggaaaatgattgtgactatgaaaggtcaacaggagggatcctcgtggtgataggaatgttttctttattagctttatcaatgtcaatatactggctgacattctactatagtactgcataacattaccacctggggaaattggttaaagactatgttgaatctctgtatcatctcttacaattgtgtgtgaatcacaattatctcaaagtaaaaaagtttaatttaaaacaatattttaaaattaaatagacctaatttattcatttaaaaaaattatatattttttccagacttaaaatatagattatgaccaaattgttacatattgaccatttaacataggttgtaccatctctgttacattattatgtatgtatacaatatgactacatttcaatagtttttaaattttgttttctgaatttcatcacttctgaaattttaccacactgcctgatcatctttggaaatagggaaaaagagaaagtagattaggagtgagatgtgaaggcaatggatattattgacatttctattcttctgtttaggtttctaaatcaattgaaggaattaaatgacatataatcaagtatttaatggcctgagacttggaggcatgtttcccaaaatccagacttatgtgccactatttattagtaaagattcttcttaaagcaaggctaatactgagttgcataattgtgttgacttacgtactgttaaattctaagtgatccaacaggttatatttcagactaccatctatacaaaacagagcacagagagcagattccatactgtggatcatagttttagaatatttagtaatcctttgagtaaagaaaaaaaattcttaaaacatttctttctggtgacattttgaagccttttgcaggagataaatagaaatatctagattaaaaggaaataactacaacaagttcaaagctaaatatagagatttactgaatatttccacagtcaacaaatgttttcacatttgaaacagaaacatatttaatgagagctcctgggcttaatatatggccaaagttctattgcctgttttaaataacaaccaaaacaggaatagaaaaatggaaatgagtaaagcaaaatggaagttgatatgccaggcctaagggccttcttctgttcctttatattcaatgcttttaataaaaagagaaaatgcctgcatgtcaacttttgcaaataaaaatatatgggtttttagcagtcctaccagtaggatttcagaggcattcttatttctctgaccatatacattctgaaacactttattgttcacacgactatccttgatatcttgatatcttaggtaaacaagctgtttttctttctctaaaacaaagcaatgtttttgaactatgggtacaattcaatgaaatatgaccgaaataaatgcttagggtaaattaagaaagaaacttttgtttattattttaatatttcctacatacaaaaataacatatagtaagcacatcttattttatatatgatatttaataaggaaccataaataaaaaataaaatttaaaggaaacccaaagtatatgttttttgttatacaacattttacctatagctccaatagaaaatatagaaatttttgaaaattttaaatgtaaagacaagggaaaaagagaaatcacaggagagtaccaatttacttaaaagttatcatttagagaaaaacattccgtttgcttaaaaattgagaattatttcatttggagcatcattacacaagacagacttctatatataagtatatcacatatatatggatgtaagtatacatagactcacagaaccactgtcccaggttctgtagaaaattaggtcatatggtgaaatatgaattcaattacaacatgtcagcaatttgaatgactctaagaaataatctggaatacatttttccaaagtttgaaaattgattgcggtatatttcatgttcctccaggttttcacttttaccactctctttcatgcattgacaggtattcttgttttattcctcccagaatctcctcccctatatcatttatctaccagggacttctcagtcctcttttcacttccgcatcactgcatgttcctttatctccttttctgttacaatctcttattacatagtctcctttatggctctcaattccagggttcttctattcttttttctccctcatgaccttacccacttctttagagccagtagcctagtagggggctctgtccagatgttccacgtggattcaaattcatatggtaacatttaaccattatttctctcctggaatgtgttttgctttgaatcttttatcttaatttatgtcaaacattgaactagtcattcatgtcaaaaatcttatttttctattcccattacttatttagtaccaagtgctttcactttgaacactgtcttaaaaatgtctcctcccaccaatctcagccaccttaatcagccctcagcaactctaattactcctgggtaatttaatgaggaaatagctgctaccagccactttttattttgtcttcttcagtccatttgtgtattgccactctacagagccttctagaataacagtctggtcatgttacagatttggtgaaaatcttacaacgctgctttatcaaatctgttctattgaaaaattgttctatcatcaaaaagatatggaaatttgtgttaaacaataaataattttcttatattacaatgtttctaagaaatggaatatgttttctctttcctagagcaagacatacaatggtatacagagttttttgaatctattagatcctaaaacggtttatatgtatcctcccataaaacactacacagaaccagtgttccctagggcacattttggaaaacttaggtcaggattaaatctgacatgctttgtatgtacaaagaaggctctgaacaaagtaatccatgcctaactctttgtgtcctactcatgtacatcattcaatggcctggcctcaacaaactttgtagttctccaagtatgccacaactctctttttcttctttggttaaaatgcttgacttcctattagcagtctgttgaatgtctgtgtattatgatataccaattcatacacaatcttcattcttgatcatatcttgatatattcctccctctagtgaaagtggtcattatcccatttgtaccattctcccagacttaattgtgaagatgagaacgagattaatcatctttttcatccatatactctagtggagtcccaagaacattgacattaaataaatgctttttcattaagtaaatgactgaagtctagttcaacatttaatggacatctcttatgtgtcaccaactataagaattgaatgatgcttttcttatgagtataattatagtacatattttatgagattgttttggtaattaaaatgaatgactgtaaaacatttagaacactgcttgatcagtgctatatgagtttttgttaaaataaaatttaagaaaaggaatactagagctcagctgtcaagtagcttataaatctaaagcagaaaataagtttgcagacttgctgattgtgccaagcagaacacgttaaaataaagttttgaaatgtatgaaatgaagatggagaaataaattccagcagaaagaattgagatggaaactcagaatccaatgttagtgaagaaaaagattctgtaagtagaaagccagcttcagagtggctggtcacttgaaatttgtgcatgggtatttctcctattgatgaggagaagcaagaagtattcaaccttaattgtcccagtcattttcatatgcagtccatgtttaatgttgaactaaattctagtatttattttacttaagtcatatgtaaaacagtctttttagtatagtgatttttagtaaagtggctgcttcagtataattatctaacactgataagtaaaataagtaaacaattatttttttaaactttaaccaaatgcttgtttcagacacttagataataatttaaaagtactaaaatatctagaattttcattaaatatttaatgaacaagagacttagtaagtgaaaagagtagatgttaatataacttaagtctaataaaatatctttatttctctattcctctttctagacagatactcttacatgtttatatctgcaggacatgtgttcctagagttatgaaatatattaaaattttgtttggtgataaatattttccagaaataataaaattagaaaataaacatatatgcaataattttaccaattttacaattataggattgatttaataacttggagatttataacatgatattactgtgaggttttctttatttttctaagttaaaaagcatcacttgatataaaaatattaactaatgacttcgtttttgtgtttggctgttttttacccttctagtgacaagctactagggatataacaactctttattgttaagcttctaataatcttgaaaaacatctcctggctagggaggaaggaatctaaaaatgtctcattaaaataatcatttggtaacttttttttaaattttcttcaaaatcaagcagaattacagcacacagactccaaaagctaaacgtgagtacatcctttccagatctaattaatccacaatttgtcacaagaaatttattctacttatattcattttctgaacaatctccgccactttcgggttcttctgacaccccacctctaacctttgatatgccggtaaaattggagagattgccacactattttgtgattaagggcaatttcaaaagaaattgagttctcatgctatagagcaagaacttacctaaagtagtcaagaaacaagagaaaccagaaattgttttacatgagacagatctcatatttttaaatatagtgtaccactttcttaataagtaaaattaaaagaaaaatgtaacttaggatacagaaagtcctaaaggaccattactccctcctaagaataacaacaaaatataaaagttaccagctcaaagaattagctaatggttgcttttatccctagcagagaaacaggagaggattttgtagtacgcctgggatatattgtgttatgtattaataaaattgatgaaaaattgagttttgttttttgttttttttttttgagatggagtctcgctctgttgcccacctggagtgcagtggcgtgatctcggctcactgcaagctccgcctcccggattcacgccattctcctgcctcagcctcccgaatatctgggactgcaagtgcccgccaccacgcctggtttattttattttattttattttattttattttattttattttattttattttttgtatttttagtagagacagggtttcaccgtgttagccaggatggtcttgatctcctgatctcgtgatccacccgcctcagcctcccaaagtactgggattacaggcgtgagccaccacgtctggccaataaaattaaattttaaactaacaattaaaattttaatacattcagaaatattcatgcagggactgtggtggattacaatatcaaggcacccttgctatggtgtaagtctacccattcgaaactctttcccatgggccttcattgagcacactgaaagtatagagtctgggagtcacaccagtgggttgaaaaaaattctttcaagtcctctgggcctttattgcatccattgctgcagtctcaaataggtggacataaagcatgagaggtaagacaattctaccaggcaaccagggtttttatgcaattgtctccagcagctgtccaaagtctagaaacaggcttcaggacaggcaaatatctcttgaggttcagaaagtctggcaggactagacagcaataaaattttccagtaacccacaaagtcatcacccaggctacaaagcagagaatgatgttctagagtttggaaagttgacagctatctgcaaaatatttaaaaaattgggattttaatcttgctcagatcccaagtcttgctgaagacgtcataatctcattctcaaaatacttgaaagctgtgatcaattaactcgaaaccaaactgagaaccagtctacctgcagattaggttaaatcaggctccctcagtttggcaaactaggaaaattacaggaaacatttaaaatattctaggccgggcgcggtggctcacgcctgtaatcccagcactttgggaggcggaggcgagcggatcacgaggtcaggagatcgagaccatcctggctaacatggtgaaaccccgtctctactaaaaatacaaaaaattagctgggcgtggtggcaggcgcccgtagtcccagctactcgggaggctgaggcaggagaaaggcgtgaacccgggaggtggagtttgcagtgagctgagattgcgccactgcattccagcctgggtgacggagtgagactccgtctcaaaaataaataaataaattaaattaaattaaatattctgaggagaaaattttatttactacaatgtttgtgattctttcccacacaacgttcaacatataataaaaaattatgagtctcttgaaggtacaataaaatatgacccatggtctaaagaagaaacagtcagttggagcaaccccctattttggattcagttgctggaatcatcttatagggattcttaaataactgtgagtactatgctaaaagatctaaagaaaaaaaggggacaatatgtgcaaagacaaggtatgtcaacagagattgaaactataaaattaattctgatagacaagctagaaacttaaaacaattcatattagaaatgaagaatgtatttgaagggttcaaagattaaaagccatggagaagataagtgaatctgaaggctttccatagtaatcgtctaaatcaacataaagagaaaacttatttaaaaagatcagagcatatgatgcctgtagaataatgacaaatagcttctcacacataattagagctagagatggagaagtaaaaaagagtggaacaaaagaactacttgaagaagtatgtagtaatcattttctaaaattgatgaaaagcataaatctatagttctgagaagccagcaaactacaaacaagataaagtcaaagaatcaattatctatgtacattaaaattaaactgcttagaagcaaagaaaaccagaaaaaataaaagcagcagggttgatatatcacatcatgacatcaatgataagaatgacaattgacttaagaaacactggggctaggagacactggaacgaaatctttaaaatgctggaaaaactctgttaaggattctttacctgtatctatgtttttcaaaaagaaagaagaaataacacttttaggcaaaataaaagctgagataatttgtcttcggcatatttataatataaaaattactaaaaatacttgtttaagctaatgtaaaattatatcagacaaaaatccagaactccagaaaaaactaagaacccaaaaaagtaaatatatcattaaacataaaggacatttttcataacacatatatacacaaacataactacatatgcacatgcatatgcatatgtatttaacataattttaaagatggttgattggttaaagcaaacataacaatgtattatagggtttatatcacatgcagaagtaaaatatgtgacaagaggacatagagagataagaatatacaaaactaatctatggtattagaaatcataaagttgttggggcaggggtgggttaattagaaaagtggacaagagaacttttgctataatgggaatattttctattttgctttttgtgtaaatgggcatataaaattgtcaaaaatcatcaaacctaaacccttagatctctacatttagagatctaaatttagatctctaaattataaaaataatattaaaaataaaaattgaatgcatacgaatttagcatgatgaccatatttattttcttctttcttgttttggtttcaaggcatttaaattagctactaaactttttttttaatttgaatttttacttttcttggttttctttaccaaattttctaaaatgagtctgtgttatcagagaacataaatataaatctgttctatgtgaaacgaacaaatgaataaaataatagcattgcctcagcaggaagaaatcttgtttctcaataagatctttcagtttacattaatcattcaataaataagccaaagtaagccaaaaatcttagatttcatttttttctgtatttttctttttcccttttgctttcattctgcttctctgatgattatgtactttcttgtcattgctcttctttcctctttctcttttcatttgacttctaatctttggcctgaaaatacttttttcatctggttttatcaactaatactaaaatttggctgttccaattaattattttgcaactttgttagccctaattctgaaacaacaacattttctctcaatacattgcttaattcaacacattctgaggaatttaacaccatctttttttttttttccaatggacaatcatcagggaattagccaataatgagctagtgatattggcaaactgacatacagtatgactgttcaggcctttgcagacatccaatttgcacacaaaggtgcatgcacacacacatacatacacatacacataacacctatatttttctcaatgaatctcctttttgggtgtatctactaaacttcctctttggtcttgcctgtccttgttcattgtcttagtttgagatgcagctcattctacttagttttatgcttgcatctgacctactgattatcttgccttcccaacctttatgtgagttggcatttttagtctccctttctttgcactctaaactcaccaactcccaaattctctgggaatgttctttgaccgatattgaacaaaaattctttttaagtctgagaataagaattttttaaatctgactttaaggccttagaatactactgtttctcttaccttctgattaatatactcctgaaataattatgaaatcataaatgaacaaatctcattatgtcaaaccaggcattaagtaactcaagttgaagaacagaataacatgtatttaggatactaagttgtcataccaaaattaccttgggtctacaatcacaaaattaaaatcagccaggcacagtggctcacgcctataatcacagcagtttgggaggctgaagcaggaggactgcttgagcccaggagtttgagaccatcttgggcaacatagtgagactttgtttctaccaaaaaaaaaaaaaaaatcagccagtgtggtggtgtgtgcctgtactcccagctacttgggaggctgaggtaggaggaatgttgagcctgggaggtcgaggctgcagtgagccatgattgtgcccgctgctcttcagcttgggcaacagagccagaccctgtctcaaaataaaaaaaaaagaaaaaaattcaattaaattcattaaaacattgacggattaaaatgatttttctgtagcttttaagggagtatgctatcttaagtagttaaccatttttttgtcattttaacttatttaaatgtcaatattaagttcaagaacattgatataaaatatcatcttaaccttagattaagacttgcattattatattaatcattttacaacttacttctttaaggcttagttttatttttaattcattgttttattagactctgatgagaatatgaatttttaaaaagtttgttttctaataccatatatcaactatatgttattaaacataattttagcatctatttttatataaatatgtcaaaaatcacatgaaaaagcaaattatagtgtgtattttcattcatatctttttgataaaaaaactatattaactaatgataaataatttattattctgtatgaataaacttcttttatctgaagtcctcttacctgcttcgggaaaacaaatgtaagggaaaaaacaagtaaaacaaatggaacaaaaggggaaaataaaaaagatcttcctaataaactatgtaacagagatcattcaccttaactgtcagcaggaattccagaataagtcatttattcagtgatggtaacttcacaacattatgacgacaattacaggtactctctattacatggtttaacattgaacctcaacttgagttgagtcagtgcactggagtagcaaaataaataactgtgacattttgaaatgtctgcatatcaccaatatatgcattgatttttcattttaaaagtctaccctttttccaaattaatctttatattttctccccaaaatttgggtaatgcatagggctacatcctacttgcttgaaaagtgaatggaaccattcatatagttataagaatctctacaaatagaaaagaaaatttagtaaaagagagataaatagcatttaccatttggcttataatgtaaatatcatgcaatgtccttagttgaagacctgtacttattaacaaaatatatatatataaaattatatttatttctttacatacataaaaatatctattttttaaataagtataaatctttagccaatcagattatatgatttttaatttaatagaccactttgtccaagaatcttttttccctcaattaatatacatttgtttatgtattagagctaaatttatgtgtctctttgtaaaatttatttattttgttttttttttattatactttaagttttagggtacatgtgcacaatgtgcaggttagttacatatgtatacatgtgccatgctggtgcgctgcacccactaactcgtcatctagcattaggtataactcccaatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctaccattgttggacatttgggttggttccaagtcttgtaaaatttattttgttgaacacatggataaatcaatacattctgactttttaaaaagtccattttgttgattcctatttctttgacagtaaaacatatatttttattcatatggcttttctctcaaaatttatcgccctaatatttaactttgccttctatagctgctcaaagttacttattagacttccacttaacacataatctctcttgtagagtacacttaagtattttttagagacttcatgatgagtacttggttgtccctaagtttttctgacaattttgttattttaactttcatttcttgttcttaaccctcttaaatgaaacttcctatttgtgatagacttattcttttgttcttgactttccattgcaaccacctctggggtaatatttttaaaagaatgtttagaaatcaaataggagtttagctaactatgaatgagaacatattttcattacatgtttgaggaatagattttttactgggtaagagatctcaggcacaattctggctaactaaaatattggctttagctacataaggtaagacatttaataagtgtcaggtctataccatagatgtcatgattaaacaagctactaagtgtatagctaggatgcattaaaaaattgttcgggaaatttttggcagaagaatattatccagaatcagatttatgaggatgcagtaaaagattaagattttggctggtgctcatggtaatacggtctaagggaaccaaggttttatttaagcttgaggtatgttgatgtactacctaatggttatcaaatttttgtttccaggaataaatgatttagacaaattagttcataattcattaggagaaaaatatattgcttaaaatctattgataactaaagttgaataacttttaataactttgatttctgaattgatcattggtattttctttctggagccagaaataggcaaattctataattggtaaggtatgcatatttagtcttttataaagatggctttcaaggttattcaaaaccatatagtgtttttgcttttcataatatctatgcccttaaatcattttctgtatgcttatttgagattgttccttctattaggtcaagattttataaatttcaaggactattatcctgctatagtacagaatacatttgaaaggccagtggtgatagtgttttccacccagataacaatactaataaattatttactaagtgcacttattgtgtccaaggactgcaataaatgctcagcatgcatctcctttaactatcataaaaaaatctataatgggttttaattatgaccacattacagatctttttaaatgaggcttagacaacttaaattcccattatcaaatggctagtaagcgtagaactaggattataaaacagatccatttgaactcaaaatccatgttctttctactccaccaggaataacatatctagtaattgcgctgctaaccttttatgatgctcatccccgctgagcccagatgtgctctaaattagtgctcttatgttcaaatcaatcacccgagaatcttgttaaaacacagactgtcatataaatgtggaatcatacagtaattgtcttttgtgactggcttatttcacttagcataatgacctcaagttctgtgcatgttgcagttgttgtttaatgggtacagattttcacttttgcaagatgaagaagttttggagagtggctgcatgacaatgtgaatatacttaacactacagaacttcacacttaaaaattaagttagtaaattttgtgttatatgtattttaccacaggttttaaaagtagactcttagtggggtacagaggctcctgtctgtaatatgagtattttgggaggcccaggtaggaggatcgcttgagaacaggagtttatgccagcctgggaaacctagcaataccctgtctctagaaaaataaaaataaaataaaataatcatctgggtgtggcagtgcacatctgtaggcctagttactcgggaggctgaggtgggaggatagcctgagcccgggagattgaggctgcagagatgattataccactgcactccagcttgggcaactgagtgagaccctgtcttaaagaagccagaaaaacaaaacaaaaaatggaatcttatttgctgggtctgggatgagcccaaggtgatgctgatgccactggttcataagcaccctctgccatgcaagggtatagatatttttctccagggtgacctctaagaaaccactgccatttgatttgaattggcatgtaagatattaataaaacatattgagtttttgctatctactatactttctttccaactaacatgcatgtcctcattcacactagtaggacaggtgagcaaaaagtgcccattgcttctgatgcccttcaatttcctagacagttcagattctaagaatgtctttggccttggaagcatttttgtcttaaacttctgaaataattgtgtcctgaaataccttttgtgatatttgttgaaaagtttcctcctactctgagagctgagaagagaggaaccatttccaagctgctgctacatatcaaagagcctgtcttttcagcttcactgacaagtggaatgattttccggagtctgagaaaatatcaggcaaaatcttttccagataaaaaagctgctgtcagctgcctgcagctgaggaagcaactttaaatcctgtggggagaatttctattgcaacctcaatcccagattccagcttctgtcttacatccttttttggcttgactctgctcaaggagctcaccaaactaaggaaaagaaagttagcaggacctacgggtctcaccttcacactgccaatctcaaagttttctcttgaggaaaccatggtaacagacgcctgttcagagaagcaatgtaaggtgattatttacacataacctattgtgctttgtagccccaccctcacatgataaagccaatagaaattgatgctgaggtccaagtacagatttttttttttttttttttttttttgagatggagtctaggtctgtcacccaggctggagtgcagtgacacaatctcggctcactgcaacctctgcttcccaggttcaagcaattcaccagcctcagcctcctgagtagctgggatcacaggcatgcaccgccacacccaggtaattttttgtatttttagcagatacggggttttgccatgttggccaggctggtctcgaactccttacctcaggtgacccacacgcctcggcctcccaaagtgctgggattacaggcatgagccatcatgcccagcctacaggttcttctaatacctaattgaagtgtcctgacatgacaattttatattacatggcaatgtgctatggcaataatatcttctgatttgggaagtgaatatgatacaaagagaattaacaggaaagcagagaatcaagagatgccttctactatgaaaattattcccagagctgcactgaccttgaaactcacctgttgctccacggcggctgagttaatttttctttactttcccatgtgtcttcccaatatatttgcattcattggaataatcctgagttctcttgatttcttgcaaattgaaaatgcctaaacacagaattagttttgcccattgatcaagccttaataaatcttacagattctggccttgaccaaggctatgatctccactccatcagtgactggcctgagctggctctggaggggtccggccaggcctcttactaagttatctttatagttttcatggcacctgtactcaggggcagctctgttttgtatttagaaatacctcattttcaagaaagatatctgttttcattattcctattatagtcccagcagcctttaaaaaaatgtgcttagccagtcaaaatgataatcttgagatttttctaactttacctttttctcctacttatttgcttagagaaaagagtggtcatctacctctccaaactgtatgccaccactactgtgctcttaactaatatttctgatttgtcagttaggaattccttcctctctgtttcatttttttttcagaagcctccaacataccatgttttctattctttcttcacgtattactaaagtatattttcccttcccttccatatttgctattctttcaactttgccattcaccttcctaatccactgatatttcaggaaaggttctttttccatttctgctatttattaccatgtggcttacttcatcctactgagacatcatttctacatttgtaaatggggattaaaaatgcctgcatttcctactttgcaaggatttgtgagaatgaaagatggtaatacaatggaagtgttttgtagttataaagttttacatattatctagagaactatcttgctttcattttatacggtcagaaacaagatattaaataaggaagtgctctcagaaagaaagacctttgcatttaaaaatgtggttcatcatttatatttatttagtcacacaccattttaaaaagtgtcattacttttttatctgtatgatatatattatttttggacctgaactcacagtttgttaaaatgcaaagataaatagaaatcagaaagctctgaatattagttgtcaaaaataataaaatagttcacctctgaattttgatgagcaaatcaacaagttcagttttccatcaagaaagaaaaatagctgtctcattcaaatacattttttaatttatattatattaatattgctgtcacagtgaccattatgacttcaagtaatctatgtaaacatcatctaacaaaatgtacctgagaactgtgtttcatgcttaccaatttattattctgcctatttggaagttctattattactagcatacatagtttatatacttcttcccttagggaggaaaaacctctcaattatactgtttattagctaagacaagaactctagcatttacctgaatataaagcttttggatagaggagacatatagtttagtgggaattttgggcacctaagatttattgccagatattcttgttaacttatttggtctacagtgattgtgaaagtaggtttttgagccttgtcccctttgtcattccaaaactgagattaaagcaatgctcaattttacatttaagatgaataaagtatgattataaaataacacatataaaatgaccaaaaattaataattaattgtctgatgtggaccattcaagcacatcagacacctaacaattaggatagatgagcatctttcatgaaaggaaagttagcatctatatttttaaggaggcatatgataataaggactacagagcaattactttgagagtgcttctactgtcacattttagaagaggttctaatgcaagatttctgtttcatttcttatttttaattttaccaagaaactcttgaatttgcaattgtataccacaaataaatgcattaggtacaagtgcctcaatgtcctaggaaattgatgtcttagttcaaaaggaaatgctgttacagctttataattgagtcatataatttccatggttgagtagatgttggctttcaccggtccttgtcctttaaagtccaccacctgacacatcaccacaaagaacaggtaatttattattttttattgccattaatttatagctttaagtttcaaaggagaattataagttaccacaatatctggagctttttaagttttgtattcccctttgactgcttaggataatctaaatcaccagagattagaaaagaatcatgaaataatgttcaaattacggaaaaacagactttaaaaaacagtattaaaatggaggtaaattatcttagtggattatttatttctgacagatttgcctatattgtagttaaagaaattggcttttttccttgatttataatgattttatttatagaaaaaatataatgggacaaattttctttggatctaaaatttttcttaaaattcaaaattcaaatgatagttgtggtattataaatttggattctattttatttaaaatgttgccacctctgaaaatggcttaaaggctctatcacaaaatgtttgctagtaaaattaatacaatacaatctagctgtattaacacagagcaccaatcaactttaccaaacactatttgcaaataaacatttgtaatcaagaattttggagacttaaaatccatctcacttacacactagttattgaactttgaggtccagagaagaaaataatttatcagtttcctatcctgtgatgtgagaataataacaggcatatcatagaaacttgtgaggattatccctcttacattcatacgaaaactaaagtctagagaggctaagagatcttaaggtatcacaaagagaaacttgtaggtttagtattcaaactttatatgccctgctctaaaatgctacattttccttgataagcacataatcacatacagagtttcagattatttaatttcttattcatagaaagaatatgttggatgtataaaacatatttcttaggaattattatctacaaaacgggttttaaaatactgttaactccaatcacttaacagtttgagttgttttggatggttcaccagtccctataactcttgcagcttactgccatttgggtttctcagacaaaaccacagccttctactcgatttgagaatttttctttttaacctgtacactcgctaagagaatacaatttggaataagttgacagaaatagctataatagtatatgtagttgcacactgactgtttcagtcaaggcacaatcagggaaagaaagtgttgcaattaagtgaattcagatcaaagatttggttaagatggtaaagaaggagctgaggaccagtcagaacacagtaaaggaacatacatattaggaactgcaggaaaccatctagcactcctagactggagagagaaaggaaaattgtggtgtcacttgaagtagcaccagtccctgaacagaagctggagatggagacatggaggacatgtagtcactttaagaatacccttcaaaaaatcaatgaatccagcagctggttttttgaaaagatcaacaaaattgatagaccactaggaagactaataaagaagaaaagagagaagaatcaaatagacacaataaaaaatgataaaggggatatcaccaccaatcccacaaatatacaaactaccgtcagagaatactataaaaacctctatgcaaataaaccagaaaacctagaagaaatggacaaattcttcaacacatacaccctcccaagactaaaccaggaagaagttgaatctctgaatagaccaataacaggctctgaaattgaggccataattaatagcttaccaagaaaaaaagtccaggaccagatggattcacagccaaattctaccagaggtacaagtaggagctggtacgattccttctgaaactattccaatcaatagaaaaggagggattcctccctaactcattttatgaggccagcatcatcctgataccaaagcctagcagagacacaacaaagaaagagaattttagaccaatatccctgatgaacatcaatgcaaaaatcctcaataaaatactggtaaaccaaatccagcagcacatcaaaaagcttatccaccatgatcaagtgggcttcatccctgggatgcaaggctggttcaacatacgcaaatcaataaacataatccaggatataaacagaaccaacgacaaaaaccatacgattatctcaatagatgcagaaaaggcctttgacaaaattcaacgacccttcatgctaaaaactctcaataaattaggtattgatgggacgtatctcaaaataataagagctatctatgacaaacccacagccaatatcataccgaatgagcaaaaactggaggcattccctttgaaaactggcacaagacagggatgccctctctaaccactcctattcaacgtagtgttggaagttctggccagggcaatcagacaggagaaggaaataaagggtattcagttaggaaaagaggaaatcaaaatgttcttgtttgcagatgacatgactgtatatctagaaaaccccatcgtctcagcccaaaatctcctcaagctgataggcaacttcagcaaagtctcaggatacaaaatcaatgtgcaaaaatcacaagcattcttatacaccagtaacagacacacaaagagccaaatcatgagtgaactcccattcacaattgtttcaaagagaataaaatacctgggaatccaacttacaagggacgtgaaggacctcttcaaggagaactataaaccactgctcaatgaaataaaagaggatacaaacaaatggaagaacattccatgctcatgggtaggaaaaatcaatatcgtgaaaatggccatactgcccaaggtaatttatagattcaatgccatccccatcaagttaacaatgactttcttcacagaattggaaaaaactactttaaagttcatatggaaacaaaaatgagcccgcattgccaagtcaatcctaagccaaaagaacaaagctggaggcatcacgctacctgacttcaaactatactacaagggtacagtaaccaaaacagcatggtactggtaccaaaacagagatatagaccaatggaacagaacagagccctcagaaataaggccgcatatctacaaccatctgatctttgacaaacctgacaaaaacaagaaatggggaaatgattccctatttaataaatggtgctgggaaaactggctagccatatgtagaaagctgaaactggatccgttccttacaccttatacaaaaattaattcacgtggattaaagacttaaatgttagacctaaaaccataaaaaccctagaagaaaacctgggcaataccattcaggacataggcatgggcaaggacttcatgtctaaaacaccaaaagcaatgacaacaaaagccaaaattgacaaatgggatctaattaaactaaagagcttctgcccagcaaaagaaaccaccatcagaatgaacaggcaacctacagaatgggagaaagtttttgcaatctactcatctgacaaagggctaatatccagaacctacaatgaactccaacaaatttacaacaaaaaaacaaacaaccccatcaaaaagtgggcaaaggatatgaacagacacttctcaaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgctgtgtccagaattggtgggttcttggtctcactgacttcaagaatgaagccacggaacctcgcggtgagtgttacagttcttaaaggtggcatgtctggagtttgttccctctgatgttcggacgtattcggaatttcttccttctggtgggtttgtggtcttgctggctcaggagtgaagctgcagacctttgcggtgagtgttacagctcataaaggcagtgtggacccaaagagtgagcagcagcaagatttattgcaaagagtgaaagaacaaagcttccacagtgtggaaggggacccgagtgggttgccactgctggctctggcagactgcttttattctcttatctggccccacccacatcctgctgattggtccattttacagagagccgactgctccattttacagagagctgattggtccgttttgacagggtgctgactggtgcgtttgcaatccctgagctagacacaaaagttatccacctccccactagattaggtagatacagagtgttgacgcaaaggttctccaagtacccaccagagtagctagatacagagtgtcgattggtgcattcacaaaccctgagctagacacaggttgctgattggtgtgtttacaaaccttgagctagatacagagtgccaattggtgtatttacaatcccttagctagacataaaggttctccaagttgccaccaaactcaggagcccagctggcttcacccagtggatcccatactggggctgcaggtggagttgcctaccagtcctgcaccatgcaccctcactcctcagcccttgggtggtcgatgggactgggcgctgtggagcagggggcggcgttggtcggggcggctcgggctgcgcaggagcccatggcagtggggaggctcaggcatggcgggctacaggtcccaagccctgccctgcaaggaggcagctaaggcccggcaagaagtccagcacagcagctgctggcccaggtgctaagcccctcactgcccagtgccagcagggctggccggcagctccaagtgcgggaccagccaagcccatgcccacccagaactcgtgctgcagccctggttcccgcctgcgcctgtccctccacacctccctggaagctgatagagccggctccagcctcggccagcccaggaaggggctcccaccatgcagcagagggctgaagggctcctcaagtgctgccaaagtgggagccaaggcagaggaggcaccaagagcaagcgagggctgcgagggctgtcagcacgctgtcacctctcagtgggactgtaaactagttcaaccattgtggaagtcagtgtggcgattcctcagggatctagaactagaattaccatttgacccagcaattacattactgggtatatacccaaaggattataaatcatgctgctataaagacacatgaaaacgtatgtttattgcggcactattcacagtagcaaagacttagaaccaacccaaatgtccaacaatggtagactggattaagaaaatgtgacacatatacaccatggaatgctattcagtcataaaaaaggatgagttcatgtgcttcgtggggacatggatgaagcaggaaaccatcattctcagcaaacaatcacaaggacaaaaaaccaaacaccgcatgttctcactcataggtgggaattgaacaatgagaacacatggacacaggaaggggaacatcacacactggggcctgttgtggggtgtggggaggggggaggagtagcattaggagatatacctaatgttaaatgacgagttaatgggtgcagcacaccaacatggcacatgtatacatatgtaacaaacctgcacgttgtgcacatgtaccctaaaacttaaagtataataaaaaaaaaagaaagaatagctgctaaggcagagtaagaggagaaacatctgagctccttcctcccaactgttgcccatctctagaggctgactcagctggaattcaggtaatgtgggatccaaggaacagcgtctacagtgctcagccttcttaatatatgatcattactctacaagctatggcatgtttgatttgagaagcactcaaatcaccttattcattttatcaaattcggttctttcttctgactaagtactaggtactcaatagctacaaaaactatcctccaaaggcagaaacagcatcttacacttagttattggggataaccatgataatattccctcaaagcagattctcacacacagatactcatccactcagtacgtaaaacctgaccttcactctgcctcaccgtatcataagcaaaggatctcaagtgaagaaacaaaaactgacatgttcctggaagatgccaatggtactgctataattatttgtcaaagaatgcaactaatatttttagaatttgtccatgtcatgattctcaattttttagttgatttttgtgtcacgtttctttttctatcacaattttaataataagcagcccttccaaccacctccacaggaggaagattaactgtgagatggttaaggaaaggcaatgctaatcaatgatgtggccaattctttctgcaacagttatacacattgttatattccgggataaacttctcctgcccactcataaatttttatttccttctcctctggttttatggttaaattaatgaaaaataaaacttttcagaaggtagctgactcttcatgtgatttcaaacttaccaacaggaaatatccaatatacactccttacgccttcctacagcacatgaaatcttttttttttttttttttatactttaagttttacggtacatgtgcaaaacgtgcaggtttgttacatatgtatacatgtgccatgttggtgtgctgcacccattaactcgtcatttaacattaggtatatctcctaatgctatccctccctcctccccctaccccacaacaggccctggtgtgtgatgttccccttcctgtgtccatgtattctcattgttcagttcccacctatgagggagaacatgcggtgtttggttttttgtccttgcgatagtttgctgagaatgatggtttcccgcttcatccatgtccccacgaagcacatgaaatcatccttttttatggctgcatagtattccatggtgtatatgtgccacattttcttaatcgagtctatcattgttagacatttgggttggttccaagtctttgctattgtgaatagtggcgcaataaacatacatgtgcatgtgtctttatagcagcatgatttataatcctttgggtatatacccagtaatgggattgctgggtcaaatggtatttctacttctagatccctgaggaatcgccactctgacttccataatggttgaacttgtttacagacccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagccaatatcatactgaatgagcaaaaactggaagcattccctttcaaaactggcacaagacagatgccctctctcaccactcttattcaacataatgttggaagttctggctagggcaatcaggcaggagaaggaaataaagggtattcaattaggaaaagaggaagtcaaattgtccctgttttcagatgacatgattgtatatctagaaaaccccatcgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggatctcttcaaggagaaatctttgtttttaatattgcttttaattctaatagtaattacttgaactggccagaaacagaaattcctcaagtgcttagcagaaaagcctagctatagtagcttcacactttttctatttttaggcaattacaaatatattttgaatttggaaaataacatataatttaaatgatatacacacgcatatatacacacacatatatacacatatatgtatatacatatatgtgtatatacatatatacacacatatatacatatatacacacatatatatatatacatatatatatgcagtaacttcctaataagtttatttaaatttatctgattttaggtgaataaaaaataaaggtttggagagtacctttttaaatgtcagaggaatccaacaaccaattgtacaagtgaggggcagaaggagtctttgatttgaggatacctagtagctgttgttgcacatctgatcactttgcctattcttcttactacctgggtgtcaaatcaattcagaaaaataatctggaaactgtaaaccaaaaataaaattctaagcacccccaatcaactgaagagacccctcatctcagccaagtgcattcttttttttttttttttttgagatggagtcctgctgtgttgcccaggctagagtgcagtggtgcaatcttgactcactgcaacctctgcctcctgggttcaagctattctcctgactcagcctcctgagtaccaaggaccacaagcacccgccaccatgcccagctgatttttgtatttttagtagagacagggtttcgctaaaactagtgaaaagcattttcctttatagaaaaaattttcacacactaacttccacagtggttgaactagtttacagtcccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagcgatattgggcaggctggtctcaaactcctgacttcacgtgattcacccaccttggcctcccaaagcactgagattacaggcatgagccactgcacatggccatcagccaagtgcattctaaagtaaaccagaaaccctagttcaggccatgataggaataggtggtcagacatgcctcattatacctccctcctgttggattaatttgggcacagctggccagcattaacactaaaacagaaaccttaagacggacagaacagactctttgtagcaataagatacctacatgacagcaggttctgaaagaaattgaagtattaatattttactcccaaacatatttatttgacatattttgaaatggccccgcaaagctgtctcttgtcggggaaaatctacattctgtagagaatccttttccctttccaggtgtttttactgatccggagtgaattaacaaagagtctggcacctgttaaagtttgacaagaaacatttacaatgtcttctctccgaagcctgctacctggagccttcatctgcataataagaacccgggtctctaaaacccctgatcttaacccagacagtcccttctgttgattcctgatctttagatgcactctttcaactaattgccaattagaaaatctttgaatttggcctggcaaggtggctcacacctgtagtcccaggactttgggaggccgaagctgacagatcatgaggtcaggagtttgaggccagcctggccaacatggtgaaccccccccaccatctctactaaacataaaaaaattagccaggcatggtggcgcatgcctgtaatcccagctacttgggaggctgagacaggaacatcacttgaactggggaggcagaggttgctgtgagcagagatcacgccattgcactccagcctgggcaacaagtgagactccattcccccccgccccctcccccccaaaaaaagaaaaagaaaatctttgaattcagctatgacccagaagttccctccctacccacttcaagttgtcccgactttctgtacagattcaatcaatgtacatcttgcatgtattgattgatgtcttatgtctccctaaaatgtataaaaccaagctgtagcccaaccaccttgggcacatgttctcaggatctcacggagctgtgtcatggggccaaggtcacttgtattttgctcagaataaatctccaaatattttacagagtttgactctttttgtcaacaaaatgtaaagcattaaaagaaattagccagcaatatacttaattatcatgagcatagtaagcgattttagttttcctttcatcacttattaatatcttacatcaaatttatttttacactgacaggattatatcccttctttaaagctttctatttatagtatgcaatgtaatatggaggttactacctacttcaagcatagaaggcccatcctttatactccacaggcttgtagcacatttatatctgagaattactagtgaaaagcttcctttaacagttttagaaatgaaaatcaagaacatctgtgacttttgtttgacccccccccccccataggcagttacaaggcaaatgtgcatactcctctagcaatcactatagcaacaagcaagtaattgctttaaatagcataaggtgcctttgctgaaatcatttcaagtatcctgagttaactctgtgtcaacaaagcactcataggtcttggattctttaatgggggttcttttaaaaaagaaaattacagctttgtaattggtcatttaaaatttcagaaaaatgtagatacaccaaagaaaatgtattctccaactatgaagaaataattggcaaaatagtatcattttcatattcctaataatttttcctatacatatactgtatgtgtttatttatatttcttatttcttactataagactttaagccagtgcttgtgttacctgttttcattgccttcttacaattatcttatacagatatattataaaataaactcacttttaaaatattttctgtgataagattatgaaatggcatccaaagggaatcacacacaggattttttattttatttctgaaaaatatttgtaggttcaatttaattatcatatattgaaaggtgcttagtgcttttttgcatcagacaaggtgaaaaattcaactttcaaatggctatagtccctggcttcttattttcatcttagcaaaataaaacaacaccctacttatgaattgaaattgtaatgccattccattttctgctataccatagaaataactctaaatactaaaatgtataaagtggaaaatgctgatagtattccaatttgtttcattttcaatttgaagaaaaaggatatgtgtctcctggggtgaagaaatgagtcaattaggtatagaagaaggggcatgactatatcaagcttacactaaaaatgctgaataacaatgacaaattagataattattaataagtagataattccaaccctaaaaaacaaaagaccttgcatggttaatatacaaatgacttttagaaacataaacataaatggaagccaaggaaacaatcaactgagtgaagaaacaacttgtggaataggaaaaaatatttgcaaatcatattttcaataagggattgttattgaaaatgcataagaaacttgaataatttaacaataaggaaacaaatgacccaatcaaaaaatgggaaagatctgaatagacatttctcaaaagaagacatacaaatggacaatatatgaaaaaatgtttaatgccactattcttcagaaaaatgaaaattaaaaccactcctcagctcctcacagctgttagaatggctactatcaaaaagacaaaaagtagcaagtgttggagagaatgtggagaacagggaatccttggacattattaatgagaatgtaaacaattataggcattataaaaatatggaaattcctcaaaaaattaaaaatagcactaccatatgctccagcaatccctctacaaagtatatatccaaaggaaaggaaatcagtacgtcaaaaagatatacttcctttcatgtttactgcaacactactcacaatagacaagatatggaatcaacctaggtgtccattaacagatgaatggataaacagtcatataaatatgtatatctagtataaacacacaccacttataaagaagggaaatcctattatttcctacaacatggatgaacctggaggacactatgttaagtgaaattaggcacagaaagacagatatcacacagttttacttatattttgaatctttgaaggggtagagaggagaaaggtggttatcagggaattaatgggggggtagagaagtgaggagatgttggacaaaggataccaaatttaattcatgtagaagaaataaagatacctaatgtatgacacagcgactatagttaatgcattgtattcttgaaaattgctaagagagattattttgagtgttattaccacaaaaaatgtgaggtaatgcatgtgttaattatcttgactaagccattccacaatgtagaaatatttcaaactacatcatgttgtacacaacaaaaataaacaatttgtaatataaaaaataaatttaaaaaatatatgtacaaaaaggaaatacagatggcaaatatgcatgtgaaaagatagtcaaagttattataataatgaaaatgatcaaatcagggtaattgggatatgctaggaacatttaaatcacacattacatgaatgtattaaattatcacatgtatattgaaaatatgtacacctattatatcatttcttctgaaagtgaaatctaaaatactgtacacaccacaaggatagcaaaaattaaaacaagaacaaaagcagacattaaaaactgctgaaaagtaaaatctaaaataatactgaaaacaccactagaatagcaaaaattaaaagaacaaaaacagacaataaaaagtgctgacaaggatgtagagaagccagaactctcacataatgctagtgagaatgcaatggtacagtcattttggaagacaatttaaaagtttcttttgtattcaaacatacacttaccaacaactgataaattttacttttgtatttactcatgataaataaaaatatttgtcttcacagagacgtatgcataaatgtttatagcaatgttattcaaaattgacgagaactgaaactaaatttttattatgtggagaatagattaaaaattaaggtatattcagacaatagaatattatttaacaatcaaaatgaatgaactatgggtacatgcagcagtaaagataattctcagaagcaatgtggtaagtgaaggaagctagacacagagggtctgtggtgtatcgtcccatgtacatgatatttgaggagagaaaagcctatcaggataaaaatactatcagtggtttctgagggtccagagtttgagtgggggttattgactacacaaaggcatgagggaactttttcagaaaatggacatattctatattttgattatatgtaaactatacatctatctaaattaatcaaattatatatatacaagggttgaattatactgtataaacttatatctcaataaacttaattttagaaaacttctcaggaagataaaggaggaaataatatccatgaaacaagaacaaggcactgaggaacaagaataggcagctgtgaaacagaggtgagggagaagaaatatttgaagtaaaatttacaaaaccttttcagaattggagacatagatcttcatattggcctgttatcactgaaaaccaaggacaattaaaactaaatagataaaaagaatcactgtagtaaaatagcagaacctgaagaataaaaatacatttttcaatatgactgttaacaaagagaggtaatattgacaattttacattaatgttacttagaaaaggaatattttctaagttaagagaaaaagtaactacaatatgcaattatttgttccactaagctgacaataagtagaaaaataacaatacctttttaagtacataaaacaattttactatcaaatggatttttctaaaacaactcctaaagaattcagtttgcctagaagagaaatacaaatagaagtagtgaagttgataccagaagcaagatttggaaaacacacacagatacacacacacacatacacacacacacacacacacacacacacacacacattttattaaataaatgaatatcaagatctcaggatgagtttaggaaagcttggaaaatttgtgattacaagtttggtgactgggcatatttgtatatttttaaactccattcaagatttatttggttcttttcaatgttaaaatatatgaaaactacttcattctccaaaacatgttatttttgatattctaagagaaaattactgaattgtcaatcttatttcccaagtaagattcttttttcttttctttaaagtaatggtgttggttattttcaattacaataatgttgtatggtctagtcattctagaaatatatttttaaaaaggttaaaaacagagcaaattataatcaccttcataaaataaaccacagtgatatatggacaaatataaaaatgtattaactattaactttattactaaaagtttaacggtaaattatataaatttgacattataggaaagaagcagtaatttattataggggtcagcaaacaatggcctatgggctaaatctagcctgcttccaatctcggtcaataaagttttgtcagaacacaatcagattcatttatttttgtattgtccatggctgctttcatactacaatgtatgtcagaactgagtagtttcaacagaaacattctggtttgcaaatcctaaaacatttactatctgttcttttacagacctgtcagcctctgcactgctcatataggcaccataggaacatttgtgatactacagacactttcaactaacttaaaaagagaaaggtgccctttctttttagtagtataggataaaaggaaagaattctctttaacttttgaactggcaatgatagaatttaagagatgcaaccctgaaaactaaaattgtacattggttgaataaaatattttctaaatatgtatttttatacttcaatttaagattgttgctctgactaaatatttttataatattttaatcatgagcattctgctttacaaaaccatttcttaaaaatactcttatacttttgctgtagagtaattttcagtcaggggaaatttggcaacatctgtagacattgttcattggcataattctagtggaggaagaaaaacatgctactggcatctagagcaaaaggtcagttgctctgctaaacattacaatgcataggacggaccacacaaccaagaactcttcaccccaaaatgtcaatagttctgaggttgataaattttcctatagagatatggtaaaacaaaagaaagcaaagtaaagcagaacagaacaacaacaacaaaaaaaacacaaactaattagatttcaagataaaaaagattatttcagaattcccatctccaggccagcttttattgtgtatacaccaattgcagcatctttctgaagaaaaataaggaggctctttacagcagacatcatgtaataaacagtatacactcacaaggatcataagtttgggaactttttaggaagttcctaaaaataatttccctgcaaggaaaatttgctgttagtatgttgatattgttttctgtagaattcagtgttaaggtgtcactttttcaaggactctttttttaacatggccttgttgctatttcatcttttttgaaaccactctatgatcacatgacaaggcagtttcaaagtttttgcatgttaatgcagtgtgtctttgactaaggaagaaagataagagtgtcccacaatataacttgttaactaatagttacatgcagtttttaaatatttttgtttgtttgatcttacaatttccagtaccaaaaattttcacaaaaattagaattatgacatggtctaatctccctaattctgttcatgttattcctcaatttttgcaaaccttttctctaaaaaataaatgtaataacatttcttcctaaagtcattattatttatctaccttaacatttgtaatgaccataaactatttaacattttcttttctttccttctttgtatgtgtgtgtgtgtgcatgtgtgtgtgtgtgtgtgtgtgtgtgtgtgtgtgcttttagagacctagtcttgctctgttgcccaggctggagtgcagtggaaggatcatagctcactgcagttttgaagtcctcgtctcaagggatccttccactttaacatgtcataacacttcttgattagcattaagtactgcagcatttcttgttgcaatgtcaattatttattcatatgttaaagagctgataaaaatcaatacaaagttacatttttttgtggcgattgttgatatatattcattaaacaaattcatatatttccctaaagttttcctatatgatgtatgtttgaacaggattttgcaactatcattaaaaagaatgcagtatttcaacagtaatattgattctttgttaaaaatttagacacaattgtattacataaagattaaacaacttagaatttttgaaaatgcatacacattttatatactactcttttttaaaaaaaaattttcattccattccaggggtacatgtgcaggtttgttatataggtaaactcgtgtcacaggggtttgttgtacagattatttcatcacccagatattaagcctagtacccaagagttatttttttctgctccccttcctccttgtaccctctaccctcaggtgggacccagtgtgtgttgttctcctctttgagtccacgtgttctcgtcatctagctcccacttataagtgagaacattcacgtaccactcataatctatccttttacttcaagaaaaattatgaaaagttagcataaaatttgtgtacatcattgttcttgtatttctgtatcttattccattattttcatttggcaagatatttttcatcatttttatagttcataccaaaatatactaattttttacatatatgttaaattatattttcctagttttactttatgttaaatttaactttatgactaatccttatgatgtgtagaaatttattttttatggtcaattgtagaaatcttaggctttataatttttacttgtgcatacaaaaattttcttctctgtcaagattatatatattggccttattttcttttgcatctattatagataatctgaattaattttcacaataattataagttaggtgtttttcttaaagaaaacactggctttaaagaaaagttccattatgtatgaattcaaatgattttctcaaatatacactttcaattcgcttattctctcaatttcccatggaaacagcaaggttcataaaatatagaaaaccatctcactattatgcctaattcatcagacttcaaaaacatacctgaaggtcagcgctctgaaatacataggtaggtacacagtgtcctacataatttcatgaaatgcctcattgtatttaccgataataaaaattttcctcaaaaaaatttaaaaaataaagtttgttatataaaaataggtgcagtgaggggagtgtctgatttctccaaactttgtctaaactagagataagagagtatttgtactaatgagataagtgcagacgataaagaatagcatagtctgagacgtataagaaataacaaaacctggcagagacacagcaaaaaaagaaaacttcaggccagtatttttgatgcacattgatgcaagtatccttaaaaaatacttgaaaaccaaatctagcagcacatcaaaaagttaattcaacatgatcaagcaggcttcatccctgggatgcaaggttggttcaacatacacaaatcaataaatgtgattcatcacgtaaacagaactaaagacaaaaaccacacgattatcttaacagatgcagaaatccaacatccctaaatgttaaaaactttcaataaatcaggtattgaaggaatatacttcaaaatagtaagagtcatctatgacaaacccacagccaacattatatatactgaatgggcaaaagctggaaacattccccttgaaagccagcacaaaaatgccctctcttaccacttctattcaacatagtattgaaagtcctagccagaaaaataaggcaagagaaagaaataaagggaatccaaatagtaaaagagaaagtcaaactatctctgtttgcagacaacatgattctatatctagaaaaccccatagtctccacccaaaagctcattgaactgataagcaacttcagaaaagtttcaggatacaaaatcgatgtacaaaagtcattagcattcctgtacaccaacaacagacaaaccaagaaccatatcagataggcaatcccattcacagttggcacaaaaggaataaaatacctgggaatacagcaaaccagggagatgaaagatctctgtttacaatgagaattacaaaaggctgttcaaataaatctgagaagacacaaatggaaaaacctcccatgctcatggatagtaagaatcaatatcattaaaatggttatactacccaaagcaatttacagatgtaatactatgactatcaaactaccaatggcattcttcccaaaactattaaattggctatagtacccaaagcaatttacagatttaatactatgactatcaaactaccaatggcattttttcacaaaactattataaaattcacatggaaccaaaaaaaaaaaaaaaaaaagagctccaatcctaagcaaaaagaacaaaactggaagcattctattacctgactttatactacaaggcaacagtaaccaaaacagcatggtactagtgcaaaaacaggcacatagaccaatggaaacacattcttatttgttcttttattcaaaacaatattaattgaatgacttcaaagtatcaggccttcttagagactacatttattagcagaattctattcatcatcaggatttttttttttaggattaagctcttcttcacttttgacatttatcattatcttattcttttccttattaattctggaatttctaaaatatattattagtcaaatctgatgtttcctagaagtctacaaaaatatttttaatggccaatattttgttcaatctacttagtaaaaatgttcatatctttaattcagtggaaagtacatttttaaatagaagcttagaggaaaaataatagactgagtctacagattatagaacctaaagtttaaaagtattcaagaatatgtggaaacccattaacttttaaatattcaataatactgctattatggaaaaaatttggttttctcatttaatgatggttgagtggaattatcctgtatctggcttagagtgaggaaagcaattatcccatttttactgtaatttttcctctgcccctaatttattagagagagaaagagatctgaactgggaagatttaagatttttcatctgaaaaaaatagaagattgttatagatgaattctaaactgttatctttaatattctatatgtttatgctatgtttaataattaatatcagtattaataatactggtaacacaatttttagtatataattcacattctttcatttaaaacaatacttactatgtctttctttctgccagatacttttctgagtagctattaactggattttcatagatgaatgattttcatttggttgcagacaaatgaattattctctataaattgcataactgtcaatggtaaaactcagtattctgacaataaattcatgcaatatgcaaatgcattaataattgacttaatggttgtgaataatgcaaatattttacctttaagtacattcattaatagtaaaacaatagtaaattggaaataggtattgaagtaggtacttagttttagagatgaaattaataatttatataatcaaaatgactaatttggttggctaggaaaggtcaatgaccacctaagttctcacattttctgggttattactggaacatattttctctggacttagagctcattaaagatgcatagtctaaagttctgacattcaatattttttctctgattcagagaactagtttacagcgttctttttattttttcttttttgaagcagatgaaaaaagaattcttggtctttaaagaacatcagagagccttttcaaacaaacacgagtataatcattaataattaagctgtatagagaaatctcatgtattcaaaattctgacaccaaatttgacttaagaatttaaagggattctcacaatcttattactataattgatgcacagagggtactcattatgtctactaaatctgaaccagatcctgatgtctaaaaatacttgtcaaattgcatgttatataagccatcattgtaattaactcatttattcaacaaatcttatgaaatatcgactatacacttttgctgagcatcaaggctaccatacttgggaataaaaaagacatagtctcttttctcaaggaattgacagtctaatgaaatattcatagactaatcaaacagtcacaagtaatgtcaaatattaactacatagattataaaatgaatgtacaaggtattatacatcagaataaaaaaaggaataaaatattctcaaagtaaatttaaagcttagaaaaccaaaaatatctaccagtttttatttttaaaatttataattttctatttatttcttataaatattttaaaattatcagaagtattacatttattatctcaatatggattcaacatttagttcatcctgctttcaaaaaaacaaatgtcatatcttagctattgtgaataatgttgcaatgagcatgggtaaatagctgtttaacacactgatttcatttcttttggacatatacccacgagtgggattgctggatcacatagtaatgctgtttttaagtttctgaggaacctccatactgttggtcataatggctgtaccaatttacatttctaccaacagtgtgcaagggtttccttttctccatatcctcatcaacacgtatcttttgtcctttttttttttttttttttttttttttgagacggagtttccctctgtcgccaggttggagtgcagtggcgtggatctcggctcactgcaacctctgcctcccgggttcaagcaattctcctgcctcagcctcccaagtagttgggactacaggtgcacaccaccacgcccagctatttttttattattatttttaatagagaaggggtttcaccatgttagccaggatggtctccctctcttgacctcgtgatccgtccacctccgcctcccaaagtgctgggattacaggcgtgagccaccatgcccagccttttttaaatcatactttagtctggaatatatgtgcagaatgtacaggtttgttacataggtatacatgtgctggaaaccatcattctcagcaaactgacacaggaacagaaaaccaaacaccgcatgttctcactcataagtgggaattgaaaaatgagaacacatggacacagggagggaaacatcacacactggggcctgtaggttggggtgggggtcgggggctaggggagggatagcattaggagaaatacctaatgtagatgacagattgtcgttttaataaccattcaaacaggtgtgtggtgataccttactttggttttgatgtatactacctgattttagtatgttgaacattttttatacacctgttgccatttgtgtgtcttcttttgagaaatgtgtattcagatcctttgcgtaaattttttttctgttgatttatttgactttcttatgtattttggatgttatcttcttatcagatgtgtggtttgcagttattttctcccattccctagattgtctctttattgaagccttccttttctgtgcagaaacgttttagttttatgtaatcccatttgtctattttcagtttcatttcatgcaatctcatctatttttgcttttgttgcttgtgttttttgatgccatatccgagaaatatcactatccagaccaaagtcagaagtgttttttttctgtttatttcttagtagtttcacagtttcagatcttacatttaagtcttaaattcattttgagttgatttttatacgatgtgaggtggtaatatcaatttatagatgaatgaagaaaatgtggtacataatggaatactagtttttttaaaaagagaaaatactgccattttgacaacatggattaacttggaggacattatacaaagtggaataatagacacagacaaaaccatatgatttcacttacatgtatagtataaaaaaattgaactcatagaaacagaaaatagaatggtggttgccacaagctgggaggtaggggaaaatggggagatgttggtcaaatgatataaagtttgagttgtgtagattaaataagttcaaaagatctaatacgtggcatgatggttatagttgataatactgtattgtatacttgaaatttgctaagagtatataacttacatgttgttaccacaaatatgcatataaaaggtaactatatacagtgatggatatattaatttgcttaattgtggtaatcattttattgtatatgtatatcaaaacataacattatataccttaaatagatacaatacaattctttaaaattatacctcaataaagttgggaagaaaagaaaaagaaatcatacaaattaaaaaaaaaaaaaacaccaagcattcaaagtacaaattagtgcaatatatatataactgtgtgtgtgcaagaaatctggtttcacaaatgtaagagaaatcctaaatacatggctttctatattatttcaaaaatttttatctcttttcaagctataggtggcttttcattatgatattctatataaggaggaaagaagacttatgcacaattattctctgatgagatagtggtttagtttaccttatctcactaataaactgtagacaaacaaatggaacaaagtatactatctctctgtattctttcttgtatacaggaaagaaaaattgacaccctgggagcagacatgtatttaaaacctgtatttgacagtgactaggtgcatgattctgagaaagtttacaaacagtgcctctgctggtaaaaattgcaaaataaatggtagttactcttattgtcatcattaaaattatcatcagtatcatcattgatgttaataataagcaatgtttacttcagcaaatctggataaaatgcagaattgataagaatgggcacttaattcgcatttcttactacaacagtgcaggggatatgtcctaggcactacacatttatctaatatttaacaatggaatatattatttaaattggctatttacacatattttatgctttacaccagtccacctaaggcttgaagttggtgagaagtatttaatactagattaaaatcatgtattaaaagaaaacatgtagggaaattacaaagcatttgatcctgtgcatgattaaggataacaccaatttgattctaatatatatatatttttaagacagagtctcactctattgcccaggctggaatgtagtgccatgattttggctcgctgaaacctccacctccacagttcacatgattctcctgcctcagcctcccaagcagctgggattacaggtgtccaccaccatgcccagctaatgttttgagtttttaatagagacagggtttcaccatgttggccaggctggtcttgaactcctgacctcaggtgatccacctgcctcagcatcccaaagtgctgggattacaggcatgagccactccacccggccttaattctaatctttcaagatatttttaaaaatacacttcagtgtaacccttatttttttaagctaggactaaaagaaaaaaaaaaattcctaccaaaaatgcaataacgcattttagaaaccagtatttgtcaacatctctcaatacggagtgagagtatacatcaaaacaaaatttagtataatacattttataaagtcaacacatgattcaataataaacatctatctgttaaactgacactctctaagtgtaaatttaattctctatattgaaaagaatgggtttcttgccattaatttatctatttgatgacttaatgtgtattaaacaaatagttgttgaagacattctaggtgtcaagcatggtattatatatcacacacacaaataaatataagaattgtatccttttgcaagaaattcactgtccagtgaaaggagagttaaataagaaaataaacataatgcaatactggaaagaatgaaggaatcacttggtagcacaatatgcttacacctaagaaaaatggaagtagaagaaaaagctgtctgaagagtgatatctgaaagaagtctcaagtgatttatttggaaaactatttctaaaaactagaatttagttaagaattataaagaaaattataacatatggtaagaattttgcataaaaatgtaatttacaaaagcggtatcttaagagcaataaaaaataaattatcttccttttccagccataatgttataatagagaccagatttaaccttctgctctaaacaactagaaaactgaccagtacaactaaaacaagggttttatgttttggacaacagactagaaatgacagtgaactctttgattaccccatcatactgtctggagaaagtctctggtcttctgcacagattgtgggaacacaaatggaacatggcattctccatgagtagagaagatagatttgagaattcaggaaggccaaaataaatagaattttctgtgtacagtaccagagaaaagtgagttgcagaggtctccagaaatctgcagaggattagccttaagtcttcaactgaacactgatcataataattatgtgaggaaactatggggtttggaaaaaaccaccagaaaagaacagacccaacagaaaactgataagaatggaaagcatatagctgagaaatgtgagcagaggaaagtaagacccatgatggacaagaaggcctaggaaacagagctagtgaaggaagatgaacatgaaaaagagaccagaaattaacatctaaagggaggagaaaaatcagtgagcatagtgccaagacctttccctagtcaaacgtaatagtttaaaatacagcttctctctctgggcagcgcatctctgaaagaaaggcagcagccccagtcagggacttacagataaaattcccatctccctgggacagagcacttaagggaaggggcagctgtgggcagcttcagcagacttaaatgttcctgcctgctgactctgaagagagaagcggatctcccagcacagcgcttgagctctgctaagggtcagactgcctgctcaagtgggtccctgaccccagtgactcctgactgggagacacctcccagcaggggtcgacagacacctcatacaagagagctccagctggcatctggcgggtgcctctttagacgaagcttccagaggaaggaacaggcaacaatctttgttgttctgcagcctccgctggtgatacctaggcgaagagggtctggagtggacctccagcaaactccagcagacatgcagcagaggagactgaatgtgagaaggaaaactaacaaacagaaaggaatagcatcaacatcaacaaaaaggacgcccacacagaaaccccatccaaaggtcaccagcatcaaagactaagggtagacaaatccacaaagatggaaaagaaaaaaaaaaaaaaaaaacagcaaaaaaaggctgaaaatccaaaaaccagaactcctgttctccaaaggatcagaactccttgccaggaaggtcacaaaactgacggagaatgacttagatgaactgacagaagtagccttcggaaggtgggtaataacaaattcttcagagctaaaggagcatattctaacccaatgaaaggaagctaagaaccttgaaaaaaggttagcgggattgctaattagaataaccagtttagagaagaacataaatgacctaatggagctgaaaaacacagcacaagaacttcatgaagcatacacaagtaccaatagctgaatcaatcaagcagaagaaaggatatcacagattgaagaacaacttaatgaaataaagcatgaagacaagattagagaaaaaagaatgaaaaggagccgggcgtggtggctcacgcctgtaatcccagcactttgggaggcggaggtgggggggtcacgaggtcaggagatcaagaccatcctggctaacacggtgaaaccccgtctccactaaaaatacaagaaattagccaggcgtggtggtgggaacctgtggtcccagctactcgtgaggctgaggcaggagaattgcgtgaacccgggaggcggagcttgcagtgagcagagatcctgccactgaactccagcctgggcgacagagtgagactccatttcaaaaaaaaaagaatgaaaaggaacagacaaagcctccaagaaatatggaactatgtggaaagaccaaaacttcgtttaactggtgtacctgaaagtgagggggagaatggaaccaagagaatggaaaacactcttcgggatattatccagaacttcccctggcaagacagtccaacattcaaattcaggaaatacggagaacagcacaaagatactccttgagaagagtaaccccaagtagaataatcctcaaatttcccaaggatgaaatgaaggaaaaaaatgttaagatcagccagagagaaaggttgggttaccccataagggaagcccatcagactaacaatggatgtctctgaagaaaccctacaagccagaagagagtgggggccaatattcaacattcttaaagaaaataatttcaacccagaatttcatatccagccaaactaagcttcacaagtgaaggagaaataaaatccttttcagacaagcaaatgctgagagattttgtcacccccaggcctgccttaccagagctcctgaaggaagcactaaatatagaaaggaacaaccgttaccagccactgcaaaaacataccaaattgtaaaaaccatcgacactatgaagaaactgcatcaactaacaggcaaaataaccagctagcatcataatgacaggatcaaattcacacataacaatattaaccttaaatgtaaatgggctaaatgcctcaattgaaagatacagactggaaaattggataaagagtgaagacccatgggtgtgcggtattcaggagaactgtctcacgtgtataggctcaaaataaagagatggagaaatatttaccgagcaaattgaaagcaaaaaaaagcagggattgcaatcctaatctctgataaaatagactttaaaccaacaaagatcaaaaaagacaaataagggcattatgtcatgctaaagggatcaatgcaactagaagagctaactatgctaaatatatgtatacacccaatacaggagcaccagatccataaagcaagttcttagagacctaaaaagagacttagactcccatacaataatggtgggagattttaacaccccaatggcaatattagatcaacaagacagaaaattaacaaggatattcatgacttgaactcagctctggaccaagcagacctaacagacatctacagaactctccaccccagatcaacagaatatacattcttctcactcccacatcacacttattctaaaattgaccatataattagaagtgaaacactcctcagcaagtggaaaacaacgaatatcacaacaaacagtctctcagaccacagtgcaatcaaattagaactcaggattaagaaactcactcaaaaccacacaactacatggaaactgaacaaattgctcctgaatgacacactagttaaataacaaaattaaggcagaaataaagaagttatttgaaaccaatgagaacaaagacacaatgtaccagcatctctgggacactccttagtgtttagagggaaatttataccactaaatggccacaggagaaagcagaaaagatctaaaatcaataccctaacatcacaattaaaagaactagaaagtaagagcaaacaaattcaaaaaccagcagaagacaagaaataactaagatcagagcagaactgaaggaatttgagacacgaaaaacctttcaaaaaatcaatgaatccaggagctgttgtttttgaaaatattaacaaaatagatatatcactagccagactaataaagaagaaaaaacagaagaatcaaatagacacaataaaaaatagtaaaggggatatcaccactgatcccacagaaatacaaactaccatcagagaatgctataaacgtctctatgcaaataaactataaaatctagaagaaagggataaatccaggacacatacaccctcccaagactaaaccaggaagaagtcaaatccctgaatagaccaataacaagttctgaaattgaggcagtaattaatagcctacaacgaaaaaatgcccaggatcagatcgattcacaggtaaattctaccagaggttcaaagaggagctggtgccattccttctgaaactattgcaaacaatagaaaaagagggactcctccctaactcatattatgaggccagcatcatcctgatatcaaaatctggcagacacaacaacaacaacaacaaaatttcatcaggccaatatccctgatgaacatcaatgcaaaaatcctcaagaaaataccggcaaactgaatccagcagcacatcaaaaagcttatccacccagttggcttcatccctgggatgcaaggctggttcaacatatgcaaatcaaaaaacataatccatcacataaacagaaccaataacaaaaactgcatgattatttaaatagatgaagaaaagacctacgataaaattcaacaccacttcatggtaaaaactctcaataaactaggtattgatggaacgtatctcaaaataataagagctatttatgacaaacccacagccaatatcatagtgaatgggcaaaagctggacgcattccctttgaaaaccagtaaaagacaaagatggtctctctcaccaagttctggccagggcaatcaggcaagagaaagaaataaagggcattcaaatagggagagaggaagtcaaattgtctgtgtcaaatttgcaaatcaagtcaaattgcagatgacatgattgtatatttagaaaaccccattgtctcagcccaaaatctccttaagctgattagcaaatttggcaaatactcaggatacaaaatcaatgtgcaaaaatcacaagcattcctataccccaataacagacagagagccaaatcatgagtgaactcccattcacaattgctacaaagataataaaatacctaggaatccaacttacaaggtatgtgaaggacctcttcaaggagaagtacaaaccactgctcaaggaaataagagaggatgtaaacaaatggaaaaacattccatgctcatagacagaaagaataaatattgtgaaaatggccataatgcccaaagtaatttatagattcaatgctgtccctgtaaagctactgttgactttctttacaaaattagaaaaaaaactactttaaatttcatatggaaccaaaatagagcctgtatagccaagacaatcctaagaaaaatgaacaaagatggaggcatcatgctacctgacttcaaactatgctacaaggctaccattaccaaaacagcatgggactggcaccaaaacagacatacagaccaatggaacagaatagaggcctcagcaataacaccacacatctacaaccatctgatctttgacaaacctggcaaaaacaagcaatggggaaaggattccctatttaataaatggtattgggaaaactggctaggcatatgcagaaagctgaaactggatcctttccttacaccttatacaaaaatttactccaaatggattaaagacttaaacgtaagtcctaaagccataaaaaccctagaagaaaacctaggcaatcaataccattcagcacataggtatgggcaaagacttcatgactaaaacaccaaaaacaatgacaacaaaagccaaaatttgcaaatgggatctaattaaactaaagagcttcagcacagcaaaagaaactatcatcagagtgaacaggtaacctacaaaatgggagaaaagttttccattcaatccatctgacaaaaggctaaaattcagagtctacaagaaacttaaacaaatttacaagaaaaaatcaatcccgtcaaaaagtgggcaaaggatatgagcagacacttctcaaaagaagacatttatgcaggcaacaaacatatgaaaaaaaagctcatcatcagtggtcattagaggaatgcaaatcaaaaccacaatgagatgccatctcacgccagttagaatggcgatcattaaaaagtcaggaaacaacagatgctggcgaagttgtggagaaacaggaatgcttttacactgttggtgggcgtgtaaattagttcaatcattgtggaagacagtgtggcaattcctcaaggatctagaaccagaaataccatttgacccagcaattccattactggttatatactcaaaggattataaataattctactataaagacacatacacatgtatgtttattgcaggactattcacaatagcaaagacttgaaaccaacccaaatgcccatcaatgatagactggacaaagaaaatgtggcacatatataccacggaatactatgcagccataaaaaaggatgagttcatgtcctttgcaggggcatggatgaagctggaaaccatcattctcagcaaactaacacaggaacggaaaatcaaacaccacatgttctcactcataagtgggagttgaacaatgggaacacagggacacagggagacgaacatcacacaccagggcctattggtgggtgggggcaaggggagggatatcattaggagaaatacctaatgtagatgacaggttgatggttgcagcaaaccaccacagcacttgtatacctatgtaataaaactgtacgttctgcacctgtatcctagaacttaaactattacaaaaatcaattagttaaaaaaatattttcagttaagctgtggttgaatacaagaaccaaccacttccccatgtaatattgataagcatggaatgcatgaatcatagagtctcagggtaagaagatttgctccaaagctaccttgagtcaattaatgggattcagctggaaacaaagaaaaacctcgagggagaagtaccagttctaataaaatgctcacagttaaaacaaaaataaacaaaaactgatatattcatttcttatgtttttaaagttcaaccaaacataaaattgggggcataattcctgtggggttaataaaataagtacatttcttcagccagttgatgaaaaatatgtaatttcatttacagcccctgttggttttaaaaacgaagtgtttttcaagtatacacaatgatacttatatgccttcaggtataaatattaaatgatctaaaagaacacaattttgctttattgatttcagctgtcaaaatgataaaatacaactttatttccttctattacagaaagctggtcaggctttttagagagtgatagaggcactagtatcaaaagaagagagaaagtacatagagaagataaaaatgcatccaatgtctaaccaaaatggtaaactacttagggaaacttcacccagaataagagtgtgattgaaaatcaaacagaaaagtatagcacctagtcataatcttaaatcaaaagagttattcttatcatctgatgtttccaaattatacacagaattttatccacatgaaaatatggattgaattttcatgtcttgtttcttcaggattaaaatcctttttagaaagtaaaacatgaaattttcaaagaaaagggaaaataaagagcatgttaaaaaaagaagacattattggaatacaaaagttaatgtggtttctacacttgaagtttcttagaattgaaaacatagaaaggaggggttagatattgcataacctcaagttgttaaagcaggatgaggagtaaggctcttaggaaggaagagacagcttcatggcagaagcaaggagtccagggaaggtggtaagaactgcctcagagcatcagcgagctagtgaaacattaaaacgtataaatagcaattaataagatctagagaagcattggaagcccctggctaaagtatggtcaggtacacagaaccacaacagaggcaagaatgtgaccatgtttagaaatcaaatgtcagaatatggtaaattagtcagcagtaagtgaagaagtcaaaggtatggtacatagtattaaaattcaggacaagcaccaagtttaggtttcaagtactctaagcttaaggaactagacaggtagtaaatgagttgtgacagcagtttataaactaaagagagtatatggaattaaatttaaaaactgaaaatttggggacaggctaacatttaggtggcactgtgacagcaatttatatagataaattcatataatcctcaaaatgactgcacaaaattagtggtagccctatattatagatgagcaaactgaggctatgtcatagaacttttctaaagacaaagagctagtaagttatagaatggaaattctgagatttattcaccttccaagcttctgtcatattaccaggcactgaaattgaacaactgaagacctttaaaaatcttggaaaatgcataaggactttgagctaacatttgctttagtgtggtagcatttacatcatccttgactagccagtgaaaaacctgtagtaagtgatctgagaacagtgagagttcgccaaaatcatgtaagcaacattgtgacttggcgatcagtgcgtttcctacttgttctttggaagtaacttccacaatccatctttttggagaatgagactcatttgtaatgaatatatgcccaaccccaggtttttagaacgttaaagaagtgaagtgactttaaaagtcctaagtattcttcagatgagaaaattgagattaagacaggttaatatacttaaaattttaaaaataacatctgtccagggccagagggggaaaaataccaaacgaacatgttgagagtgtctttgttcacttgttcccacttagatatttatggggaaaggtctttagaagactgaagaatatcaacacatctatggtgctatgtatatttattcatgaaatttttgtctgaatcacaaaaatcttgtatttcttttaagctttcaaacaaaataattttatttaaaaatagtttcttatttaagaaaattactaaattatgaagaatataagcaattgtttttcatgatgtatcagccttgtgcttaatttgccattaggaggaaacaataatctctaagaaagctaatttagtattgtagctttttaaaatggattggattatattcccccagtgacatgttaaagtctcaacttccaataactcagaatgtgatgttatttataaatagagttattagagatgtaattagttaaggtgagattgagactgaatccattatgactggtgttcttctaaaaaggtgatgtgaagacacacggggagaatacatgtaacgggaggcagacattggagtgatgcagctacaagtcaagaaacatcaaagcttgaccaccaccaaggaagctaggagggggcatggagggattctcccctgtaggtttctgaggaagcatgaccctgctgatactgttttttagtacagctagactccagaattgtgagacaataaatctctgctgttttgagacaatcagtttctggtattttattgtggcagacctagaagactaatatgttacattgttcatcaaaatatattcactattccagcattggtgtcacaattaagacttagagtaaatataatcaaatgtcatgtcttcaacatccaccatcctctttaaatattttattttatagttctgtattttctaatcattacctctgctctctctctcaatcgttcaaattatatttaagtctttccactccattttgactttgttacataaaaatgcaccctacacacacacactcacacacacacacagacatatgcatagagtatttcagttaaaaatcactatgatcagggcattcatagcttatgttattaaatattatagttaagtagagttcctcaattcaacgtgaagatacaaatcaatttccaagaatgagtatagatgcacaacactaaacatatattttagaatcaacacgacttatcaactcttggcagatgcagaaatcagaggttctttctgtgcctcagggttgtaataaggaatgtcattatacacttatcagagtttcgctttataatagagctgttgttagagacagttttatagctgataaaaatttctgataagcctacttgtagcgtgtctaaaaattggtttgcattattttcctttatttgtccttagagggtggcttaagatgcttctctctgcttcacaaaattgattatcaaaataaaaataatccaatgcatcagaaaattacattgactcaaccttcaaaacatatccagaatctgaccatttctcaagctttcatgctgacagactagactgagccatggccatttctagcctggattagggcattagcctcttaactattctccctttgtgtattcctgcccaaacctcacacacactgatctgttctccatagtatagccagagtggtcactcaaataatttcacttctctgcttaaacccctggaataagtctttatttccactcagaatacaaaacaaggtcttaaaattgcctaaaattatcagaatctcctctcccccattatatatgtgacttcatcctccacaagtctctaccttgcttgcctgctcttccacactgtcgcccctgatgatcccagaaaatgtcaatacatgcctacattaacacagtactggctttttgctctgtgggcttttcttctcccctatagctacacagctagctctcatcctcttcaagttgtcttcgtcaaagagatcaatcctgatggtagaatgtaacagtgttgtcactcactcttcaacccagaacttgtgacaccccacacttgttctacttctactttttcttttatcacattctctttctctctctctttgtgtgtgtgtgtgtgtgtgtgtggtgtgtgtgtgtgttttatgcttagtgtttattatctgtctctctccactagaagttaagctccagagggcataaaatttctgtcttgttttcttgtttagcaatgtatcactaactatggagtccaggacatggtgtattcacaataaaatatgctgctagtgaaacatggttattatggaagaacacattttatgataatcactattacacttaggcgataacactgttgaggggtttaagtaatatcttaattactgacattaaataccatttcaaaatattgctgattgatgcctattaaagtgacaacttgtcatactgcaccacatgcttcaagtataaatagatttgggaggcaacagaaatatcttttcattaattttctatgtacaagtgacttacattagtaaacagaatttaaaaagtctctggagaagcaagttcttctcctcattcgcagaattaggtatgttggtcctacccatgggcgaaagaatgtgtctcaggtctttattcctgttttgatccctgctcccttgctttaatcaattctgccctggcctttctcaatacctggagtgagagatgctcttcactagaagacccagctaagatctgccctagcaggaaagtcactgaaggcctgaaggacaaaaatgataagcagaacttcacttccttcctcaaacagtatattggaaggaaaaatccatgatatctggatttcacacactcaaattccaatgccaactcactggaacctgagccaagatagtctttgcctttatatcatctggaaagttgtatagagaccaaatcttcaaccccagatcattctcatgtatgaagcaggtattaaataaatgccagttactattataattatccttgaaaccaggaatttttgtcctcatttcaatgatttctaaagatgcccactgagtatctgtgttgtttcttggtcaaaccatttcctccttataaatgtcctccacaagccttattatcactggaccaggtcacagacagggttattggcttaggtcctctgcttagaacatgaaaatgcccattctcattcatattctcagtgtagaactgatattaagtcctgaaattctgctgtactgaatctttgctcaagaacagacagctctttcctacgtgaatcctgctttctggacatctggaatcaagcactatactggccggttactttgaaataagctatgatctcttacctttacatctctcactagctgcctggagtcttgtggtatcaaatcattgacctgttcaaagtcactcttagccatcattaagttgataatttattgggattactgtatattgagccacccaacttcttccttaggaaccaggcacattatatttatttatttttttaagtcccagggtgttttccattcctagacttcaacatttttatagcttatgttgctctgttcatagaagctttcatagctaagccttcttaacctatattaacttgataaatctttgtgacaatttttaagatagatgacatacagcctttctgggatctccattcttacagcaaagctttggataaagtattatgtctattaacatataactcctcctgaaaaagcccaaatactgctgagggaagctaacagaaacaacaaatgaccaaagtcaaggtgacattgagttatgcacaatattctataggagaaggataaagggaaaaattaaatcttcaaggtttttttcacagaagtcttccaataggcagtggcatttgaattgggccttaggacaggaattctgatagactgggcaataaagggcattcatgagaagggactatgagcactgaagtgcagagttgtgcaactgtatgacaggactgaggaatagtgaatcataaaacaggttagaaatgagtggtagagaatgactttagatgatgcaatcaaggttgaatatactagttggaatgcttaggattttaaaccttttctcataaaaaagaataactcttgtaaattttaaaatagaggaaagaaaataatatgtttatgtgtatattattttttaaacctctgaaaataatgtggaaggcggaatagaaagactagagactagaaattgtccatttagagagaactgcattatttcaagagagatcatacaagccaaaactggagttgtaataaacagacataaaaagctgaatgagagaattcctaaatataattcatagtatttttgataaagtttaccctgaagtttagaaatccagatggatgtaaatttcatatgagagatgaatcagggaaaaggaaatatgggtagggagagagatgaagatttttggtattgggaagattacaattttatctcaagtttaaagtattgagagacttacaggtgaaacacaataaatagtacaaaataagaaagtatatatctctgcagatatttgaagctatgagtgaaagtgcaaagacaaattgcggaataaaggaataagaattgactaaagaattaaagatgagtggaaagagaggaggaagagagaaagagagtgatgggaaacatctaagagcaaatgttggaggattctaacatttaagtggtcagcatgtgaagaggagtctgtgcataaaactggggtggtagagtagggaaggaaattacaaaatagtggcaccatggaccgagctacatacaaaatgttctgggctgagttgaaaatgaaaatcagaaccatttgttcaaaaaagtagagaaaatgtaccgttacaggtaattagatataaagtttttcctttgttttatggtctttatctaatcattttatggtattttatttgctgtttaatgtcattctatgtaagaaaaattttcaaatattggcataaatactaccatttatctttatgttgcataatgccagctttaatgacaaatataatttaagaattaaacatcaaaattacataattcatatttcatggttcatacgtgcatgttattcttatcacaacagtggaaacactgaagccagtggcttgtataatgcccttacgttgtactcgagtctcactgagctattacatactgtggctccaccaaaagtcaagtccttctgaggtcacacacccctgaagcccacactggatagatctaagggcttcacgaagggcagataatgagtgtctaccactgtctatgtctttatgatagggcgccatcagagtggtagagaagacagggacattgtaacttgagatagaacaataggattaagtaggtctgaaatctgaacttttctgagtccatttatggctgatactaaaaacttggccagaaaagtaaaataaaccaaactgagaattgtcaaaatttacccatatcgttatatcagatgctggcaagttttcctgtaaagaagaacatagtaagtattctgggcttgctatgtgtgacacaacctctgtcacaactattcaactttgttgtcattgtacaaaattagtcatagataatatgtaaaccagtggtctccaacccctgggccatggattggtacctgtctgtggcctgttaggaactgggctgcatagcaggaggtgagcctcctatcagatcaacagccacattagattctcattggaggtgaaccccgttgtgaactgcacatgtgagggatctaggttgcatgcttctgatgagaatctaactaatgcctggtgatctgaagtagagcagtttcatcccaaaaccatcccctagccccccatggaaaaactgtcttccacgaaactggtccctggtgccagaaattttggggactgctgatgtacatgaattggtatagttatagctgtgttccagtaaaattgtctttccaaaaacaaggaatgggtcagatttggcctgcaggctatagtttgccaatccttggtctttttttttttttttgcttgctatttttccaaggtcatgtaccactgagatgggtattcagcaatgaaaatgaaagtatttcaaaaccaaagaactgtagaatgcacaaaaaagtttgtattattaaactatcacaatcactctactgtattctctatagaatgtcaataacactattccatgcagtgactagtgggaatgaaatgcaaataatgaatgatctggaatagtacaaactagcacaacacaaaagcacggggctttcatttgttaggaaggtgctagcagatgtacaggaaagaaaatgccaggattttacttctgatcttattgctcctgtgtgttgggtttcagcagatacagttggccctgtaggaacaccagcagcattcattgctgggttagttccaaatgaggttaattgtatatattttaagtaagttagaacaaaagtgacattatatattgttacaaaagattctgtcttccatgcaaatacttccttggccacaggaaaagggttctgagtgacttttaatgtagtaaagtaacttggagaggtatggttggaagtgtctacatcttacttgtagggtggacatcttctttggtgtttaatagttttaatcagaaggaaaactttttccttatttgttggtttataaaatgtaaatataggaatgaggagtttgaaaaccctgggacataaacattattcaaaaaaaaccctaggatataaacatatgattcaaaatacgtagaaaagaaaaatgatgttattgtgttaaagagttacagctcatatttgaacacttcagggcccaaataagcaagcaggcaaacaaacaaacaatcatagtggtgactggtgcctgtcacaaagtagaccatcaatgaacacttgaatattgaataaaatgatgtgattaggccaggcacagtagctcacgcctgttatcccaacactttgggaggccaaggtgggcttatcacctgaggttaggagttcaagaccagcttgaccaacatggagaaaccccatctctactaaaaatacaaaattagccaggcgtggtgacagatgcctgttatcccagctactcaggaggctgaggcaggagaattgcttgaacctgggaggcagaggttgcagtgagtcgagattgcaccatcgcactccagcctgggcaacaagaatgagattctgcctcaaaaaaaaaaatgtgattaattccactcaatttttcttctaatttcactaaaacgtaaataatactgtagaaatgtgattaatgattttaacataaacataataatttcattaaaaatatgtagatggcatgtttggacataaaatatatctctgtgttccatgcaagatatatattatacttttttcaattgatttcctgtcaactattataatgctatgacttacaataattttctatatgaatatatttctcaaaattcttgtagtttattttaatctaacatgaataaaatgatcaaatatgctttttgaaatattcttaatatctcaataaaacacatatttgcaaaaacatattttgttctgataaaaagtatatagtaatatgtaaagcatgtaaaaaataaaagtaaatattaaaaacaacattaaggttctggaagaattaggttgcatatgtgtggtgtgcatgtatacatgtatttagaataggttgtatacatggttttacattttctcctataggaagagagaaacaattttccatgtcagtatttaataaagccaccatattatgataatagttgttttccaatttttaaaattttaatataatatttaatatatcagtaataattttctaaaattgaaattatattttaatgcttttaaattttttattaacaaataatcctccagaaagatggtgacaacttactctcccaccaatagagtgcctccactgtgactttcctaattcagaccactacaattggaaaaaaaaagactaacaaataggtagttaaaatttgtatcacattttgaatttgatactctgagttgctcttaataatttttgaatatattttactgcatatagtttttatttgcaaattgttttactgttctagtggtcagcattttgccatcaatttaaaagaacacttaataatcatatgtctgtcttgtaaggtaaaacatggctgcatatattttctttaacgatgcttaagatcattttttggcttagaaaggtattacttttagttaatgtactataaaatgtactcactatcaacatttaatttataattttctaattttgctttcacagttaaaaattttcaattttgagattaaataaatactattatttgacccagcaatatcgttactggatatatactcaaaataaaatagttttactaaaaagacacatacatttgcatgttcattactgcactattcataacagcaaagacacggaaccaacccaggtgtcagtcaatgatggactgtataaaaggtggtgcgtatacatcattgaatactacacagccataaaaagaacaaaatcatgtccttggcagcaatagggatacagattgaggcccttatcctaagtgaattaccacaggaataggaaaccaaatactagatgttctcatgtgtaagtaggagctaaacagtgagtacctatggacataaacataggaccagcagacactttggactagtagaagttggggagggagcaggtaggggttgaaatacctacctattggatactatgctcactacttggatgatgggatctgtaccttaaacctcagcatcacacaatacaccatgtaacgaacctgcacacatacccactgtatctaaaataaatgttgaaacttttattcagatcatttaatgttttgttttgcaattctatgtggttattcctaacacaatttattttggcctgaaacgtagagaacgagttttcaaaataaaacaatgcatcaacagaattcagtaaataatctttctctatggactcacaatcaccccttggatgtagttttatatatagcatgtatatctagactttctattctatttccttttatcagcattttctggagcaatataacattttaactacagtttttatgtgttacaaaaacatacacattctcttattgccctttctattcaacactttcttggttatacttttgcactttcaaataatataagttctaagtattatcttatttggccttgtttggaatttctttatacttttcaaatattgtatgtaacattaacagcctacatttctgagtgctcaaattaatatatcacatgtccatttatatacttttatggttagtaaattttaccttttaaattgttctgtatggttttaataagcagtagtttgaactttttgttgcttaatgctatgatttggatatttgtgtctactctaaaattcatgttgaagctcaatcaccagtgctgcagtattaaaaagtagggtcgttaggaggtgtttagaccatgaagtattctctcttctggatgtaattagtgtctgataacagtgcttgatggggtgagttcagcccttttggcatttcttccacatgaggacacctcattctggtgaagaatgaggaaacagacactcattgaacttgctggaaccttgatctagaacttaccagtctccaaaactgagaaataaatacccattctgtggtattttgtaatatcagcacaaatagactaagacacttaatgcattttttccatattttctaaattatatgtaagaaatacatgtacatgtatacataaggcattttgaactgttaatgagtttaatgaaactatctcttctgtttcagcattaagacactgaatattgttgtgagctatttctatattggtatgattaggaaatattaatagatgccaaaaagatttgaagatgtaaatcttttcagaaagaaaaaacaagagataaaatgaacacatttaataaaatatcaattgagtgttaaagtctttttatttaatgatgcagtaaattacgttattaaatatcttaccttgacttatcctttttattcttggaggaaatgcccctttgtcatttaatagaattttatctgcagtgtacatttttaaatttagaagttacaactaaaagtggaataaacataactcaaacactctatttttcctatccattgctatttgagaatatttggttcatgaagctctgattgctctttcttatatccttcccaaataaccagtagaaaaaatagagttatattgctgtaggaaaagaatgacaaattgctagaatatgttccctttttctcttacattttatttcctttgtatgttaaattaaatcacacaaagtcatgcagtttcaaagacgtcagagaaaaggactttgattcaatttaatagagctgtcaccgtaatacagggctagcaatcatgcacttcaaaaagtacacaaaactcaaagaatcatgctgatagaggtggctccacgatgcctcactttgttaatcgcaagaggttgctcagagtgtcatttttttttctagtggtccaatacaaagtgggaaagtcaccagcagcaagggactctaaaattataggcttgctaccttagctacttttctattatggaaataccacatatggtggaaatgatagcactcagtggtctactttggaagcagacaactcccttcatcatttacacatttgttctatattttggcagtgtcacggaaaccattatgtgtaagaaacaggtatatataatggttcaatctttcaagatttttgcattgtagaacattagactatggcctactatatcatttctctacatgaagagattagaccagagtttttataaagattatttccagtaatatgttttagtgactttatacaaccactattaagcagctattttaatgccatttagtgttagatgttaggtgtacaagagtgaacaacacagaaatcatatttatgtaatgcttagttgtttaacctggtgctggctatcattttaggtatctgcacgttcctggaacccaatctttcatggataccaaacaatgactactatggcaacatctgcatctaaattgtgtaaaacaattttaaaagaagaaaatactatagtaaccaagacagtttggaattgggtaaaagaaagacatatggattaattgaaaaaactaagactccagaagctgacccgcatgtataccattgattgatttttgacaaggtgtaaaagtaatttcatggataaggaataagcttttaaacacaaggctctggaacaattgtatcaccaagtttttctattttcctttccttcattgccagataattttaagatggagtctggaaagaagattaattagactagatggtatttgtcagttgagaagttagaaataagttaatttgctcaacaaataagatggttatcatattcatgctaagaaagatcagaaaaaaattcaaataatcactgtgatgaaaattttaggaagccaattcaaaattaactaggattgcctagaagaattaagagcctaggtgaggaattccataagaattttagtggaacaagccattattatgaattttgacaaaatacaagctggaaattgacaaatgtaggactctaatacatcaacatttgctcttcccgatcttctttccacccttgtttattctaccctctaaacactagagatcaattcaaaggactggctttagcctccagctactgaacagctttggttaataagaagcacctgcagaagactagaagacaacaggaaaggggttgtctagtattttctagtctcctccctgtctgttcttattggattacctgtgtcctacttccaaaggccacaccttctgtaacctagaagctttccattttaggttctggtccttctcttacctctgtctctttaggcccaatgctggttttgctgttattggtctcttgagaactgtaaggtccttagttttccttaaactctacccatattttaataagtaattaccatattaaactctccccaaatacccagttagactgtttattcgctgatgtgactctgatcaacacagtggatgaacatattggaaaatgtcaacaaatgccttgcaaatgatttattataatgactaaatgactagaaaggcaagaaaaactggaaggagattaggagatgtaggtgaggtcaaaataaagaatagttgcaatgggaatgaagaatgggaaaagtgaaaagcagcaagattatgtttaaaaagaccaaattttaggttttatttactaataatgaagaatttgtgccctgattatttccaagaggtggctatgggatgaattgtttgagagacgttttaactctgctacatttaccaagaaccttatatgtgagaaatgatgtattaggcattgtatgtgagttataacagataaaccacaagctatcagcctgtaaaagtacaaggacaataccacatttaaatttgtaattaattttatcatggttttaagaaattttgtagacaaaattatatcatattgaatatatgatataccaaatagaatgacttgttctttcatgttactgaattttcagccataaattacacacctaaaaccttttaaacgttggggtaatatatgaagcaaaaacacacaaccatacatacacagacacaaaccactataagtttattgtcaaaggaaaattaatttcactgccacaaagtaacacttgaaaattccacaagatagaatttcttaaaataatgaaaaatcttatctttctggtaaacacaattctttaacctttttccttttttacatccttaccaatttgatagcaattacaaggggagaatagtgatttaaaatacgctttaaagtaagaactgttatatgagaaaactggcttgtcattaatatatcaaggctctgaattcaaattcacagatattatctccttcaatttttgcatagtgcttttgttaaataaaatacttgaaattaacttatattctgaattatataaaatgaaacaaaaaactttaaatttaaaaatgatataccatgccatagaggataggaaatctcaagaaagttccagtgatttcctctttcccatattaaaaaaaatgctaccactgaagataccgttagaaagagtatgttatattgtgttcaacctgacaaagaagctatttcaagaaatgagaataataaaagttatttctaaactttgagagatctgtcataatgaattgaactagttcagtttctgattgcttgacagcagtatagctgtctccaacctactactgtattgatctggtagcctttgtggcagtgcataaagaataaccatctgtgtcaggtacaacagcaggtgccttctcaattgaactggctgctgccctgattacaatgaggctgttcagagcacccggtgaccatgacaggctctttcttctctgtagaaaagaaactcatttctaaaagtttactgaacagaaactgagaaactcaccagaaatcatcagccgttgaggtgccagaatggattccagtgaagacaaagtaagagatctagtgaagggaagatgccggcttgcagtgggaaattcctgatattgcacactaggctgaagttcccatttggaccattctgaagaagtcttgacctcttttttaagagaggtcatataatctgtaaaatatggccaatctggcctaattacagacatggaggaagacgtctgtattgaaagtgctggagttgctgaaactgtataaaatgcaacattggtggtgacttctgaaaaatcaggcactgagcctgtcaatggtggcagattatttttgaagtcatttgcatgtgtaatttctgaatatgtctttaaagtaacatccggataaatttgtaagtttaactcaaaatccagagaactatcacttgggtgaagtttgaacagtgtatgagatcctttacttttttccatgtccaataagctctcttgatttagtacctcagtgggtcccatagttatgccatattgtcttattttcaatagttttaaaatgttttctgatactgacagttcatcagtagtcatttttgaagtcaaatcagaattcatcaagtctgaagagatagtttgtgaagggacaatggataaacaagtcttatccaaacataaattaacatccaaattacttgatagggtaatggattcttccaaggatgaggataaaattgttctttttgcactctttttagaaggaaataaagatggcacttctgtgaatgccactgatggtgttatttcagtagcagaagaaaatgaatgcccagaagtgatagtttgagctcccattagtgcataccagctggctaatatcgctgagttcatccagaatgtctcataaaagtgggactgtttgctatgcaaaacttgatctgagaattcacgagaggattttatttcagtcatagaacatgttgcacatgtttggcttaattctcttaaagaatcagcagcctgtgatttgatgtttgtgagtctctggttgcttgaagcctcagtaatagcctgatattcactgggattgaaggcttttgtactgaaccggtgcagagctgatgagtttaagatggttacctgtttagatataattaccttagcaggaaaaatgggagacatcgaggggctgagcaatctccagtgctctcttcttgaaattaaagaatcagctgaatattcttcaatatcctcttgagcccccctagagacaactggagttgcacttatggaggcagctataagcaggaatccacgggagagtaatgactgcctgtttagctcaatatcagcccctggaatgcttctaattactgaagtcgttggggtagcagataaagcaacagtctgacagttctcaaataataaagattgtgtaggaaaaataaaatctgacattaaggaagacatgataaatggggtccttgctctcctatcaggaaaaaagaaacctagtgtggctgctgaagttcgaataggcatatgtgataccgatgttttgtcctggacaatttgtgctgggtcacgaataccaaaattcaggaatcgagaagaggaaacatctgcggaagaaagaagactgtgttttgctgaaagctctctagtgacaatcagttcttggagtaagtagctttccaagggtgtgctaattcttaatgttgccaaaccagtggttgggagaatgtcgtgcttgacaatgcctgtctgttttggacctacaaaaaggaaaaaagccaaaaaggttagaaaaatgaatcagaaacgaaccactttggcactgggataaatctcaggcaaattgcactggcaccttacatccattatatgtagacaaatatggttctgtaaatcatatttctaataaaagtacatgaggagtttaatgatttcacaaactgcataaatgcaaagattcctattatttacactccatgggagggctaaagttagaacaaatggcattacatagaattgacatattcccaactaaatgactcctttgaataagaacacatgaaaaattacaactctttgtcattgacacaaccaatgaatgtttgacccatcgggttagaaatgttagaaataccgttttacttcctcaataggcaaaatgttctgtttatattagataacaccatatttcaatttaattttttaaaagaatagaaattacatagatgaaaaatagacaaggtacatttctacttagaatacccaatagccttcaaaattattttttcttcaagaattccttgctaagggctacaattcttactctgattatccgaagtggcattggctacatgaagagtaaatttggaatttaatatacaatgtactgtttataatatgacatcacttgatttagaaagttaaagaattggacatgtaaaaaacagcctgaagttgttaaaataattcacaataggaaaataagcacatatcttttatctgagtgttagtcaaataatttgataggaatataaatttaccttaatgactcagagaatatgaagtaaagacacattgatgcaagtagcacaaggcccttttaaaacaaaatgtgctgggattgaggtccagttgtctattcgaatttacacagtggaataaaaactgttaatttacatttttttactgatccagaaatagtattagcaaacaacattgtttaaaacaaaacttaaaacaggagtcataaccaataatgcttaattttacacccctaaaaatcatgtatctcagaaaaaaaaaagattttaataatgcagaaaatatgcttttaccacacaactttttcaaactcaaacttcttaatatcttacccacttctacttaccttgatcaactgggtaagtgtccattatggctggtattctagtagcctttatagatggaaagctgctgaccaaagtctcagaagggggaattgtatatgtctgtgtggaaatgggatctgttctttgaaagatgggagttaaacaggtaattctccttatttcatcaccacaaagaagcccaatggagcaggtctgcaaatgacaattacagtaattaaattaagctcagtttctttgttcctaagagaaattgtaaagtttgttttgagatccatttgcatttccatagacatattggatagctcaaataaaatattttacttgaaaattaaatctccatagtaaattttacccatatttcaaaatggactcaatcctttcaatttgagatatgcacagttgcatgcccaaatttattcttaattcctttaattttaagtcaaaatactatttttacttttgagaatatagttttccaatgaagaatttgtactgtatggtaattaatgtggatataaaaaagaagtcacattacaaattataaaacttttctgctctaaaagtcaaatttagttggaagctaatgtaaaatgcagtatctgcaacagaaaatttgaaaacatattcttgtgatttgcaaattattttagtttgtattggcttgcagtaggaatgatctttatgtgttttagtttgacatgaaaaggctatttctaccatatcctataaaatagctttcacatgaagaaactgtgaatgaaaattgcgataatgtataaataagtataaatggaccagagagatacgtttataaatgtagagttaaaaacaagttatactatatgaatcatttttatttgtaagaaaataatatttcaaaatgattttaaaatactaatacatgtctatttcctaataataaagacatacctaataggcatccctgctttagtgttctaatatttgttaaatattacatctaatttgcagaacacttaagtcttctttcagatgtgggtggtggttgtttcacagttccatattctgtagtcactttcaactcacaccaaaaagttgtataaatgtcagatgattcctaatgttagataattcgcaacaaagaaaagcccaggaccaggtggctttactgctgaaattgatcatacttttaggaaagaactaacaccaagtctttgctattgtgaatagtgctgcaataaacatacgtgtgcatgtgtctttatagcagcatgatttataatcctttgggtatatactcagtaatgggatggctgggtcaaatggtatttctagttcgcaacccaaatgtccaacaatgatagactggattaagaaaatgtggcacatagacaccatggaatacaatgcagccataaaaaaggatgagttcatgtcctttgtagggacatggatgaagctggaaaccatcattctcagcaaactatcgcaaggacaaaaaaccaaacactgcatgttcttactcacaggtgggaattgaacgatgagaacacatggacacaggaaggggaacatcgcacaccggggactgttgtggggtggggggagggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaatttaaaaaattatataaaaaaaagaaaagaactaacaccaattcttctcaagctattacaaaacattgaagaggaggaaattcttccttactcattctatgaggccagcattaccctgacaccaaaactagacaagaacataaaaaaatccacaggcaactatcattgatgaacctagatgcaaaagttctccccaaaacactagcaaactgaatacaacaacatatcaaaaaataatacactatgatcaagtgggatttatcccaggcatgcaaggatgtttcaacatatgtaaatcaataaatgtgacatatcaatcaacaatatcaaggacaaaatccatataagtatctcaatagatgcagaaattaatttgataaaattgaatatcacttcataataaaaagtctcaacaaatttggcattaaaaaatactttaacataatgaaggtcataaatgacaaacccacacctgaaatcatattaaatgggcaaaagctgaaaccctttcctctaagaactgtaataagacaggatgcccactttcaccattgttattcaccattgtcccggaagtgccaacaagagcaattaggaatgagagagaaataaagagcattaaaattagaaaaaaggaagtcaaactgaccctctttgcagaagacataatcttatatatagaaaaacctaaagactccaccacaaaatctcttagagctgatgaacaaattcagtgaaattgtagaataaaaaaatcaacatacaaaatttagcattgtttccatacaccaataatgaactatttgaaaaagaaattaaaaatgcaatcccagtcacaatagcctcacaaaagaaatacataggaataaatttaaccaaggaggtgaaaaatctgcaaggaaaactacaaaacactgatgcaagacattgaagaggacagaaatgaagggaaagacatcccatggttatggagcagaagaattaatattatttcaatgactgtattaaaccattctgcattgctataaagaaatatctgagactgggtatttcataaagaaagtaggtttaattggctctcagttctgcaggctttagaggaagcatggtgctggcatctgcttggcttctaagaatgcctcagatagtttacagtcataacagaagacgaagagggaggaggcacatcacatgacaaaagcaggagcaacaaagagagagagagccagggaggggatgggtaggggacacacactttaaaataaccagatctcacaggaactcaccaactactgcaacaccagcagaaagtgatgagggatccacctccatgacccaaattcctccccccaggccacatctccagcactggggattgcaatttaacatgagatttgggcagggtcaaatattcaaactttatgaatgaccatgctattcaaagcaatctacagattcaaagaaatctctatcaaaagaccaatgatatttttcagagagataggaaaaacaattctgaatttatatggaatcacaaaagattctgaatagccaaagcaatcctaagtaaaaagaacaaagctggaagcatcatactctctgactttaaattatactatgtagctacagtaacttaaagcagcatggcattggtatgaaaacagacacatagaccaatggaacagaatagagaagaaagagatagattcacatattcacagctagctgatttttgatagagataccaaacgttagagaaagaatgctatcttcaataaatagcgcagggaaaactggatactcatatgaagaaaaataaaactagactcgtatctctcaccatatacaaaaatcaactcaaaattgattacagacttaagcataagaccccaagctataaaactactagaagaaaacagagtaaatgcctcaggacattggtataggcaaagatttttatgagtatgatctcaaaagcacaagaaacaaaaaacaaaaatagacaaatggaattgagttaaactaaggagcttctgcatagaaaaggaaacaattgacagagtgaacagataacctgcagaatgagaaaaaatgttttcacacaatgcatccaacagggaactaatatttaaaattttacaaggacctcaaacaactcaacaacaataaaaaatataaccccatcaaaaaaagtggacaaggggcatgaataggcatttttttcaaaagaagacatacaaatggccaagaaacgtatgaaaagctgctcaatgtcactaatcatcagagaaaggccaattaaaactgcaatgagatattatcttacattagttagaatggctaccattaaaaagacaaaaaataacagatattggcaaggatgcagagaaaagggaacccttatatgcttctggtaggaatgtaaactaggacaaactctatggaaaacagtatggagatttctcaaagaactaaaaatagaactacgattcaattcagcagtcccactactgggtatacagccaaaggaaaataaatcattatatcaaaaagatacatgtatttatatgtttatcacagcaccgttcacaatagcaaagatgtggaatccacctatcagtgaaggctggatcaagaaaatggtggtatatatacacaatggaatactagtcagccataaaaagaattaaatcaggtgttttgtagcaatgtggatggaactggaggtcattttccaacatgaaacaacccagacacagaaagacaaatacccacatgttctcagttacaagtgggagctaaataatgtgtacatatggacatagagtggagaaaaataaaaactggagacttaaaagggtgggggaggacatgggggggtaaataatgagaaattacttgtggttacaatgtctgttattggagtgatggatatactaaaatcccagatttcatcattatgccatatagacagtcacgtaacaaaattgcacttgtaacgcttaatttgatacaaattttttaaaagctaaaagagaattttaatgttcacaacacaaaaaagatatcttcaatattatgctaattaccctgattttatcactaacacaatgtatacatccattgaaatattactatgtattccataaatatgtacaattaatatgcgtcaactaaaaataaaagaacaaaagaactataaagtgtctgtgtataaaaacttaaacattaagtggaaaaatatccacagcaaacaaaaacacagggtcaacaggatcccttaccataatggatacagaatgcatgtaaattaagaaaaaagagaaggggccaggcgtggtggctcacgcctgtaatcccagcactttgggaggcccaggtgggcggatcacaaggtcaggagatcgagaccatccttgctaacacggtgaaaccccgtccctactaaaaatacaaaaaaattagccggccttggtggcgggcgtctgtagtcccagctactcgggaggctgaggcaggagaatggcgtgaacctgcgaggcggagcttgcagtgagccaagattgcgccactgcactccaggctgggcgacagtgcgagactccgtctcaaaaacaaacaaacaaacaaacaaaaacctaataggtaccaagatgatatagtaatttctatgaaacatcatgacttaaaaaattattttctttctgaatctatgtttgaggaaaaatatgcaaataagatcttctgaattagagctttatgagaatatggtcatctgctttcttgtggacattgtatagccctctatgtcttcactcaacaaatgtttattgatcaatatctaagtgccagtaactgttgtaattgttggaaatgagctggtcaacaagataggcaaagtttctccattatatactttgtattttaggaaagaaatttgaattaattaatatcaattagtgataagtgattttaagacaaaatatcccaaaatacataataaggaaaaacagcaagggctgttttggaggcagtggccagggaagtcttctctgaacagggatataaattaatgtgagtattttaggaaagagtatcaaaggcgaaaagaacagcagtgcaaaggcctgcgggcaggaaaatgcttaatatatttacacaaaagcaagatggacagttaaagagaataagggaaggccatgtaggtagaaatgaggtcacagaggtgattagaaaccagataatgtggcttctttacttgtttgttgttgaatttggaattgattctgagaattataggaagccattggaatatttgaaataagaaagttctaatcttattgatatcataaaaagcttactgtagataatatacactcaatggagcttggattcgggggaagaatggaagctaaggtatatttgggaagcagggactgatccaggaaagggaaataattagactgacctggagtggaaatggtgaatatactgagtaaagtttgtattcagggtatacgtggaaggcagagcctataatacatgctgatggactagatgtatggggtgagaataaaaagtttagtgaatgatttgtaaatttgtattcctatcaataaaatagaaataaaaattaaagaagacaagcaaatttactaaattatagaagaccagttacagattggaggatagatcacaatttctgtttaaatacattaaatttgagaagcttattggctaccagatatgtaacaagttgaaaatatgagtctctcttgaagcagaattattaatagtttcaataaaataaagtatggtttaaagaaaagcagtgttatcccatagtcctgtctaattttctggtaatagagctagaaaatggcagagcaaagatttttacctaagaagtgaggctccagaacccacacttcaaaccactatactatacttttgatatatgaaacatcgtcaagatttgttatcaatatttctaagctaaagttgattattttaggtaataaagctaaaacaatcttgtactctgacagtctacttaacaaacatcactgtcaattaaatttaatcatcacaaaccatgttttaagatctgggcaaaacagtttctattatctcaatgactttacaatccagtggactgttagtatatttcactctattgacagtaacatttgaagataaaatgttgtggcttatccttattttctacaagaaataaggagtacataatacagaaaaaacccagcatccttcaggtgacttgttcctctttcctgtgtctttccagcctactttgagtggtttcatgccattgctgacctctgtttacctcactaacctctggttattttcagctctcttttttttcaactgtatgtccaattctctctatggtttctgttttcctcattaagatattaacagattctgtgttctataaaagatacataggatatttctctatgtggttatctaacttgattgggagacaaaaggcaaagtaggtggcaaccagaaagtgagaataatattctgaagatatcatttacccataataataaaaaaactctagtaataatcaaatatcaaatgttaagaatactttgctccaaaacatgtaatattgagatatctttgtgctatgttactgggctagataaatattttagtttctaggtttttaaaaagatttttccacacaaaatcagtatgtagggttcatgataataattatagtttttaacagcattccttttgttatgccaaattgatttgtatgtcttttccagcatactaccagtgcccctaggaaggggactatgttacattttccactgaatggccggggctaatatgatggctggcacatactgatgtacttgatggtcagtaaacatttattggaaaaaactaagagaaacatattgaaaacacacgtttatctaagtacatacatatttctttttcccttttgtagataactgtattgaaatgaatattcattaaattatctaaacttttcattctttcctcaagccattctaatgtagctttcatgtcttcttgccactaggactgttatagtgaaattccagaaatcctattgtgctgttaaatacaaagcacagtttttgatcttcatcttattcaaatcatctacatacttaactaccaccttctaaaaaacttggtttctctctaaccttctacctctttctcctattcattatcaatctcctctgctggctccttctctttgtagcctctagtttggaatttatcatggcttagtattcaacttttttctttctccattctccccagaagcaatgtcatatattcaaaaaggctataaagatatcatatattgatgagtcccaaaatcatatctctacttcacacttctctgaaatacatttttatataaccaactgcttatttagaatcattatttaaatatctcatgggtaccttaaacataacatgtacagtactgaactgctgattcagtctctccattctaacatgttcctccaaccacctgtcccatcacaggaaatttattatcattactctattgctgaagtcctccctgatttttcattatcttctatctcacacatctactcaatacaatgtcttgctaatttttctttcataacacatttcaaatccagccttttctctgaatttgctttgccacaaatatcaaaccatcattatcttttacataataattgttagagcctagctggtttcttcactcccacttttaacctccttctagatctttctttatggaagaataggaatattttaagaacctgaataagatcacatcatttcccttttgaaaaaacttgttagtatatatgtcaattgcacttgaataaaattcaaactaattactatttttctgactctcaacctaacctgaccctgtttacttctacaggcacttctgtacttttgcccccaccatagttactgtgctcaactcccattatccactctttactgtcccatacaggacaagatcttttcctcctcatgacccttgtttatgctgatacatctgacagcacatccataccctcactcttcctttggattatttctttttatcacacgggttataacttaaaggtcccttccttagagaaaacttttctactatctacattatttttctatcacagtaactttttcttttccttctgactactatagtttgaattatattttatttttctattgccttgatttatatgtcattcctggtacattgtaaatgtcactaggtagaagcctatctccattccatcctgcattgtattcagcacactatttgtatgctgctaaccaattagtgtttgttgaatgaatataaaattatatttacaaaattgcctctataaattaggttaaagagttgagcaagcaaaatgtaagtatttttacccataactcgtttaattaaaatttgaaacacaggatggccctttagatgcctttatattacaagaaaaacaaccaaccaaatatgagagttcaataggcaccagtcttgagctacaagagtcatcaaccttactctgagaaataagggccacatcatgtgaacagtctgtcttgaaaccagagatgacagatgaaatggaagtgcaattagcactattacactctttctctttgtcctctacacttaagaaacattttccccttttcccaaggtctatcattaagaaatgcttaatgctgctgaagatgagctcaaaagaattggtaaattatttgaaaatttagcaatttgaaaactaagtaagctcaaagccatttaccactatcccatttaaacatgcatcaagaaacattttcccccttttccgagatctttcattaagaaatgtttaatgctgccaaacaggagctcaaaataagtggtaaattatttgaaaatttagcaattggaaaacaaagtaatctcaaagccatttacaaccaccctacctaaacatgtgtcaggtagctcctaggctttagggactaataaaaacagagccctgggtgagtttttctggttgcttagcaagtcactagaggaaaaatgcaagctggtagaagaataggtcctattgcctcttgtgttgggtggacttcctgaggagctatacaaggctaggacattagaatatgtaatatcatggatgctaatcttccacaagatagtgcctccaggttcaaacactgccctacctggtagctctggccctttttgggataactattttaaaccaggaaagatttataggaaaaaaagtgcttacaggacaaaataattagccccatttagcttttctttttcttctgtttcctcctcttcccccacttctactccatcctccttctcttctttcttatcctactgctgctcctcttcctttttcttcttcatttcaagagcataatcccacagagattttgtttccctgagactgatacataatgagttgaagcggaaagagtgaaattagagatcaggagaccccaaagtgcctggaaaacctctgttgcctcccaagagcacacagaacttcgcccttcttgaaaaaatccattagacaggaaatcattcagaattttagaggagtctggtgaagtctctcttagatttccaaaccctgcaggctgtttatcaaaatcttatacagcctcatacaaaccctgtgatctacaaagatgttatctaagactccagaaaggaaagccctttcatgtagttttctatatgtgatagggctcacagaagtagatggtcatcattcaaactggttctgtggaggtgagtcagtggtcagatctgaagaagtaagtgtgatctatgcatgtcttccgaacagagtctatcttaatggattatatagatagtactacagatcacatgaattatccctctgcttaggctgtgtatactactaaagtaaatgaatacctgtgtgtgtgtgtgtgtgtgtgtgtgtgtgtgtgtgtgtgtgttctctgcctgaagcatctaccaaaaaggtggccaagctctcaagaatatatataatgctggtattcttttcttcccttatgacaacttgacaacacacaacaggaattctcattcccctaatctgcattatttctctctttttttatttttgggtggaacatgttccatcaaatttatgtgcttcgctctctgtatctctgtctctttctcttggtttagaataattcatctataatggctcctgagagtcattgcctgggacactgcaacgtaacattgttttatttattttcctaggttatccacaatatcctgtcatgaaagtttaaaatgtcttttcctaggggaggatgataatcatgttttctgtctgataacctaacaatgtatggcccaaacttttcaaaacattttcaagtatgtcagtcaattaattgttaattcaaatcagttttcatctttctcaaggttaaagaggagaataaaatcaaagaccatgaataaaactatgggtccataattttataaatttgtatgaagtctgaagaacatcaagaatttgtgaaattttccacagagtagaagcacacaagctccatctaagttttatggggtgacaacaatataaacatgaaatagtcacttcttctctggtgtctgataattggtagtgaaaactttaaggataattttctttttccttattgaatttggctaccagaacttcaggggatttgcttcaatggcaatgcttctgaaagcacaagttcattgatttgctgtataattttaatctgcagggagatcttctagcagactaaagaatgcaggaataaggatcttaaggaatgcactgaatctcacttttgtttctagtctatccaaaagaaggtgcaataagaagggaaatggaaagcatagctcaggggagaagtcaaggttaatactagagacagatgcgcaggcaacaaatattgctgcagaaagttgatgaggcaagaggtcaagatgcattgttttagaggcaaggtctcaaaagcacattgactatgtatcaaacatatgccagagttatctttcaaaataaaagtctgaccaggtgattcctcagttcaaaaagtcatgactggcttaccactcttcttgaaaacagtaaaacaatttaatctagcacacaatatcaccagctatttcttattgaatattgatttttcttattgaaaacatggtgagaaacttacttaggttacccccaaattttaaatatatgggattttctcgacttttcacaatgattaagtttaattacatgtcaattattttcgatatccatgatcctaatataagaagtgccaatggccttcttatacactaactacatttgtagatattgagttttaaaagcaaaaaaagtttgaatgttaaagttatatgcctgactacggccaagttcatattggaaataccattgtttttaatttaaatttaagtactttgtatttaactccaaatagcaaaatcaagaaattactctgtgtcagtcatcatatcagaacaatttaataacgcataattactacaggtgcaaattatcagtgtgactaatatatatagttatatataacataactaaaactctgtggtcctactgtcaatagcatcctctgaattttttttttctaaattctcacctaattgaaatcaaataccttaaagatttccctgagaccactgtttatgactcaccagtcctagaaactgatatctgatacagaaccctgagtatgtacaagtaaaagagccatgaaacatttcagaagtcaaattgtttgatctttcctactattttggtaagaatacatggaattagcagacactataggtaaattcgtgggtcatcgatgtgaggatcccaatactcaactgatttttgagaactggcaagtagaaatttaaaactttctttttcttaccaccaaatatctataacatttagggaagcttttcttaagtcacagaatgttcaactgactgctcataagaaaagacatttatttcatgaaacatcttacgttcctccattggaaataatgtcctcattctctgaatctgtataatgttatgtgtttacattttatgctgcttacccatttcttttctgtgttataattgttgttttgcatgttgtatctcttctctacgaatctgagtttcttaggataaaaaaaatcttaaatagttgttagaatctaagttcaacaatatacacatattaagtgctaaaatatgtgtcataaaggatatattaaaaaataacataacctcacatctttccattcacactccttgaaagtaacttgcaagctttcctacctgttctccctagaacaatgtctccttgtattcaagaagacttgctacacttgacctcctatatagactattacttgagccaatctgagcaaacaaatttggactgcatacctttattttgccatccatagcatcttgtttttatacctctatcaacacatattagttaatatattatcatttgtttacccatttctcccttggagtattattctataccaacccaaacagccacagttgtcacacaccaatgaatacactgatcattttatacttatctttaactaatttatcattagaaacattaagttggcatcttcattttagaacattaagaacaatgtcttctgaacactttcaagcctctctcattttctacaacatactgtggcaatacatattttctttctcctttcagattgaagtgagtcagccttatagtcagaaagtctttgaagctagtcttcaaactctgggaatgtgcacacagccttctccttacttgggaattcaagtgcaaatgacatgaaaacagttacagaaagtaaggcaaaaccaaatcaaacactatcatacaaggacaccatctaacatccaaaatatatcaaaagcagcaagcaagatatgctgtgttgtacgtcagtatccctgagctgcatggagagcaacaaccaacaggtcttccttcctacgcattaactcttttcttagtttcatttatttttaattaaggggggaaaagcttaaagcaggtggtttctgtatgaataaaaaaaaagactcctaagccaaaagagaagtataaaaccctgccgtttctcagtggcaatgccagaaaaagcagagaaacagagattggtttttatcataaaaaacgcaatagatgcaagttatattttctcccactgccttgccagaatttaattatttctagaataagctagcaggtgtaaaatgcacagttccatttgttatcatgtaagaaccatgtgaagaaaagaagttttggttaaaaaaaaaaaagaaaaaattgaaggcactaagtcttagtctgttcaggctactgcaaaaaaagataccataaactggttgacttataaataacagaaatttatttctcatagatcaggaggctgggaagtacaagttgagggatgtttagtgtcggctttctcacagatggtgccttctaactatgtcctcataggctggaagggactatctagttatctgcagcttttttataagagcactcatcccaatcatgagtacttcaccctcatgactgaatcacctcccaaaagccctacattctaataccatagtcttaggggttagaacttcaacatttggatttgggtgagggagatacaaacactcaggccataacagaatagataagctaatctttatataagttaatgtattctgtgctcaccaaaagaaatctgagtatggctcagagtgaaaagatctagaactgtattttggttgcagagtgaaaactttctgacgtagtgctcatggatatagggtttgtattcactggacaaactacattctaacatttgctatctatgaataagcgaccaacatctctgagcctgtttcctcatcatcaccataggaataaataatgattcttacatcacaaaattgttttaatcattcaatagggtaaagtatccaagacatttagcctggcaaatagttaggcttccttcataaataataacgttttaatggaagcttatggctcaagtgatattttaaatcactctaaatattattgtagaaaacaatgcattatatctttagcagtgtatgatattgcattcaacagactgttccacaaaattcttgtgcttagttgtgattaacaccacaataattgtaatccattcatgttttcgttcatgtataataatcaacaaaattttatttagaatctactatgttgtatctgcctggagaacagaagtaggtaatatgtgcacagttcctgttttatggaacttattgaagaggagaaaagcagaccagagagggagaagggaatagagaagaagaggaagggaggtgagagtagttggtcaaataataaatatatagccacaaaaataattgatgaattacaattttagtaattgctatgaagacaaattataaaatgctgcctaatttcttgtgcgaatgcaaaatggtacaaatattttagaaaacagttgggcagtttctaagtaaacatactgttactgtataatccagtgagtgtgtgcctcgatgtatagcaaacgaattgaaaacatgttcacacaaaaaactccacaagaatattgataacagccttattcatgattgccaaaacttgaaaacaatcaagaaaaactttagtaggttgaacggataaaccatggtacatctggacaatggaacattattcagccctgacaggggctctcatgccatgaaaaaatcctggaaggatattaaatccccattattaagtgaaagaagccaatctaaaagggctatatactgtattacttcaactatatggcatccttacaaatgcaaaactatgaagaccctgaaaagatcaatgattgccagagatggaggggacagaggaattcacaggaggatcacagaggatttttagggcattgttactattctgtatctataatggtggttacatgtcattatgcatttgttcagacccaaagaatgtacaagaccaagagtgaactctaatgtgaactacagactttgggtgataatgatgtaatatagatttattgattgtaacaaatgtaccactctgtcatgggatgttgatagtgagggagcctgtgcatgtgtgtagggatgggtatatgagaactctctgtattttctgctcactttttctgtgtacctaaagctcttccagaaaatagtttaagaaaaaaagagttacctaagcacatgttgtggcagtattatgaggtttacctgaaaaagagggacatatgctaaaacctgaaagatgagtagaattgggatagtgggcaggaaggattggagatcattctagttaaagtgtagcatgtgcaaagacacacagccagaattttgaagggaatatttgagcaactgaaggctaaatagggggctacagtacagggttagaagatcaggaggaagtgaggctagagaagttatcaggaaggggtcaaactgcacacagccttgtagactacggcaaagttgtaggacttcggaatggattttggaatccaatctgtttttattttagagagtagcttaataatatctttgtacagacattgtggctcatgcctataatcccagcattttgggaggctgaagcaggacgggtgcttgaggccaggagttccagacaagcctggcaacatagtgagacctcatctctacaaaaaatattataaaaagttagctggttgtgggaacacatgtctgtacttccagctacttggtaggttgaggcaggagaaccatctgagcccagaagtttgacgctgcagtgagctatcatcatgtcactgccctccagcctgggcagcagagaaagagcttgtctaaatatatatatttagttatataatatattaactatatatagacaataatatagttatttatcttaaaaataaatggatattgcatttagttatctatcttaaaaataaatggataacatttatggcatagaggaaagaacactgatctaccattctgtaagtatgggcatttaaaattctgtgcccaactctccaatgggttaacaatgttatcttcaatatagccaagcttttaattcatccacatgttcatgctgtaagtgaagaaacaggctcagagaattttccatctaattgaagtctaaaatgttaagccattacttttttgagtcaatatatgacattaaatatattctaggtttctaccaaatacattcttccaccagccacattaagcaaaaatctgatgcataaagatgaaaggtgggcattcattatctttaatatctacataggtctatgaggtggtcattattttaccatactccatttaccaataaaaactgctgttgtaagaatttttttttttttttttttttttgagtctcactctgtcgcccaggctggagtgcagtggcaagatctcggctcactgccagctccaaatccccggttcaagcgatccttgtgcattggcctctccagtagttgggattactgacagccactaccaagcctggctaatttttgtatttttagtagaaacggggtttcaccatgttggccaggctgatctcaaacttctgacctcaagtgatccaccagccttggctccccaaagtgctggggttacaggcatgagccactgcaacaagcaagttgtaagacatttagattgtacatcacagctgtgccataataaaatgtaaggcaacttattttaaatattctacttctgaaaatattaaactacatttttcattatacattatacttatttaatacagaaaacttcctcttttcattaatatttatgtctttattctagtttgcaccatctcctcccccaaaaccctcacatatcttgcattacaaaatactgtcactgtgttgcttagaaatgctcagaacacacatccctccatctttttcccccccatagcactcattgctgcccataaacaaattaacaaataaataaacacaataattttgtttcttcccccatgcatcctctgctttttaggtggtagatttcataaaagctaggatcttggctctctgttaccagagcctaattgatctggggagaggaaaatacattttttgtgttttttttgttgtttgtggtaaaacttgtcctgagaagcagatcgagccttatttcttatggctattttatatttagcattctcattagcagtactgagcaaaccctcagggtggacttccactatgtggtgcagattaagtttcagcgcttttagagatacctttctaatccttaggaggaagccattatcttttgtccattgagaaatctttcctaacgactactttactcagagttcgccaattgctttattattttttaatattactaccaaataagcgtcctagctaatgcttttatttccctcatcatacagttttcttcattttgtacccaatgctgacttccttattatcccacacattatttgtctcttccatacagctgaatgttctctttggataacaaactgaaactaattgatttttatattattttaaggatctgcaaaaaatggtgctcaacatatattagagaaaactatcaaatttcacccgaataagagcattattgatttttttagtgcattgcaagaggatgtgagcctgtactcttttccttaatttgaatgtaagactagtgtatatgtatttctttataagttttccaaatacattgttttagtgagtatccaaaagatgtgttttgactgatctaaaatacaaattacttgaattcaaataaggataaatgtcaaaaccacaaaaatatctacttaaaagagcattacgagtttgtctaaaatggcatctttgctttatttcctattaggagataataaatattttttaatagaacaagtcatctcaaacacagaaaacacttggtaaatatttattaataatattgatgactttatcacatgagaaaataaagaccagaaacatagacatacatcaaaatgtttgtctgtcttgctatactggtgtcttctgtgttaggtttattttgaagatgacatttaaaaactgaacaccacaaataggctgtccttctgtagaactcagaacccttttttctcagaaaatagtttctccattttttcttcattttaatacaaatacagcttccacactatataaacatctgtgttttaatttaagggctgtaattaacactttcatcgactctatcatttacaaaacacaataagcctgaccaatagacactcatcggttaatgcatggagatcaatcttgtttggcagaatttcatttactgaggaagaaatgagcagttctgatcaaatgaaaaagagaatgatcatttttcttgaattcttaagcaagtttaggacattcaaaaattgtattctgtcatttaaattcttttacagaacatttgaatttcaaaatgatgtaagtactttaatcttgtttggaatcacttttgtaattggatctgcttaaacaaataatattcactaattatcagcttgtcagagattgtcatagctctaaacattaagaaaaacctgagagttcagacttttaatgttatcttcaaaaaattaattctcagaaataaagaaaaaaacagcttcccatctccctacccagcagggactatttacctcccacatcactcttcatcattaaacaagaataactgtagtaatattaatcctatctaatcctgtaaatatgtagctgaattaacatttttatatgatgacctaattagtgaaacttttaaagtagcttaaataaaaggaatctgggaaaaaagtgccatttttctgaagatctctgagaagaaagatattagagggaagttcaggtgaacataaaaggatttaatgtgaagagaattgctacaaattgttaggtaaaagccttattgctttgaattgtgctttgttgtttcatgttcaattaaaaattcaatacaaacatatttcaattatttgaattatttgaatgttctttacacagattgcatgtgctactgtatcagctggtgtagttagagtacacatgcaagacaatttttaatttttaattttttacatgttaatggagaatctgattgccaaattaatgacttttgaacaatcccataaagccttctagtaactctgaaaaacaagacaaccattcaagttgagatacctgagaagcctaattagaacaacaaaatcctttttttaaaagacacattgaattacatgaatgaaagaaaatccattcatgttttcttaataaatatattcataggtcctttcattctaaaacaatcacaaaattctgggttttggtctggtgtgtagagaatttggaagtcatcattcccatctacacaataagagaaaagctgaacaaactaaaaatcaactcttcttagatttttaagaaaattgagatcatttcccactaaaggaaaacttctgcccccaaacattggagagacagtcaggcaggtacaaagaattatagcttaccagagcagaaattcagaagcagaaacctctgctggagccaaaaccagggtagaaaaacaaactgtaattgatgaaatgctggaggctcagtgtgtacgagcttgagagttagttagaaactacaggggagcccactcttagggaatatcccacactgtaatgaactttatgttcaaaaatgctacagggttctcacagtgaggtttggagaaaaatcccctcatgcttccagcatggagaggagagaatagccattttgaagactcccagagcattctgttcctcttaacaaggcttgtcctcaagtgaaactattttaccagagcttagttgacctgcaggaagggaaatacccaactccagccctgtgtagattttctgtctcacctaagggaatggggtacagagaagcacattcgaaggtcacagaccagaggcacagaatcaccaagactgagacctaattataggactgttaaaggcttaccctctccctacaccttactgccatatcaacagggatcttttataacaacaggagattacaactgaaagaactccacacctcacacttctttaagaagaattttctaatgaaaccaaaatacaacaggcaagatgaaaataaaaatataagacgaaattttgacctctgacacctatggctgtagcatagcaaacacagcctgactcctagccagataaacataaaatgttatgctacaggcctatttatctgagttccttttacgcaatgcatcatgtgtttaaatataaaattacaagacacactaaaagccaaaaaaatagaagagacagagtaagcattgaagtcagactcaggtatgacagggagtctgtaattatcagactgggaatttaaaacaactgtgactaatatgctatgagcagtaataaaacaaccttaacaatgatgaccaaaatgaaaacacgtatacagatgctcctcgacttatgatggggttacattacgataaacccatcaaaagttgaaaatattgtaagtggaaaatgcatttaatacacctaatctactgaacatcatagtttggcctagcctaccttaaatttgtccagtacacttacattagccaacagcttgggcaaaatcattcaaccccacacccattttatattacagcgttgaatagatcatgtaacttattgaatgctgtgctaaaagtaaaaagcagaagggttgtagggatgttcaaaataccatttctactgaacgtatgtcactctcgtacaatcataaaatcgaataattgtaaattagtgaccgcctatactgtgctctgtgctcttaggaatactgcaacgtccagtgttgtcttcgtccttcaggagtttacagtgtttcagagttgacagagaaatgagcaaacgttccaacagaatgtgataactgatgcaatgtttagtctcttcccatctattctagtgctagaatgccatgacttaccccctgtacattgtcaactctccattatggacactgttttcatgttcacctacactctatgtacacacttcatttttagtactaatgcaaatcaatttaccttttttctaattcttataactgctttattcttaagactctctcaagtttgatatcttcctgtgaatgaagtacccatgaagtttcacatttccccatggttgtgatttttattcttttaatatcccatttgcactaaagattagtgggggagggaaaaataaacctaaaaagtgattttctaatgtttttatgcattttccatacctgtatccatttcaatattttatttcaatatttacaaatttaacgtgctacaaatattttatcaaatattttgaatatttgattttctgataattcagcagattattttattttctgttccaattaataatttgcgtgttattttcaaaagtatatttcttaggaatatctaatttagagtaaatacatactgctatagcattggcatgaataacatttcaatgttaaaattctttttcaataaactgaatttcccctatctttagctactcattttaaagaataactaatgcattagcaaaagttgaatctcccttatctcattgtagcatttcacacaaacattatctcttgctatgacaagtttttaaattttgtttcagctttcaagtacttagagaatggttgcaaaactatccatttgaaattaatttagtaaatgccttactaaaatgtaaatgcattatgtctataacattttcttctatttagtagacatgtggtcttataaaactatattttccaagatgtttctatttctaacatatactaatgtatttatccttcagatttgatttttttattaaagaaagagctcaaatattaatagattcatatttcacatgtgaaagaacatataccaggagattaactatttcaggaaattttatagatatttggtagtaaattatttgtttttatgaaaacatatcatatgtaaaataagcattgattttctaagttatttagattcctacgtatctaaggctgcactggcagaagacatagttaaataaaagacacatctcagtattttgctctttatactgactcttcgaggaagacattattggtataatctgaggtgtcagaaaaataacttcttggtaccaactaacttccaatttaagtatcagagcatctgatatttttctccaaagatctatcgcttttgtagcagtaagagaaaatctttttcctagggcaaatccaaaattagagaattctcagagaaaggaagatatctgtttgagctcattcatatccctccaaaacagatgagccctgggaatatcctttaagagggaacagcattggacttaagcccaggtccttctacaattgatttttcaaaatcttgtgttccgtgacagttattgattatttttttctatgtaattccttaacctcgtctagagactcttggttctggtttttcctttctgatctttcacttctgagaaggagtttctagctccatttacacttcccttcacacttgttcatcttttatacacactggccagatgcttgaagtatgattctttattctggcactgactctagtcacctgactataccccatctctaattatttagccttaatttcagtgaaggctggtctaataatgatatttataaatatacatttaaaatttctgataacacattcttaccaattgctgttttttcactatattcatgggctgcggtcagttttaataaaagactgtggtcaaatgctattttttaatagagacatttttaccaaggaaagtcatttctagtgctaatggagttcaggccagttcaaacttgctgaggaagcagatccgtcctcctcggacatacaatatgctgagcccaaccctggaagtagtactatgtccttgggcaaaataaaagttccgccaagaccctgacggtattaagtaattcctccactggcatcctccttccaaatgcattaagacattaaaggccaatacattaagtcacttgcaccttggtgtggatcagtttatcagaatgtttttcttctgaaagaaaggactgagggtgcaagtgatgcacggacaacaagggaaagaggaatgccgagaaaagtgtagcgtgcacagagaaggagagatgcgctgaagattaactactccgaccttatttttcaccatataattttctactatttactgtgtatcaaagagaataaaaaattattacaaccacaaccaccagtaatctttaccataaatccaggtgtgcataaacatgtcgagccaggttcattctccatgcagagttcatgaacacatgagttgggaatgcactcaagctcattctcacagtggtgtccagaccatcctgttcaacaaaattacaaagcagatatgcaatttttaatgataataaaaacagttatgctaatagcctatatttattggcttttactatttgaaataattatgctagatgttttgtacaaattacctcagtgtatcttcatgatcagtttatcaggtagctcttattctatctctatttagttcaagagaaaattaaactcagagaaaataaataatttgctctaaaatcacctagttaagtataaatgaaagtgagtacatgtatgatatgtctcagctcttatccgtggtgccatttaacattacatattcaaatgtctttacttattttactttggaataaatacatggaaagcaatagaataaagacacttaataattcccttaatatgaatcttaaattcagaggaaagcacctactatagatctctagatatacaatgttatttgtgatacttgtagtattacagttagtattttacatttagtatttgttatactgtgattctatagaatataagtattgtgtctacgtacatttggccattggctgtaagaattctcattaaacatgacaatctaaaattttccagaccaaaacacagtttgattgtatgtattttgtttggcttttgctagtcaaacattttattatttccatcatcaacctatcaaccaacattgctaagtattccataagctaatatctcagctatgctttactgggtagatattaggaacatttttttgaaaccattgattctttcccatcagataattacttctaatgaatcttaatatgcctaacatgctagccacaacatcatgttaacctaagtatacccttccacatagggacaatgggtctttacaggcagctctcactgctcactgactatgcttactctaatcacaactttttaacttttctttatttttctatgtattgtccaatagcatttaatctgaaccctggctgttgggaaatgtaaaatttaattattgtttatacttaggaagatattctgattgttcttccctgataaattgtaacaaaacaattaaatacatattttgaggtacttagaaatgatttattgaaacacttcattataagaaacaaatagggcctgagtctaaaagacatggcaatgtccacatcaaacttagaaatagcggccaagagactaaatttatcaaatcttcatccaagactctttccactttgcaatgctctttcatgtgctgggctgattctgcagagatctctactgaagaggctgtaaaaggtgatatggaaaaaaacatcttcacagggtttataaaaagccaatatgactttgttgagtctcacaaacatagttgagtctcacaaacatattattgagcataaaaacatattgcataaaaatacaccctgataaatgctcttataaaattcgaatgcatatgaaacttagtaacattgcttagagatgcatacatatataataaaactctaacaaatactaaaggaatgctgatataaaattcagaatagttacttcagggagtgggatgtccctggagggatatagaggtggcgagaattattgctaatattctatttctcagaacacatggtagttatacacatttattacagtgtattttgtattttttatatattgtatcctcttctgatcgaatatttcaaaatataatttaagcaattaaaatgacatagttttcctttgcttctcatactgtgaagaacatgataaagctttaaaccataagatgggaagtgtaaaagaaaaattgcactgggccagttatacagacaaagaagacttcattcaagagtactgcataggagacagatttttacaatagagtagagagcttgtactcaaccccactaaaataaatgggagcaggaacatttttaaaggccaggtgagctaacagaaaagtaccagggggatgtttgggtgggtgggaatttggtcaatttcaataggccacctgtacttgctgtctcttactgaagttaggcttctactctcccaaagagactgggaaataggggcactatttgtctcgttccagggttacatttgttttgttttgtctttcattgttgttgtttttgctgttttgttttgttttgtttttgagacagggtcttgcactggtgcccaggctggagtgcaggggtatgatcacacatcactgcagcctcaacctcctgggttcaagcaatcctctcacctcagcccccggagtacaggattacatttttgaaggaatgactcccaggtccttgggaaacagcctgagagaagatttacatctcaaagagacagagaaataatttacaactacaagttttctaaagtaaatgctctacgaaaagggagatcaggccctatagtcaggaagaagtctgtctaaagcctagtcaaactgagaaaaacattaaggctgtgttggtcaaagacaacaaacaaggatagaaaataaattagtcaagattcattacaagaaacagaaatcactctagttatttaagcaaaacggacctgaataatggaattagatgcttacaaaattatcagaaggaaggaaagctgtaggagtaacaccaagaaccacaggtatgactttctggaagatgtcccctcagtcaggatcaggaagatgagaaatataaaagcactcttaggatttttgagttcaagagcccattgtgctaatccaaggaaggttgaccaccaggcagctgccgtttcaatgcacctacgcactgaaatagtgactctacagtgagatctgctgcaaagatccacatagctccatgacttttttttaccagaagaatctgctaagacacccagaaatggtctccatcagagccttcagattttaggtatgtttcttactggtggaactcaattatatttgcaactccagttttgaaggattctggaagttgtagttttcaatactcttgcctctgcagtacaggaaaccacactacatgggagtggatactgagtgtcaatcatacccattagtatgaagaaacacgtaagatgaataggtgcttattctggtgtgggacaaggtaatgggtaagaaatgagaccagaataagaaaacataaatcaggcaaataaatatttattggattttttaatgttcagaaatgaaatatattttcttttgaatcttatgtaggttttatgttcattcttaataaggtaaccaaatattcagaaaatagtttggtaactgaaaacaaaaaccaaaaattgtcattagcaatctaggaaaagtaatcaaattattatggtgttaaactaatagtattaacctaatgtctgacacataatataaagtaagtaagtgcataaggaataaatgatttaaaataattgtggtgcaaaataaagacaactttaggtgacacattgcaataaaattggagtaaatttttactaatttttttttaaagacaatcttgctctgtcacccaggctggagtgtagtggcatgatcacagttcactgcaaccttaaactcctgggctcaagggagccaacccacccagcctaaaactagagtgatcttaagttgaagactaaaccaaatctttaaatacattgatatattcagctagaaatattgaccagttttaatattaccattctataacataagttataatactttgagtttatgaatgaaaataaatgtcactacttctaagatttatatattttattttcatttcattttccctctctgcccatagtgatttctatctgatgttatgaatataaaataaaaataaacctaaacctaaaataattttgtctaactagttaatacattatttagtaattggataacataaaattattttctcttcttagtctaactctagaatatgtaaaaaaattttacatgtacaccctcatgaaaatacaatagtatacactcttttatctcataataaggatttctttacttttcatggatcttgatttaaaaaaagattattctgtatctcttttgttctaaatgcagccacctcatcatcgacaataattgtggctactggtggcagatattatctatgtttgtttctctgttttcttgccccaaggatagtgcagcatttctgctacaaaatgaacaatactactttaagggcaaaacatgcatttgaagtttgcatcaccagcaatataacaccattgcacccctgctgggtataaaaagtatctgggcacagtgactgtcccagggattgagaacaactctgagtgaatttgtggtacacaaactgttccctatcactttcaatttgctcttcatgggatagctctgatcacttactgggtgttctacattgttagataacactatacatggtactatttcggctaaaaacacactaagtgtgtttctatttctataaaaaacatctgaatacctatattgatacttcattggaaatgagctcaaaaacccatttaattccctatataggtacaggatgaactctgtgattaggactgtcctaaatgatgttcaggatgtttcttgcacaaagaattcatgcaaagaggatgagtgaggtctgaaatctaacctgagctccacttgtcaagtcttataccttgttggcttggaggaagtggcatatttatataatttttctgcctagagatggtggagggctttatgcttaccatggccctgtcatgactggacaacattggccatcataaatgaattgtactttttcaatatgtgctgaacactccccaaggactgattatgatacaaactctctactaggatttggtgatacaaaaataaacaacatttacaatgtcttctaacccacttatatccaggttaaatttcagtgtgttttgcagactgtctggtggggaaaacagtatttagtttttcaaactgtgctctgttcagaatgttgcaggattcacacagctctgtttgtactaaaatgaagagggaagggagaaaagagataaaaccttttggcatagaggtggagttacccaggatgacaaccatggagttgttgttagataaagacaagagtattttgataattagcaacataatatgaatgtaagaaagatttccacaactgaagaaaatggcaatgatttatagtgtttagccaatttaaagacagaggaatacttgtgtagttttctacctggagctgtgtaagataagataatggcatgactgagatcaaagcctaggaaaaaattttcaaaattatttgaggctttttaaaaatcaatgacagagaagtggacatgtgtaaatgaaatgaatcagtctttgtgtttttctatggcatttaggagaaagcaaattgctgtgaattactcagaagagtgaaaagttttatatttttctaatggaatcttttaaagagaaaaacagattgggtaggagacttcctgagaattctcacagtgtttagaattgctaacatctagactaagctgaaccacactgattgattttattggggaaggcctttgttttttaatgattggtcaattcaattttttactgtagtaagcacatttaacatgagctctcaccatttaacacgtttaactgtgtaatacattactattaactataggcatgatattgtacagatctctagaatgtattcatcttgcatgactgaaactttatgaggagtttctcttcaccaagataacattttgggggaatatgagaaatgatgaatgcacaagtgtcagtgcagacttcttaggtgtgaatcttagctttgccactaacatgttgtgggacattacccagtggttctgggactctgtttccttattagaaaaattaggtaaaatgagatgcccttttctcgatgctatgaaaacttaattagttaatacatctaaaataacatggtgtctatgcagtaatactgatattattattattttctaagcacatacatgccaaagaactcacacatttgatcttcgaaatataaaattcatatacacgagacagaggtgctgaaaaaaggtagaattttcaataaaaattatagagaaaaattagtattctatcaaaatcagttccttttgggggtaaagagttaattacaaagggacagcatgagaaaattttggaggatggtggttaattgccttactgtgagggtggttacacaactttatgcatttaccaaagctataaaattgtacacaagagagttaattttactgtgggaataaaaataccctgaaaccgtggcaaactatgcccattaagaaaatgagaaagggatgaagagtaatctgcaggagcaagattattccttaaataactttaaagggaggatggattggcatgattaagagctatggctggagcagagacaggagtgttggggacgtgtcaatagcattttccaaaaatttgactttttcatttgtcacttagttttcactcccatgactaagttgtgaagagtgtaagtaactctaaagtcaaaggtatcagcagattttgaataacgcctagcaatacaggtggtatcattttgagatcttctgcttcccaatagtgatctgaaaagcagcctgaacaattcaacagcttaaaaatgtcctcatgcttacaagtgaatccagagtagtggaatcaacctacagcaacaaaactaatctagcacctgtaagatgtttattaacatgaaacagaaaatgaatctagtagttacaagatacctattgttatgataaacaaaatttatatgggtattttacttaactgtttctgtagaatttattgtttatgctagctaccatagagtatgaagtgtttgtgggcacaataaagatattttttgcttgaaagaggcaaaatgtttgaaatggtattcatttcttatataagaaaactgtaattttattctacttatgttacctgcaagagttcccattttatgtacggctggctatttcaaaagggaagtacaaagttctccagatgttctacgtgaccaaataaaacctagtactagtaatgaatgttcaaaaaacagagtaggtctctgagtgatgtttaacttctaaatagtatgtgggtgacactcagttgataggtattcactagtttgtatgacttcacataaatcatattagtcctaatactctcatggctattatttccgtggtgggcccaataaccagaagcccagaaccctagggtttccataggctttctgaagtcttctgtgaggtaggtaaatagggactattttttttctaagagatcaagtcctgctatgtttcccaagctggagttcagtggctatccacagatacaatcaaagcatgtatcagcctccatctcctgggctcaagtaatcctctcgcctcaatatagttggaactataggcatgctactatcatgactggctcaataactttttttaagtgaccagaaatatcccctacatatattcctgagaaattactgctgctcaaggaaatttaggcattgaacatccgttttgggttaactgaatgttgaaaataagatgagtggcagaagatgtaggaaaagagcaaaaatctgaagttagagaactaaagaaaaaagaaggaaaaaaatgcatgatcaacaatcacttatatcaatatagacctaaaaggaatatgatcaaaggtagagatggccaaaaagaccaatttttaatgagcagttttcttaatccattcaagactgctataacaaaaataccataaactggatagcttacagaaaacagaaatttatttctcacagttctggaagctgcagggtacaagaacaagttgatgacagatcctgtgtctgtggagagcctgcttcttggttcttagatgttgccttctggctgtgtcctcacattgtggaagggccagctagctctctagggtctactttataaaagtgctaatcccattcgcaagggctttactctcatgacctaatcatcttccaaagtcccacctcttaatactatactatcgtattgttgattagggttcaacacatgaatttcagggagacacaaatatttagacaatagcagcaattattccttgaagaaaacaagtttattcagctcgtccatctctgtgctgacaattgtgggaagaaataataatgtcaatactaataagagctaacattgataaagtacttgctgtgtgccaggcataattgatacaaagatcagaagtatgaggcttacatatgtttagaaaatccatcaataaggtattacactctaaacattaagatttcctgatgaaagcctaagtgcttgctttctagtatcatacaacattcatttcatgtttttaaagaatgatcattgcttaaaacttgattagtagtcaacaatagtattggtggagtggattgtcaaaattgtattatacatacatgtccatatacatttacataaacgtatatattattatatatgcagtatgcttattatttttaaaataattacctggttggcatttgcaaacatatccattgatgtgatcttcacagtctgcaccatgtagacatggtgatgaagagcattcatttatattaatttcacaaaattgaccagaaaatccaggaagacatctaaggaaaaaaaatgaaaacgatatttgtatatattatacacatgagcactatcacttttcatcttgggattccatcattcaaacgtgttttcagagctccaacaacatgtagctgggagccttccttggggtgacaatgagttgaattgtggccccaaaacagtatgtctaatacttaacactaaatatctgtgaatgtgaatttatttggaaatagagtctctgcagatttaattaagtatcttgagatgaggtcattctggattaactcggtgggctctaaatccagtgacaagtgttcttacaagcacagaagacagagacccacaggggagaaggccacgtgaacatgcacataaagattaacattatgcagccctaagtcaaggaacacccagagcctctagaagctggaagaggaaagataagattttttcctagagttttcagagggaacatggccttgctgacactttagttggacttctggtctccacaactatgaacaaataaatttctgttatcttaagctaacgagtttgtggtaatttattatgtcattcctaggaaactaatacagagattatgttattgcatgtatctgcttaaatccaagtgaactgtttgaaaagaaataaaacagaggtctctgggagactcttaaaatggagaaattgggggcatgtcatgaaaggtatgctccataattggaagaatagatatggaaagagtcaataggtcagagactattgtacttcctcttaatttttagggacgctttaataaaaaccatttagatgtcagctgttaaaccatgcttcaagaactgatggaggatccacaatattgattaaagtgcaatgtccatagctatagatacagatttgtcgagtgcctacaacatgcaggtattttatgaatgctaagaatacaaacgtaagtaaaactctgtgtctgccttcaagaagcactgagcccagttgggaaaatagacaagtagccgacacaattatatgataaatgctataatcagcatatagataaatgtatttttatcatggcagagtatacgcaagggcaagaataagaaaagagtgtgagttaatccagaaattgcaagtagttttgaaggctgaaatataatgtgggagagcacagtctggggtgatgctgatgaaaaaggataaattaaataaatagaaattagatcattatacagtattggatcataagttttaccacatatttactgaaaacttattcacaatatataactttaccaaagtcacaagacaagcaaatttgcaaaagtagaatttattggtctgtacttatcagctagccaaatttagccactgtgctttacttgcatacacagttacttaggtgatacaaaaattaagttctgtttttcactgcaactgggtctgcccggctgaagctaggtaacgatgaattttagaccgtccagaatgttagtaactccactgtgctagatccttacctagctgaagactttcttgaccaacaaacaataagacttgctttagggccgggggcggtggctcacgcctgtaatcccagcattttgggagaccgaggcgggtggatcatgaggtcaggagatcgagaccatcctggcgaacacggtgaaacccaatctctactaaaaaatacaaaaaattagccgggcgtggtggcgggcttctgtagtcccagctactcaggaggctgaggcaggagaatggcgtgaaccagggaggcggagcttgcagtgagcccagatcacgccactgcactccagcccgggcgacagtgcgagactccgtctcaaaaacaaaaacaaacaaacaaacaaacaaacaaagacttgttttaactgtgtgtggatttatggatggtctgattttgtactgtgaagatgacatcttcagtattgaattcccactgccacagtcaacctccccatctttgtagcaaaaagaaacccatagcagtgttttttttttttttgagaggaattcatcactagtggtttactcttatatgcaaaataaacttctatgcaaaataaactcaggtctgattttgtcaataatcgaagtgttcattgtctttccttgaatatcataaattgttcttcaaaaatgcattatcaatatatttattttatttatttttgagacaggttctttctctgctacccaggctggagtgcaatgcagtggcccgattatagctcactgtaatataaaactcaaagtaatcctcacacctcagcctcccacataggactacaggtggtgtgcaccatcacacctgcctaatttttgtgtgttcattatataaaatggacattttctctgtgtccattacacaaaatgggtcatgctatgttgcccagtcacattatcaatttatattcttggcagagttatctaaaatgtccatttgtctgcgttcttacctatgaacaatattaacatttattttaattttcattgcaaaggaaaaaaactacttacctaataaagattttttaaaggggatagtttaaaaaatttttaatataatttgtattttgcgataattttaaggataacaaaaaagttgcaagggtagcacagaatgttctcatagactatgtatccagtttcctttattgttaacatcgtacattcacatggtatgtttgtcacaactagtgacacaatattactacattattattaactgaagtctatgtattattgcagtttctttagcttttatctaatgtcttttgtttctgttcaagaatcctattcagaataccacattccatttagttgcatatctccttaggctcctttagactgtaatattttctcatacttccttgtttttgatgacttcgactgttttgaagggcattggtcaagtattttgtaaactatacctcaatttaggtttaatattattcccatggttacactggtgttatatgtttctgagagaaagacatcatagaaaaggctctcatcacattatattaacattactctttagagggaagttgctttgcacatcccacgcttaagagatgagaagtcatgcacacctctttaaaggagaagtgcctatataaataatttgaaataatttctttatatatatttttaaaatcttttctggaattttgagtgaaatggctttgaatctataaaagtcaagttgtaagaaacaatatcttaacaatactgagtttttcaatttatgttaagaaatatgtctccagtgacacatatctttgatttctttcaccgatattttatagttttctacacagagatattataaatattttattagatttatacctaaatgcttcatttttgtttactgttctaagtggtatatttgttttgttttgtgtttcttctttccgatattccagtgttcattactagaaagcaattgacttcagtatgatgatcttatatcctgcaaaccttgttacactagcttattaggtccaagagcttttttcaaaaatagtagagggttttctatagagaaaattatcttctacaaagataatgattgcatctgtagataaagaccgttctgtttcttcctgttcaatctacataccttttatttcttttccctgtcttattgcactcagtaggacttctagtaggatattaaatagcagtgttgtgagaggaaatgtttgcctgtatcaaatctgaaggagaaagggtttagttttcatcattaagaatgatgttagctataagtttttaaaatgtagcctttattaggttaaggagtttaccttttattctgagattttttttgttttttgtttttatttttgtttttgagatggagtctctctctgttgccaggctggagtgcagtggcacgatctcggctcactgcaaactccgccacccaggttcaagtgattcccctccctcagcttcccgagtagctgggactagaggcacacaccaccacgcccagctattttattttgtatttttaatagagacgggatttcaccatgttggccaggatggtctcgatctcctgacctcgtgatccacctgcctcggactcccaaagtgctgggattacaggcataagccaccacacctggcctattcttagtgtttttgacagtttttatgagtggaaattaagttttgtcaagtgatttttgtgcatccattaagatcattatatggttttacttattcatctgttgatatataatcatattgattaaatgatacatgatatgataatgattgatacagtcatgtgtatttttcttgatcaagtgttaaaatagtgaactatactgaatgttttatgaatgctaaggtttgctttcctggaatgaactccacttgctaatttcagagtgtgttaatgcagtcatcttcttgttatttgcaaagggcccatgatttcaattttaaacttttaatgttaaacttttactctttgttccttcaaggttatgtgatgtttacattcttagcttgaatggaggaaagattttgaaaacacttataaaatagaagtgcataacaatttataaccccatgtttcacaaaaatatttacacaatgatctgtaaaaatttataacatggggaaattgtgctacttatattggtattataagcagttttatcccatacgtatttattcactttataagcattttaatagaatgtctgacggattgaaattacttacccaacttgtttatacaaaaggatttactaaaaactgttaaacactactacataatgacactgtcacaccaggcttttaacataagaattgctctgcaatactaggagaaggggcataaaagacaagttgattttgcagcatagcaactaaaaatataacaatgaaagcaactgttaaaaatgagaactcagaacttaacattagagggacccaacatcatgcctccatttagctaattgatacaaaagagttagtttaactgctattaacaggtgacaggagccactctcaaatgattcttcaaattggaaagtactgtcttacaacctgttgttgcagataagaagtaaatgaaatcattttgtatggtttgcagctgtttggataaccacctggcctagatactttcccataatcattctgctagttaccacttattacccaagaccttcctgaaaatcctcctttaggccctcactattgttgctgatactgttcctttgatacagctgcttttatttcacatttattaagcccatcatagtagtatttattttccattattttcttcacttgtttctgttcgttaacgataatgcagagcccatgtctccttgttggtcttttccatgggagttttatagattttaccactccaaaaacagcacttggttcatttattaagataaattatgaggcacataacaaagcaattctccagaattgctttatttgtttattaacaaatgtgtctggtatcatacaaccgaagtaagaaagaataagaagggtacaaaaactgaattttcatcccccacaatctattctattcagaaacctttttttattttttgagatggataatattttaatttaaatgagacttaattcaagttacatacattcactaaattcttatttgcctttgaaatatttacattaaaaaacaattaaatttatattctatttatattacatttataatttctaatatcccatttgctgggctttgataatataattgataggatgtagtttaataattgtcaaggaaggaacgatgttatgactttttatatctgcaaagcatcaactttaaaatattaactctaaatgctcagaagctgagtgtttatttataaacttcactgaagccaagatttctcaagttagaatagttgaaaagtatcagatatgtaaatgacttcatacaatttcagaatcaccacagttcttttccgtgatttatcttcttttttaataattagtgaccacaactacatataacttattttcttaagatatgcaaaaaattaaagtatatatctctgtgaatagtactctattagtaactgatcatacttaatcatgaataggaagcctccagttagaaatctacacacctcggatattacttctgcttaattttatttacctgtgctgtagccaaaaattttgacggtttggaatttttgccttgtttttacataagaaactatagttctgaggaataaccataaaccaaaccaaaccaaaccattttacacttcacttacccctgtgtcctgacctcttctctgtcctggatgatataccagaatatctaactggattcatccttcagatgaatggccatgggcttacaaatttgacatattttcttttttaaaatgttatttttatagatgatattgtaaacttctatgtttctgggaaacacaataggagcatcaggttgataagtaggggatattcagtgaataggcaaagccaatgatctgagcagaatggtcttgattatgagttcaatattatactgcttctcatttcagtatttttattactattcaattgatcacattatatgctctaaatttttaaaaatacaggtattttaaactcatttcattgctttgttgcagagactgtgatagattggaatctaattattaaatgtattttcaaatgtgtaatttaattttattatagtcaaactgcataaagcataatccaaactgaattataaaataagtaattttagtgttgtttatattatgtatcttgaaggtcattttaatttaacatttttacttttatcctgagtaattctattgtcactatcaattatgcatacagattaagaggagttattcttagcaattattgtaacataaaccaaagtttcctgaaaccactttaaaaactagaatattgtctaaataactgttgaaattgtatgtagacatatacaaagatttaggtaaaaaggacattaactacacctgtctccgtagttatgaatgaatgaaactcaaagtagttcctttttatagatgatattatttcgtatcactttttagtaaaacattgctttatatattgatattgacagtatttaaacttcattaatttgaaatgatccatatgcagaaattaagacagagctgggtgcaggttgtttatttagaaggtgatccaagtaagcagaaatgaaggagtggaaagaacaaaacagggaaaaataaaagttaaataagaatgcattatttagcagtttgtcacattgagcaactgggactcagtctgactgcagtagttttcacattctttcatacttttctcagcaaaaaaaaaaaaaaaaaatggagcctaagcccccttttaacccccatcattggaaagttggcttcctcctactctgtttggatctcttgtgcaggcaagctagacagtctatcataaagaaactcatgtatcactataaagaggcccatgtggaaaagaactggagccttgaccaatagccacataagtaaatatagaaggggatctttcaaccccatgtgggtctttatatgattgtaatccagctcgcatcttgagtgcaacctcctgaaatatactaagccagcaccacccagacaagctgctcttaaattcttgactcacagaaatggtgagatgacaaatgcttgtgtttgtttctttgtttgtttgtttgagatagagtcgtgctctgacatccaggctggagagcagtggtgtgatctcaactcacttcaacctccgcctcccgagttcaagcaattctcctgcctcagcctcccaagtagctgggactacaggtgtgcgccaccaagcccagctaatttttgtatttttagtaaacacagggtttacccatgttggccagcatgatctcgatctcttcacctcgtgatccgcctgccttggcctcccaaagtgttgggattacaggcgtgagccaccacacctggcctaaatgcttgttgtttaaacaacagaattttgagggtagattgttatatgcaatacataattatgtacaaaatgaggactaattgaaaaatctgtaaagaagacaaatcagaaactacctcagaaccactgatgaacaaagcaattattcactgattcttattccctactagccatggatagctcataggctaatacgggcaaacttctgggctgatttatgagtggctatcttgtgcgtatactcagtaagataccctagcttccaaaaaaaaaaaaaaagagccctaaggcacaaaagtacaaaatattgaagtgtggtatagtcaatatacttgggaactgtccagcacagctgggatgagatgaaaagcattaaaaacaactgctccacatgccatgtgaggatccccaacctatttcatatgtcaaaaaacatctaagaaaaaatgaagaagggaatttaataaattcaaactacactgagaactttggttaagataatttttctcttctatattccacttttaagaacattcaatataaaagaaattagatttttattaaggggactatttttaagagataacaagcatgatggggatggcattgaatctgtaaattaccttgggcagtatggccattttcacgatattggttcttcctacccatgagcatggaatgttcttccatttgtttgtatcctcttttatttcattgagcagtggtttgtagttctccttgaagaggtccttcacatcccttgtaagttggattcctaggtattttattctctttgtagcaattgtgaatgggagttcactcatgatttggctctctgtttgtctgttactggtgtataagaatgctggtgatttttgcacatggatgttgtatcctgagactttgctgaagttgcctatcagcttgaggagattttgggctgagacgatggggttttccagatacacaatcatgtcatctgcaacagggacaatttgacttcctcttttcctaattgaataccctttatttccttctcccgcctgattgccctggccagaacttccaacactatgttgaataggagtggtgagagagggcatccctgtcttgtgccggttttcaaagggaatgcttccagtttttgcccattcagtatgatactggctgtgggtttgtcatagatagctcttattattttgagatatgtcccatcaatacctaatttattgagagtttttagcatgaagtagttgttgaattttgtcaaaggccttctctgcatctattgagattatcatgtggtatttgtctttggttctgtttatatgctggattacatttattgatttgcgtatattgaaccagccttgcatcccagggatgaagcccacttgatcatggtggataagtgttttgatgtgctgctggattcggtttgccagtattttattgaggattttgcatcaatgttcatcaaggatattggtcaaaaattctcttttttggttgtgtctctgccaggctttggtatcaggatgatgctggcttcataaaatgagttagggaggattcccgctttttctatttattggaatagtttcagaaggaatggtaccagctcctccttgtacctctggtagaatctggatgtgaatccatctggtcctggactttttttggttggtaagctattgattattgccacaattttggagcctgttattggtctattcagagattcaacttcaatcccatccccatcaagctatcaatgactttattcacagaattggaagaaattactttaaagttcatatggaaccaaaaaagagcctgcatcaccaagtcaatcctaagccaaaagaacaaagccagaagcatcacgctacctgacttcaaactatactacaaggctacagtaaccaaaacagcatggtactagtaccaaaacagagatatagataaatggaacagaacagagccctcagaaataatgccacatatctacaaccatctgatctttgacaaatctgacaaaaacaagaaatgaggaaagcgttccctatttaacaaatggtgctgggaaaactggctagccatatgtagaaagctgaaactggatcccgtccttacatcttatacaaaaattaattcaagatggattaaagacttacatgttagacctgaaaccataaaaaccctagaagaaaacctaggcaataccattcagaacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaattttgcaacctactcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaatgacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacacgtatgtttattgcggcactattcacaatagcaaagacttggaaccaacccaaatgtccaacaatgatagactggattgagaaaatgtggcatatatacaccatggaatactatgcagccataaaaaatgaagagttcatgtcctttgtagggacatggatgaaactggaaaccataattctcagcaaactatcgcaaggacaaaaaaacaaacaccacatgttctcactcatagatgggaatcgaacaatgagaacacatggacacaggaaggggaacatcacactctggggactgttgtggggtgtggggaggggggagggacagcattaggagatatacctaatgttaaatgacgagttaatgggtgcagcacaccaacatggcacatgtatacatatgtaactaacctgcacattgtgcacatgaaccctaaaacttaaagtataataataacaaaattaaaaaaaagagataacaagcaaatggccagaaccaacctggacaatgaaacttacctcaatctatcaccacgtctacattactctacagtgatcagaaatctcttctcaaggcaaaattctcaattattattgtcagtgtggggagggagctgggagagggagagcatcaggaagaatagctggtggatgctggtcttaatacctaggtcatgggttgatctgtgtagcaaaccaccatgacacacgtttacctttgtaacaaacctgcatgtgtaccacacataaaataaaagtttatggtaaaaaagaaaaaagaaatttttttgttctttttttacagtagcatgctatttctagatcaccttttaaaaaaaagagaatgaatacaactccaccaggcaccctgatggaccaaacccaacacaattcaaatatactgaacttaaggatacactgagcatttcagagcaacccactgtcctgaactgacagttcaaaaatgtataggagtgcattctgagaatacaactatatgatattttaaaaattctttattttatgaaaaaacaattttaaacacaggcagactactttgaactttggatataaatgttgggaagaatgtaggaccttctgaggcagggacagaactaaactttaaacagaactagcttattcctgaaagtgtttagttataggtagatacattgttcctttctaaagaagctatgactagactctctattaaatctaaaatagtgagaatatgaattgtatttacaatagaatacagaaattaataaattaaatgattattaaaatacacgcataatgttgtaatgataattattaagagctgtgaattgtcattcatctagttacctccacaacataaagctcctgtcttagttcagtccatctttcattttcttttaatttttaacatgtgtctttttcattatttgggagagttctagaatgagcaagacatcttgcctgtgttctttttagactatcttcaccctgagacaacaaaatcctccctgacacatctatctcatatatactttgtagtggggggtttaaagccatggcctcaaaatattcaagtgcagtcattttcaagcaattttctctgactatcttttcctctgggttttttgagggtgttaagaacatggtgctgatgtttctacttccctaccaaatgctgttctaatgttaccagttaccaacatattcaagccactcattttgtctttaaccacttgatgtgtttaacagttccttggttgctttagtaaattctttccttgtttacctccctgccccctctagtagattttcagggttgccataagaaagcaccacagataagtggcttgaacaacagaaattcattttctcacagttctggaggccagatgtccaaaatccatgtgtgggcaggatgacaggattggtatcctctgaagccgtctccttgacttgtgagagactgtctcctccttgtgtctttgcatggtcttccctccatgcatgtttgtgtccccatttcctcttttttataaggacaccagccatgttagattgaggcccaccttcatgacctcattttacctaacttaccttaattacctctttaagagacctgtctccagtcacaaccttaaagcaggtcttggaaaattacaaaatcaattttcagaaacttcatgaacatttatgttttcaagcatgagtattatatgtaaatatacatctcttttttcatcaatttgtggcttttaaaatcatgctcagttataagcattatacaaatttttcccatttcttaatatacaaaccttgaaacattctataaattaaaaagcgttttgcagcttttagtgaaaaggcattgcatgggaggcccttatgctaaagattaaaattccttacaccttatacaaaaattaattcaaggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctcattaaactaaagagcttctgcacaggaaaggaaactaccatcagagtgaacaggcaacctacagaatgggagaaaattttcgcaacctgttcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaaagacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatatacagccataaaaatgatgagttcatgtcctttgtagagacatggatgaaattggaaatatcattctcagtaaactatcgcaaggacaagaaaccaaacaccacatgttctcactcatagatgggaatcgaacaatgagaacacatggacacaggaagggggtcatcacactctggggactgttgtggggtggggggagtggggagggatagcattaggatatatacctgatgctaaatgacgagttaatgggtgcagcacacaagcatggcacatgtatacatatgtaactaacctgcacattgtgcacatgtaccctaaaacttaaagtataataataaaaaaataaaaagattaaaattcatgcaaagtattaaataaaaacattcttaagcttcatgatgaaaacaaaacaaaaatagctttgtattcttttctcgttctttgtaaccactaaacacatttagtgtctcattttggataaatgccattggaacacgaagctcagaatctaaggtcagctgccctattcaagaggcttaggacttctggatcctctcattcattaacgacatgacatttctactttatacaaaatattcagttgaaattaaattctccctaaccaggtagggcaggcagaatttgtttttaactccaaagctatatcttcacaatagaactacttggtattagtccattttcattctgttgataatgacatacccaagactgggcaatttacaaaagaaacaggtttaattggacttacagttccatgtggctagggtagcctcacaatcatagcagaaggcaaggaggagcaagtcccttcttgcacagatggcagcaggcaaagagagagtttgtacagggaaactccccttttgaaaatcatcaaatcttgagagactcattcactatcaccagaatagtgcaggaaagaacctccaccataattcaattgcctcccaccaggtgcctcctacaacatgtgggaaatcaagatgagatttgggtgtggacacagccaaaccatatcatgcttataatagtttgccaactttacatggtacagattgcatggtacagtaagaagaccaaatcaatgaatgggttccatgcatcaaaatagcatcagaagggaatctcttgctctctttctctctctctttcacagagacattgtggttgggggtgaatttcactttgagataaaaactgatttcactaacagtttccctttcatacttaaaaaactttactgtgtaaggcagaggtctccaacacccaggctggggactggtacaggtccatggcctgttaggaactgggctgcacagcaggaggtgagcggtgggtaagggagcgttacctcctgagctctgtctcctgtcgcaccagcagccacactgaattctcataggagcgtgaaccctattgtgaacctcatatgcaggggaattatgttgtgtactccttatgtgaatctaatgcctgatgatctgaggtagaacagttttatccccacacaactactccttcctcccatatgtgaaaaaattttcttccaaaaaaccagtccctggtgccaaaaaggttggggactgctggtgtaaggatgagatagctgttactaccactgtgtccacaaaaagaacaatgtagttagactggaaataacatgaagacagaaagattctggctccttgatggcatcatcaagctgctgaaagaaatctggaatcaccaactcttaagtttctgattttggggaaaaaaattaatctgtattgtttgtccattagtcagtttgttgttctggtggttacttaaagttaaaagcatcttgaattataacatttttgttttaaatttcattcgtaatttatctttatatttaacattcatcttaataaacttttttaataattaccagttttcagaacacatagaaatatgatatttgaaaaattatggtagctgagatttaatgtgccattatatattatgctctgtatttctccatggttatatacacatattttcctatacttacaatcgatatattcttttcttcccctagcttataaggttatcctactgtgagtgaagatgagagatatgacatagccctttctgtgctgtgctcttgtctccatatcattttgtccacattatttatttcaacatatataattttcctcttctttggagaaatcataaatgaaatgcttcctgtgaggaaaacttacattcaatttttgagtagccagggttcctgccagagagataacacttgtccagctaatgcattactaaaaagcaaacaaacaacaacaacaaaacctatgtatctattcttttcattctctctaaaacccttctctacattgagaggatagaagaaatgtgctgtgcaccccttcctttattaatagatagtactgggccaggtgcggtggctcacgcctgtaatcccagcactttgggaggctgaggcggacagatgacctgaggtcaggagttcgagaccagcatgaccaacatggagaaaccccgtctctactagaagtacaaaattagctgggcgtggtggcacatgcctctaatcccagctacttgaggggctgaggcaggagaatcacttgaacctgggaggcagagattgtggtgagccgagatcatgccattgcactccagcctgggcaacaagagtgaaactccatccccccccccaaaaaaaaacaacactgaagaaaagacgacttttcaactcctcttagttggtccaaatgcacccacttcctttcttagggagagaagacatgtgcttttatccatagagtgtataattggcatctaaatttagatatcaggtcagtgcaaaagtaattgtggttttgtcatcactttaatggcaaaactgcaattaattttacaccaacccaatactttggaggtttaaagtaagtcttactgttaattgtcctgggccaaaaacatgaataaacaaaaagaatttcagacaaagtggtatgtatggtcatcctacccataaaaggtctatgctctttggatgcttggcatcttttcctctaaggaaatcccacgtggtcctgggcagagttgggggtgagagtaggtgtagggaagtgtgtggtgttaacaatgatttcccaccacatatcccctgatacggtttggctgtgtccccacccaaatctcatcttgaattgtaacttccacaattcacacatgtcatgggagggacccaggggctggttactgaattatgggtgtgggtctttctcctgctttctcatgatagtgaataagtctcattagatatgatagttttataagggagagtttccttgcacaagctctttctttgcctgctgccatccacgtaagacgtgacttgctcctccttgccttccaggatgattgtgtggcctctccagccatgtggaactataagtccattaaacctctttcttttgtaaattgctcagtcttgggtaggtctttatcagcagcgtgagagtggactaacacattctgtaaggcactgaagtgatccaagctgtttaatccaaaaagctagttaatatatttcctgtaattttgtttgctttggaagtgagaattttactcaagtggtatcaattaagttttcttatatgacctgatttttcttttgaattgtagcctaagatacagtgaaggttaccagctgcaattttccccaccatatgtatacagtctacctttcagtaaagtcattatatacaagggagcagagtcaaaagataaataatttctggacgagtcattcctggatccagctgtgcttgaaattagcatcataatggagcatcccagttttatgagccataaaaattctatatatgacttaattaggcagagttaatttttttacttgcagttgacagtattaaaatggcatttttgtcatcttaggatttaaaagaattgggatggagtgaagagggtaagaaccaagagtaagaggaattaagataggagattatttctattgtgaggctgatcatgatgagaatgtatgaattttttatattttaatgtgcaatatgcttttaggaatgcatattctctggagatataaactatattcataagaattattacaaagctaatacattctggagatttatacttatatttaaccattttaaatacactaatatccagagaagtagtagaacattatgatatgaaaagatgatgagcaaggaaattatatatgcatggaaaaatatgtttgcaaaccaattcctgatttcagcctacctgaattgatataaatgtatattttaatgcagttaaaataatggtctgggttctcttacactgcaattgctaactatagctcatgtcatattctcagggttagtgcaatcatttacctgtgccaggcagctctgaataaaaaagatgtacatttactggatgggagaaatttctatatgagcctacaggatgcagcatcagcatgtcagcttcctgaactcttttattagtagttattttctgtgtaaaattttattgttttttaaatctctaatcacatttagtgagtaaacaactagaaataatcacttaccaattcattcatcagaatattattttacatcaactagcctttaagaagtagctaaatttctttggaaaactaaatactgtttaccatttctctttgccaccagactaatagaaagttttaggtatatctcactgctaaaacccaggctgaacactaagcaattgggagattgaaatgaacacatcattatccgagcaatgaaacattgaaaatcagacactggagcagtctcgtgtttgaatcaacaaataaaacagaagcattaagatttcaataaggtgcttaaacaacttaaagcagaacgattttagacaaatcacaatattgaatcctctctgggaacatcagtcctgtatgtaatcatggatctgaaattgacttcatgggaaattcaccagaagaccattttctaatttaacagaaaccaagaaacagcagtatgaaatagtaaaggtgtggaatattaagagtcagagttttaaagttcttgacatcagacggcgtggagatgagtaagatcactgagaattagatatgtgaccttggtaaatgacagatgcttttcatctataaatatccacaagctttttcatctgtaatatttggattacattagaaccaaaatcgtaggtctttttaaagatgaatgtaaataataagtgtaataataaatgaaaaaataaacttattagaatgctgtcagaaataaggctgcttaaatgctagtgattttttaattctctttttttagttctcttttattgctatgattgttgttactgaaaaattaaatttacattattaatagtgcaacaggcatattgttgagatgactaaggttaatctgtctccatttgcttaaatactctaaaagaaatacagcttgctattcttatcacaaaagtatatttttaaatcttttaatgtttctgctaaaatagaaaatgtgttaagatattagacagttacagttaacaagtttgaaatattaatattgaaaaactatactaggaagtaaaaatcatttggggatcctaaattctcagggtagctacacttcttgtgtaacagctatagaatctcagaaaaaagagaatcaagagaaaccggcaggggctacaaggcattttccaacccagtcgtggaagcatcacgtctgccctgttacttcagttgaggcatagagacatatatcgtatttataaccctaaaatctattttgagttgtggatgggctgtcaataaagaataacaaatatacataatcaactttggtaaaatgcttgagaaagggaaaaaatcaaaagtgaatcattcattggattcattatgaagatttcattgctctagacatatgattctgactcatataatggtaaaagagacatttaaccttcttttcccaaatattctcatattataagtacatgattgtctgctttcagatatttatgaagtttgagatatttataagaaaattctttataggcagggcgcggtgactcactcctgtaatcccagcactttgggaggctgaggcgggcagatcaagaggtcaggagatcaagaccatcctggctaacacggtgaaaccccgtctctactaaaaatacaaaaaaacattagccgggcgtggtggcgggcgcctgagtcccagctactcaggaggctgaggcaggagaatggcgtgaacccgggaggtggagcttgcagtaagctgagattgcgccactgcactccagctctggcgacagagcgagactccagctaaaagaaaaaaaaaaaaaaagaaaattcttcataaatgttgagttgcattattcctcatgagcataataatactattaacatgggatgaggtcttggagtgttacctagtttatacttctttgtgacagttatgacaaacatttgtaaggcattttaataaaggtgaagaaagagtagtgaatggaatgtcaaagatgatgccaataaagaggtaaagttgatttttttctaattttccaacttataaaagaaaccacttactgtgtaactgtgagacatattctacttcaagaagtaatatttacataatttaatactgaagtaactgtatgtccgaaaacatctcatataaaaatgtaaattacatcacttgaaaattcttcatatcatgcctatttttatgtaccaaattttagtaaagtacctcctgacaaaagaatttctaaacaaaaatgactacaaacaacagtaatactgagaaaggtcaaaattaatgcaaaaaaagaacatattctcacatgaaaggcagtttttaacacacacacacatattgagagagacagagctagctatactgaatttctagaagttatttaaactctacaagataaaattatcttaatacaggtaactttgttttggaattgttcattatgttcatgaagaatactcaacaactttataaactattaaataaacaaatagctatgtacagattttctatatgtataaatcactacaaaggaaagatgctttatggcactataccaatgattatcactttgtggcaagattatggctaatattttttatttgtgcaatcctttaaaaatattctgataatgaacatacattgtttctatagtcagaaaattacatgataaattatattaaaactcagttaaataaagaaaaaaaacgctagtattcttcaaactttttttctttaccagaggttttacttcaaacggcatttgttattctttattggcaaaattgttcaaccgactccttataggtaggaacctttttgcttatttaacctccagttggtgatcataagggtttatagaatgcatgagtgccttcatgaataaataaatggttttaaggaaaaaacatgcttccgtaagaaaaaatatctaatttcctgacatttgcctactaataattgatgtggtcatgccaatcgccctgtgaattacagggtaattataaccattgtatagccagttatgcttaaatggctgattaattaatcatgtattttgcatacaaatcttgtgttctctggatccagctaggtggtgtgttctctcatacactcatagccttatgatggctggcactgatgttatctcacctacctggtatttggactgaaaagactaaaaactaggggcagaaacagctgagctccttgccctccccctggtcttactagtttctctttgtcatggcctcgaggtaaccacactgcttgtgtgacaaccatagactcccagaaaaagaacatcaagaaaaactggcagaagctataagctgttttcctacctagccatgaaagcatcatttctactctattatttctgtctctattggttgaaatgatcataaaattctgtctgtgtttaagagagtgtcatagacataacttcttggtaagagaaatatcatataatttggaaatatggtctgaaaccactacaatctataggttaaagtacaacggcttaagggcacttaaaaaactgattgataataaattaacacagtacttctaagagtgcataatctgagtcaaatcatgtggaaatgtcagataaaccaaaattgaggcaaaattacaaggtaaacgatttataatcatcaaaaagtaaaggtcataaaagaaagatagactgataaaccgttcagaaggtacaactactaactataatttaggaatggattctggagggggaaaagtagaaatggagaaatagctaaaaataattttattgagataatttatgaaatttcagtaaagcttgtggattagcaaattgttttacatggagtttaatatcttaattgtgataatttaccaaggttatataattgaatattcataggaaatgctgaagtatttaggggtaaggctctgaatgtctgcacattttctctcatggttcaggaaaaacttgtaggcacttgtgtgtgtatgtgtatactttgcactaccttatatatacagaaagaaaggaaaatagaagaaatgatttagaagatctaacagttaagaattgatgagtccagatgaagagtatacaagcatttttttgctcttactgtaattttcctgttatgtttgaaattataacaaaatttaatgaaaaaagacactttaccatcataaaacttttccagcaacacactcaacattccagatttgccactatttaattttgaattataagcatatttgttaaatccatacttgtaactttaataatatgcttacatataatattaggactccatatatttctataactgccttttttttttgagatgtagtcttgctctgtcacccaggctggggtgcagtgccacgatctcagctcactgcaacctccgccttccagggttcaagcgattctcctgcccctcagcctcctgagtagctgggactacaggcacctgccactacacctggctagtagtagaaactttagtagagatggggtttcacaatgttggtcaggatggtcttcaactcctaacctcatgttctgcctgcctcagcctcccaaagtgctaggattacaggtgtgagccaccacgcccagccaactgctttctttttatagaaatcataattgcttctcatttttgtttgctttgttttctattttaccatcactaatttatctgacaaatatctcaaagacatgacaaatcaatgtccaagagaaaaatttgagtatctttctttcagaaagtgatggaacagtgaacaaaaaattaggatttttaatgtttataatacattattaagaaatttgatctcataaatatatatctagaaccatggcccaaggaaatagaatatattttgtgagggtaccatggactactcacagaaattaaccagtttttaagcctcaaagaaattttaataattcccccaaaccagaaatcatcatttagaacaaattttaaaatccaaatttaatataatttgatatctaacaaaatttcacagctaacagaaatattttcattgggaattttagaaaatactgttaagaagttaatgagttaaagagaaaatataaatttaaatgataatctagatatatagccatgcaaatactacatagcaaaaactctggtttaatcaaacattctcagagaaaattcaaagtttttaatgcatctataagaaaatattaaaaattaagtaaactaaatctttaagtagctacaaaatgaataaaataagaattaaaattatattaataaaagtggtaacacattaatttaacattaatttaaaaatacttaacaaaacctagatttttagttgttgtatttatcccttgaacaatgagtagaaaacttttagccagtgtgactaaaaacaaagagaaaccccaaaaagaaataaataacattaattacatgaaagatgagctggtgaaaatgtggattaaatgaaagattcataggagaatttaactttatacagcagtatgcttataaacctatactaagtgaatgctttttcaaagaaaatataaacttacaatattgttttgaggaaagggggaaaattggaaagcacaaattgtcagagaatatagtaaaaattttgactcctacagtcaccaagcctgagctctagtatcatgtgtactataaaaattttaagaaatatgtaaattcatgttgtataaactgtctcagaacatagaaaaaaggtgcttttcacatctacctacaaacctagagtaacctgatattaaaataattcaggtaagcacatgtacccactaaataaattatacacatatctttgaaaatcatgaagaaatcacaaaaataccacagcaatatattaaaaataataaaatataaaaatgtatcttcacgtttattgtttgactaatagaagaataaatacaaccttattgtctggcaactccttaatgagttatgatttacctatattatgaaatattatattgttatcatgaaggagccaatttaactattcgtgtagacagattccccaatatggttaactaaaaaagccagtaacttaaaaattggtttcaatgtctttctaacctaaaaaaaaggtccacatgaatattatagatagataaatgcttacagaaaggatagaatggttacgtatcactctgttaattgtaattactctggaaaaaagactaaatagttgccaggagaaagatgttattttaagaaatattatagtctacagttctatattacttgaatgcctcatattgagaatgtatctgtatatatgtgcagttcaaaaattatgtttgtttttgtttttttccaaagtacctaaaaataagccattagattagagagtagattcatgggaataatcagagagggagagggaagagagaatatgaaagataataaagtaaaataaatgaggaagggaaaatacagggcaaaaaacaaacttgtaaaaatattcataaaggctaggcacagtggcttacgcctgtaatcccatcacatcgggaggctgagacgggagaatcgcttgaacccgggaggcagaggttgccattagccgagaccgcgccaccgcactccagcgtggtgacagagcgagactccgtctcaaaaaaaggaaaaaaaaattcataaaatacatatcagagaaaagttcaatattgttataagagattttatatatcactgagaatggaaaattagaacaaaatgaatatgaacataaagaaagacatattagtgaacaataaacctaactcaatgttttctcttatttatcattttgataatctacagttacataaagtaagataccaatctttatcatattgcttatcaaaagattttgctgttattgtttaatgttgagataaagttctgttaattggcatacactggcatacaggcactccaagtgtactggtggaagtgaaaattagactttaacaacaggttttaaaagcttacaaaaatttgcatttactttgagggagcaatttccctgccaagaacttattttaggacagttattctcaaaaacacaaagatgaactaatgagatgatttttagtaggcagaattctaaggtgacccacagtcatgtatataatcttctcttaagtataaatgaagcctactaatattatgaaatgtcactttgtgatcaagttttatggcaatagagaaattaactgggggtgggccttaatctaatcaggtgagctcattaaaaacagtattttctctgatggggcacagaaagggcagaaagattcattctggctggcctagaaggaagcaataatttgcattgtgaacaagggggcaaggacctaacgatgcatctaagagctgaaagtattttctacctgacaaaaaatggaaacctcagtcctacaaccacaaggaaatgaattttgccaccatccattgagcttggaaggaaaccctaaggcctagagagaaactacaaccccaacaaacactctgattttagcccagtgagactctggacagagaaccagtcacgccatgcctgaacttctagtctacaaaaactgtgagaaaataaatttgttttgtttcatacttctaaatcagtgataatttgttatgcagcaatatgaaactaataccatattcatgaaatcgtcatttatgatagcaagtaaatggaaacctcctctacatgtagcgataaagaacaggtaagcaaaatatgacatactacacacagcaattaactctcatgtttgcaaagcctatttacaaacttcgtaagaactatgtataaaattccgtgtgtgtgtacatatgtgtgtgtgtgtttgtgcattttacatacattcgcacagttttgcattgcatattattcattaggggttgaattctgtctctcagaaaaggatatttgaagtcctaattctcagtacccccgtatgtaacgttatttagaaataggatctttgccgatgaaagtaagatggggttattagagtggactctaatgcaatctgactggtatccctaattaaaatcagaaaattgggctaaatggagagaaatgcaccaagggaagactatctggacacagggagaccaccatctataagccaaggaatgcctgatgctaccaaaagctactagagaggaaaggagctttcccttacagttcccagcaaaaaatcaaccctgataacaccttgatttcagactagcaccaaactatgaaacaataaatttattttgtttaaaccacccagtttgtgatagtttgttatggcagccaggaaagtaatatagatacctctatgttcatgtagatggaattgcaacaaaatttaacagtgactgtctcagttattgggaatatattaggcgggttaatactcaatttttaatatttggccacatttaacctataaacgtggcaatttgacatgtttcagttcattaatttcttctatattttttgtgctcatcttaatttttaattgtctttcttttcatttttttgagacaggttcttgttccccaggctggaaggcagtggcgtgactgtggctcactgcagcctcaaccttttgggctcaagcaatcctcctgcttcagcctcctgagtagctgaaaccacaggctcataccaccatgcccagctattttttttttttttggtagagatgaggtcttactatgttgccaaggctgatctcaaactcctaggcttaagtgatcatcccgcctctgcctcccagaatgcttggatgacaggaatgagccaccacacctagcctcctctaaatttttgaagttttcataatatgtgttatttccatagccaaataaatttgataatcacaaaaagtagacaaccctcttcaaataagcaaatgttggagattatttatattcataaagatgttaaaccaagatgaattgctaacttgaaaatcatttcctttcctatattcctttttctgcattcagtctcttcatatttaccttaagatgttttatagtttatgcattatttgtatatgtcaggttttaaattgaaatattagaaacagacattattggaaacagcagttttctgtttctactagagcaaaataactaatgggagattaatattaatagactatgcactgaatttttcttataaaagttcaattgtctaataaattaatgatacctctcacttttacaaataatatgcatatctctacttgctagtgttgatctgatcattcaataatcatttaaggattcattgaaatccaaaaattggctaagaaacatgctactgttgtctagagggaaagacaggcatcaaacaagcaattacaaaaatgtatggttagtcttataatgggaaacatgaattatatggaactaaccaagtcaaaggtgagaaaatgccctctgaggaagtgatttgcaaggtgaagttttccgatttggcaggataagtaggaccaagttgcagagggagctggggcttgcactgtatagaatgattaaaaatagaacaaatgttgcttgacaaagttctgtgattttagttacaacacctgaaaaatgttatgatgctattgtcttttaaatacatgatttcttttgacatgaatcctgattttttagaaatattttcaaatctgcattttctgtcacgaataaatctcattaactgctccactccaaatggccacttctgtcactgcaaatttatatagggacagctatacattattaacaagctatgaaaagtcaccggctaaatgtcaccaaagctgaggtatagctgcaccttgggattcatatagcaaacagtttagttttaatcatcccggaccacaggatgtcttgacatttgagcagcaactttttcctctttaacttgcactggaatcagacctctattatctcagccataatttttagcttaaattgtgatagaaagttttaccttctaaattaaaaacgtgaaaaaaatcgatccatcaaagaacttatcattcatgtaatcattgctcacctgcagccctcttcctcttaacccccactccaagaaaggtgatcaaggacagctataaaattcaaacatctttagacctgccagaaattttttgagctaaatgcttttctgttacattaagacctacaagaaatgaccttgctgaactgcattaagagagatgattgattttaccgtgaaatattttttattttgataaaataagtaggtttcatatttttaaaatatgcttttgaatctttttctgctcaaagtctaataatgttatcaggatatcaatctttgatgcctacaaagtgtctaaatttattaatattttataaaaaatatctaatgcatattatatatttgagtcttcttaagatctatcattttagcccttcattgtggagcattcacagtaattaacatagtaattagaaaaaaagggaaacagacatatcaataaagataatgtttgctatatatatgtgtcttataacctcatgctgtataccttaaaatggtcatcaatacaatactacaaatgcattacataacctgttctgaacaaatatgactggcttactgataatttttctatatatataataagtcatggataagcaattattaaaaaagggcttattgtcaaataaattggcttattggtatctatcatacagctcttactttatttaataataaatatcatatggtccataatgaatagtatagtgaatgcatacatcaaaataaaagtagatgatggaatttaaaacaatgatcatagcattgtttcttaactgttttatgagttaacacctaaaaatatgtaaatttataatatgtcttctttttatttcaccaaaaaatacatgtgatggaaaattgtctatggttgtcttcacctctttgaaaagttaacagcatcacttttatgtttgcttctattttctctattttatgaacaacattcaagtagtatttgtcaattacctattatgttatgaggtattgtaggtttcatacagtgatgagcaccatggacaagatctttgtagatattacaatcaaatacagagagaaaaattagtatcacagaaaaaaaaataaatgctgctatgttttacgatggtgtctaatgagagatacaactttattgagtgggttggtgggaggtggggaaagaagattttcccatacctgttcttttgagagtgagttaggggagcattagcaattattcttgaataacaggcttaactcaggcacatatttagtcaactaaccctacaaccttgactgattgatggagaatatggtaggtcttgagaacttttccaagacaggaataccttagttgggagtctccagaaacagaccttgagcaaaaagtttgagtagaagtagttttttaggagatataaaacacacctaaagttgagtaagttggtagatgaaagagaatgtagaaaatgaaattaaatcaactattaaagtgggtgcttagaggttattcccctaggaaactctgatcaaccgtaaaaaacacacacttcagaattatcccacctgatagactaagaaagctaaggtgtgtatacccaaacttccatcagtaattgttgggggctgcatcctggattgggaggatgagaaggggaagggggttaattcaccagaatttctgttctgctttgcatgaaagtagtttctgaaataaacaagctcataaataaatacacagtttgctggaaattggctgtaaaaggttgaaatggtaggatgagaggagtaggagtgatagccacccattagacaacagcatgacagagtgagctaaggtatttgcatctattaagattatcagtctcccattattattgtgtgggagtctaagtctctttctaggtctctaaggacttgctttatgaatctgggtcctcctgtattgggtgcatatatatttaggatagttagctcttcttgttgaattgatccctttaccattatgtaatggccttctttgtctcttttgaactttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactttttatccaatttgccagtctgtgtcttttaattggagcatttagcccatttacatttaggcttaatattgttacgtgtgaatttgattctgtcattatgatgttagctggttattttgctcattagttgatgcagtttcttcctagcattgatggtctttacaatttggcatgtttttgcagtggctggtactggttgttcctttccaagtttagtgcttctttcaggagctcttttagggcaggcctggtggtgagaaaatatctcagaatttgcttgtctgtaaaggtttttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccccttgtaggtaacccaacctttctctctggctgcccttaacattatttccttcatttcaactttggtgaatctgacaattatgtgtcttggagttgctcttctcgaggagtatctttttggcattctctgtatttcctgaatttgaatattggcctgccttgctagattggggaagttctcctggataatatcctgcagagtgttttccaacgtggttccattctccttgtcaatttcaggtacaccaatcagatgtagatttggtcttttcacatagtcccatatttctgggaggctttgttcacttctttttactctttttcctctaaacttctcttcttgcttcatttcattcatttgatcttccatcactgataccctttcttccagttaacaaatcggctactgaggcttgtgcattcgtcacgtagttctcctgccttggttttcagctccatcaggtcctttaaggacttctctgcattgattattctagttatccgttcgtctaattttttttcaaggtttttaacttctttgccatgggttcgaacttcctcctttagctcggaagtttgatcgtctgaagccttcttctctcagctcatcaaagtcattctccgtccagcattgttctgctgctggtgaggagctgcattcctttggaggaggagaggtactctgatttttagagtttccagtttttctgctctctgttttttccccatctttgtggatttatctacttttggtctttgatgatggtgacgtacagatggggttttggtgtggatgtcctttctgtttgtcagtttttcttctaacagtcaggaccctcagctggaggtctgttggagtttgctggagatccactccagaccctgtttgcctgggtatcagcagcggaggctgcagaacagcggatattggtgagcagcaaatgttgctactggatcaatcctctggaagtcttgtctcagaggagtacccggccatgtgaggtgtcagtctgcccctactggggggtgcctcccagttaggctacttgggggtcaccccactgtcaatattagacagatcaacgagacagaaaggtaacaaggatatccaggaattgaactcagctctgcaccaagtggacctaatagacatcttcagaactctccaccccaaatcaacagaatatacattcttctcagcaccacactgcacttattctaaaattgaccacatagttggaagtagagcactcctcagcaaatgcaaaagaacagaaattataaactgtctttcagaccagagtgcaaccaaactagaactcaggattaagaaactcactcaaaaccgctcaactacatggaaactgaacaacctgctcctgaatgactactgggtacataacaaaatgaaggaagaaataaagatgttctttgaaaccaatgagaacaaagacacaacattccagaatctctgggacacattcaaagcagtgtgtagagggaaatttatagcactaaatgcccacaagagaaagcaggaaagatttaaaattgacaccctaacatcacaattaaaagaactagataagaaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagacctttagcaagactaataaagaagaaaagagagaagaatcaaatagatgcaataaaaaatgataaaggggataccaccaccgatcccacagaaatacaaactaccatcagagaatactataaacacctctaagcaaataaactagaaaatccagaataaatatataaattccttgacacatacaccctcccaagactaaaccaggaagaagttgaatctctgaatggaccaataacaggctctgaaattgaggcaaaaactaagagcttaccaaccaaaaaaagtgcaggaccagatggattcacagccgaattctaccagaggtacaagcaggagctggtaccattccttccgaaattattccaatcaatagaaaaagagggactcctccctaactcattttatgaggccagcatcatcctgataccaaagcctggcagagacacaaccaaaaaagagaatttcagaccaatatccctgatgaatatcgaggcaaaaatcctcaataaaatactggcaaactgaatccagcagcacatcaaaaagcttatccactatgatcaagcaggcttcatccctgggatgcaaggctggttcaacatacacaaatcaataaacataatccagcatataaacagaaccaacgacaaaaaccacatgattatctcaatagatgcagaaaaggcctttgacaaaattcaacaacacttcatgctaaaaactctcaataaattaggtattgatgggaagtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattttatatctagaaaacccgatcatctcagcccaaaatctccttaagctgataagcaacttcagcaaagtctcaggatacaaaagccatgtgcaaaaatcactagcattctaatactccaataacagacagacagagagccaaatcatgagtgaactcccattcacaattgtttcaaagagaataaaatacctaggaatccaatttacaagggatgtgaaggacctcttcaaggagaactacaaaccactgctcaatgaaataaaagaggacagaaacaaatggaagaacattccacgctcatgggtaagaagaatcaatatcatgaaaatggccatacagcccaaggtaatttatagattcaatgccatccccatcaagctaccaattactttcttcacagaattggaaaaaactactttaaagttcatatggaaacaaaaatgagcccgcattgccaagtcaatcctaagccaaaagaacaaagctggaggcatcacactacctgacttcaaactatactacaaggctacagtaaccaaaaagcatgttactggtaccaaaacagagatatagaccaatggaacagaacagagccctcagaaataatgccacatatctacaaccatctgatctttgacaaacctgacaaaaacaagaaatggggaaacgattccctatttaataaatggtgctgggaaaactggctagccatatgtagaaagctgaaactggatcctgtccttacaccttataggaaaattaattcaagatggattagagacttacatgttagacctgaaaccataaaaaccctagaagaaaacctaggcaataccattcaggacataggtatgggcaaggacttcatatgtaaaacaccaaaagcaatggcaacaaaagccaaaattgacaaatggtatctaattaaactaaaaagcttctgcacagcaaaagaaactaccatcagagtgaacaggaaacctacagaatgggagaaaatttttgcaatctactcatctgacaaagggctaatatccagaatctaaaatgaactcaaacaaattgacaagaaaaaaacaaccccatcaaaaattgggcgaaggatatgaacagacacttctcaaaagaagacatttatgcagccaaaagacacatgaaaaatgctcatcatcactggccaacagagaaatgcaaatcaaaaccacaatgagataccatctcacaccagttagaatggtgatcattaaaaagtcaggaaacaacaggtgctggagaggatatggagaaataggaacacttttacactgttggtgggactgtaaactagttcaaccattgtggaattcagtgtggcaattcctcagggatctagaactagaaataccatttgacccagccatcccattactgggtatatacccaaagtattataaatcatgctgctataaagacacatgcacacgtatgtttattgcggcactattcacaatagcaaagacttggaaccaacccaaatgtccaacaatgatagactcaattaagaaaacatggcacatatacaccatggaatactatgcagccataaaaaacgatgagttcatgtcctttgtagggacatggatgaagctggaaaccatcattctcagcaaactatcacaaggacaaaaaaccaaacaccacatgttctcactcataggtgggaactgaacaatgagaacacatggacacaggaaggggaacatcacacactggggcctgttgtggggtggggggaggggggagggatagcattaggagatatacctaatgttaaatgacgagttactgggtgcagcataccaacatggcagatgtatacatatgtaactaacctgcacgttgtgcacatgtaccctaaaacttaaagtataataaaaaaagattatcatttaaaagtcccagatttagtttgcttatagacttttgtccagtagagatgcaaatactttctgttcagaagagaaaaataaccccaaagttataatttattgtcccgtgggacagcaagcagatatgcatctcatccagcaaatattattctgaaatgcctttattaaactcccagtgaatacacaactcttcaaatgctctctagtctgtttgtataatagtttgtaatttcaaactattataggctaaatcaaatttagccttgcttcgctcatagattttttttgtttagactatgttttaggttccaggttttgtataacattttacataatatattgagatagttcctactcttatttttgttttataaatgagaatgattgtgttttaataaggttaagtaatttcccaagatcacgcagttagcaaataatggatttagattctgactcaaggaattctgacttgagatccttctgatatacctccaccccatttttgagaattactgctctagaccttttctgaaaggaacctagactgtttatatctaaacacacaactaccaagtatctgtgcaattcaggtcagaaattacataaagttgcagatctttgaataggaatgtattcaagaaaatagctttttattgaagagggctagatttttaaaaatctgtaagagttaatcagagcttagcgaattgatgattttcctaaaaaataatagaattagacttcccaatgttactagttatcttgataacaattttgctaaaaattcaaaatccactgacaacaataattatgtatgcttgtaaaacaaaaaagccatattctgacgaaatataccattggtaataagggaaaattgctcagtttttattctcattaagtctcaagaaagtctgagtgaggaaaactttaattggataccacttcatttggtaacaccattaattggacagttaacaactttttcaaaaggttgataagtaaattggtcatggtagactaacttatgctgtttgaaaaaataatccccaaatctcagaggctaaagtaacaaaagcttatttcttgcttataagacaaagctatcacgggttcactagaactacattcttcggatcattgtcctccctttggacctggctgatgatgtattaccaatgtccatatcagcaaaaaaagtgagcctgcaattctctcatgagtatttaattgctcttcccacagaggaacacgttacttccagccaacttctccccttagtgaaaaatattgacgttgcctcaaccaaacagaaggaagctagatgtaccgtcatactgttagcagcgggtctttgctcccagagcccccaagatggcagcaagcctcttgcactctgacctggggttcttggcctcaaggattccaaggaatagaaccttgggccatgcagtaagtgttatagctctattagaagccctgggtcacggaagagaaccatggaacccagcgactagtgttaagctagattaggatgaacctgggcacttagctgcacagaataatggcgagcctctagcccgatcaggagtggcattaggcgccttgctggattagaagcgcagcagacaccctgcccgatctggagggatggaagtaagcggcaggtctgcaacgcagggatcagtagtggtggacggcgagtgataactcagctccagctggaacaaacatggaccagcagagtatgcagttgcatgatttaatagagtgaaaacagagctcccatacaatgggaggggacccaaagggggtttcccactccccacttaatggctggggtttatatcccaatcattgtcccttcccctgtgctctcagatgatagatgatgtgactatttctttacctcctgtttttagcctaattggtgttttagtgagccctctttactacctgattggttgggtgtgagctgagttacaagctccgtgtttaaaggtggatgcagtcaccttcccagcaaggcttaggaattcttagttggcctaggaaatccagctagtcctgtctctcaatatgatatgtctggaaagaggggaagtgggatatttggccaaaagagttaaaaaacactgcagtgagctgaatgtttatttccacctcctcacccgcccccaaattcatatgttgaaatcttaaccttcacagctgggtttaattgggaggtgagacttttaccaaatgattaggtcctgagggctttgctctaatgaataggagtattattcttatgaaagaggccagagggagctcatttgaccttttcatcatgagaacacagtaagaagacagctgactatctatgaactagaaaatgggtccccaccagacatgaatttgctagcatcttgatcttggacttcccatcctccagaaatatgagaaataaatttttgttgtttacaagccgtccagtttaaggtgttttatatagcaacctgaacagaccaagacaagtaccacaacatgaaatgaggtgattatgtatacctatattaatatacatctattactatagagtacatcaatttcttgcatatttctgcacatgtgtgaaaaaagagtcacatgaaaagtcttatctttgtaaatatacatatgtgggaatgtgtaaacatgatacaactgtgatacaaataatatagactttgaaagttttcataaatgaaacgcttgttttccgaaactttgtccactgtaataatgttctggcatttataaaatactgcatgtgaggtttttaataattagtaaattcacatatgtgttttaaataacatagtaaaataatctttttaggtaatgtggaacaaattgtgaaaaaaatgcaagagtgaagtagaaatgataaaaataaaacataatttaattgttgtaagtgctttgagtaagggatttatccaaaattggatttcaaactattataggctaaatcaaatttagccttgcttggctcatagactttttttgtttagactatgttttaggttccaggttttgtataaaattttaacttggagaaacagccctagtcaccattaatatggtcattctaagttttttggatgtttcaaaattatcgttatgctaaaagtgcatttgtattatatttaaatgtcttaagttaataggtctgaaaattatctgtatatagacatttaaaacaaatttagaaattattatactggtataaaaagcacacttaatactatgcttcaattgaaccaattgtcacgttttcacttccaagaccccctcccgcttttcttttttccatactgagttctgttcctactgttctgagaaagctatgctcttactgttttccaaagctgggcctccatatttgtgaacatgccatatatttgtcactccattctaaagagaatgcccgattttcctacctattacccaatttgctgttttcccttcatcatcaacataatgtgtactctagtgagggggtggctggaggccaggaacttggatggagctggaggctgttatccttagcaaactaatgcaggaacagaaaaccaaatactgcatgctctcacttataagttggagctaaataaaaacatatgaacacaaagaagggaacaacagacactgaggtctaagtgtggagagtgaggagagtgaggagagggagaggagcagaaaaataactatcgaggactgagcttaatacctggctgatgaaataatatgtacagcaaatcactgtgatgtgaatttacctatgtaacaaacgttcaagtgtacccccaaacctaaaacttaaaaataaaacaaaacacaaaacctgtactcactgctttgatttttaatttcccatttacttctcaactcatgacaacatatctttcacctctaatgtttaaattgctctaacaaaaatcatccaatctaatgattacaaaagtcaagactctctgctaatcctgacttcattttgggatcaatgcaataaatcaatctctccttgaagttaattctcccctagttcccatgacattcccattccaatcttttgctacttgtttatttactttcactgtgtcaacttcaatcacacacttcttaaatgttactgtttctttgggctgtaatgtctgttgtcttcttttcattaaattattgctaaataataccaaccagaaatcaatgttatttataactgatatgacaatgactactaacttgtgtttccagtcctaactgctctcattaaactagatctatattttcagtggccacttagttatctccacatggatgctctacacacatctcaaaaggaacctaccaataaccagtctgtttatcctactttctcctcacaacctgattccatatatttaatgggctatgtaagaattatttttttcttatttcatcctcatcagtcgactcctttgagagtgtttgaaatatttctcaattctttcattttcctagacttttgtgtttttgttttattttctcccctggagatcaatgggcagaccagaatagttttattacagttcaatggcatttagggaaaggagcaaatcatcatattcactgtgacatcacaaaaagaatcacagaaatcaagaggagtttcatagttgatatttaagaacaccaagaactttccctatatcctcactcaggattctctgcttaatgaaatgtgtaagagcacagagaacttattaaatatttaataatatttataatatataataatataaaatatattatttcctcttaaaatgattaacatcatttattggtatctaagtttttaatataaaaattaatttatttgatctcctaatttcttaaagatgccaaatacatggagccttcccctgatgtcctgatggcagaatcccattttgttacaccgtgggtggagagagcagatgccccagtgcctccttgcagctttggacacaacgtgcagatggcatcattatctcttttacatcttggatggattgctgggaaggacattctgttaaatagttattttaaaagatcatttgggaacttatgacttttttttttgctatttccttatatattttatgactaacatatattgttatttttaatttttttctgagttcattcccttagtttatcatgttaaatttctctaaagagtagtagttttctttcatttattcagaatattatattttcatatagagggagatccagcacccataaaacattagaaacactcaaaaggtaatttacatattgttttttaagatttttaatattattgaaaatacattgtggtcattttattgtccatcacaaatgaataaattcatacacaaatatatgataataaaaaatgctctacaagcaggtagaggagtgaaaggactccatgtattcagctaaagactttgagccagtatttgcaggtaagtatcataagccaaatgtctcaaactttagcatgcatcataacatctggagggcttaaaaattcagcttatgttacccatcccagagtttttcattcagtgagtctacagttgggcgtaagaatttgcatctataataacttctcagataaggttactgctgctcaaaatgtgggaactactgcttgaagtcacctatagaatatttggaaatattgaaaaaccaaaagcaacctgaaactagcaaatatagttaatacagacaataatactaataaattgcaatgttaagatatcaattattttaatgctttcatgctaaaaggactaacagaacaaaagtgtttaatgatcaaaataaaacaaaccttttggaagtaatagatgaaaacaaaacctttcatgataacattttgtgttgttttaaacgtacagaaaagtgcgaattaccttcaaaatatacttcacaaaaaggtcccctgcggtgtagacattggaaaaggtcaaaataactattttctctaaatgcttatcatatttgttgctttcacctattttaggtgacacaatttgctccttttttagtgtcttatttccctatttatggcactaccctcacccagccttccagctagtaccacaattctttttttttttttttttttttttcgggacagagtctcgctctgtcgcccaggctggagtgcagtgggctggagtgcagtcacgcaatctcggctcaccgcaagctcggccttctgggttcacaccattctcctgcctcagcctcccaagtagctgggactacaggtacccgccaccacgcccagctaattttttgtatttttttaagtagagacggggtttcagcatgttggccaggatggtctcaatctcctgacctcgtgatccacccgcctcagcctcccaaagtgctggtattacaggtgtgagccaccacacctggccgctagtaccataattcttgtgaacactgactggcactctgaccatcatttttcccaatttatttagtttaaataaatcacgtgttttgccaattgtagttggttatctgtgtgcttttctttcttcttagcttctgcctgtaccttccaatatttcttctctgaagtaaattaaagaagaaccctcacaatatcttctataatgctgtaaaaaatagcattttaacgtggcctttatatactcactcgtttcttagaaaacaagttggcttatttcagtttgaaacataagtaattgatccttaccaaacaggattaaaaatagtagcaactgtaatagaaattttgatattgaccacataacaatcttatcttactttacagattagtctaagatgctaggagttgcaaagagacttaacaggcttgaatggatataatctgtacagattctgatctttatctaaaaaaactgatattcaccctttgatgcaaaaaagagagagagagataggtttgcagagtgggggaaagatgaagagagagagagagaaacgacctcagatttgggcttgtgtaagagttttgtggaattcagtgactgaagggccctggaccagttctttgaatgagagtactggggagaaaagggggctttgagaagtgattacatgaataatgaaatgaattttctgtaatgttccttaagacacaattaagtgattgcatttatttttatttgtgcaatggactgtgctttaataagtgcaaatctctgcagagccttggttgcttgggcctcaggatttataaaagctatgtgttttttatttgttcttaaaatgacattttcttgattttagttattttcagaatgttgagagtgggaatgaaaggcaactttagaatcagaatttgacagtagtaggaaaaaagtgataattatactgacatggtcaaattcacaaaatgttcttaaccttgtggtacttaattttgcatattgaccaaaaaaggccttaacattcttctcagcttaacgttagataggttgtttaagttcctcaccttccttttcttagagcaattaacatagagaacttttaactttctagcctttgacatgtaaatcttttaaaaactcttataagctttacaacctaggactaagtttctccaggatccgggagccacccttttgaaatataatcaccatagagataatgccctgatctccccgtctctaagggaaagtaggagcctaactttggtgggcaccttactccaagttgtaaaactccctcctgtcatgaagaaagtctatttttccttagggtaaagccaattaacaaacacagatgactcgtggatccttctcgccctcatttttaaaagatcgtccacgctttgtcttagaggagttcagctcagactgagttatggcctctcccctatttcaacagccttgaacgaagtctacattgcctgattaactttgtccagtgcattttttactttaacaatatgaagtggcccaaaataaataaataaataaataaataaataaataaataaataaatgaaaaaaaaacgttaatagcactagaaaaactacaggcagaaccgtgttacgtttgacctttgctttattattattgcattcgcacagcttcagttgtttacacttcaaaacatagagtatgagacattttgcatttctgtatttcactacaccacagtcaggatcttttgtgtccccagcttccaggaagcaggaaaatgcaatcttgcttgttttaggaactacccttcgtctgctaacaagggcttatttaagaatcttggttgtcctagtgccaaaaaatggccaaagacataagtacatttcatggagaatgctgtacttttgttcccaggctctacattgctcaggaactcaggtttatactatttttttcctcaggagttactccttcaggtatattaaggatagtaactcacagtagaccctctccttcaccagcagcctccctcccccaccctccaattctaaatgataagtaaaagtggagtcctagactctgctgctggaacccatttcttctcccaatattggaaagacctcaaattcattcccagacctactatttcctcctcccacaggaagaaagtactttattttgcattcattccctcaaggctagaaaaacttcctcaaatttattctactttcaagttctaaaacactgaagaaatgtatctacttttttacctggaggagggttaaggaagataaagcgtcagaccatctgccatggtctgaatgtttgtgtctccccaaaattcatacattgaaacccagtccccagtgtgatggtattagaaggtggagcctttgggagaggattaggtcaggaaggtggagccctcatgaatgaaacagtacccttataaaagagaccccagagagatagctggcatgttctaccatgtggggacacagcaaggagccatttaagaaccagagagagagccctcaccagaccctgagtctgttggcaccttgagcttggacttcccagactccagaactgtgagcaacaaatttctgttgtttataagccgcccatgtattatatttttgttgtagccgaccaaaagagctaagaaccatctttttgagacagtatgttggtgtgtcatttcagggatgaggaaggagcttcaacctggttatattttgtttttaagacactctaaactgatgatacaatttaatgatgaaaataacagcaaatacacatctgacagttctgttgcaaacattatcctaaggcttctcagttgtgtattataatagaatttaaaaaaaaaccaaacatagttttagaagagggagacactcagtgcataagaatatggctactaatatattcctgctcagtgtttgaaaagtattcatttcccctgatatgcacatgattttctacatgtccaaaaacaacattattattaagtatgttgatagaaaaaaaacaataatttatgatcacctcactgtaattgcatacaaaaattaatatgtggaaacccaccaagaagaagttatgtatcttcaaagcgcaattattttattgaattcttagaagaaattaaaatgaatatggcattttattactgaattattctggttttagatcatacctagatacctttaaaggaaagtcatttcgtagctgtgtcttccagaggcttttcaaatatatatttagcttgtgagatttttcttttgaataacctttcccttttaactgatgccctagtctctgattacccactccctggcctctgcccttttctcaaatcatcttactcagcggtaatgaaacagcagccacagaacagcagtgttgcaagactcaaatgcattagcctatcacggaaaaacacaagacctttgtttagatacaagtacgtacaatctgagttctcttttttcccctgtcatgaactctatatatcttgatgactttgaaaactaaactttcttccccttttcttagactaggattctaatttaggtataatgggatttgaacctccctcaagccttttaaagtattcaagggaggcataaaagaaatagcagagagacattcactttttattactctctatgatggggatattgtattgctcacatactaatgtaaattcctctaaaatatataatttcaacccttttattctctcactattccctttccactatcaatttggatttctgagaccttacgcaactaaactaaatcgtttcctgaagcttatgtgccttggtcttttgagtacagtaactgcacaatcgacagaagttacaactaataaatttctctttgtgactcttcctgacaaccagaaaaaaacagtaatttaacttttctggttaaacttgaaccaaggcctaaaaagtagataagtgactcaaactatttatcttactactcctaccctataaccctcacagggaaatgaaatattgccagcattctaaaacttgttgaaagggaagcattcatatttaggaaaaagttacagatagagatcattaaaatttagaaacattccttttcaacttccgcataacttctatctttatagttagtcttgctctgcttaaagctatactgaggaatgtattttaaatttagaaccaattttaccctttcttttataattcaaaaagttggaatatttgttttaataatttctgtaaaaacaaaatgccatagaatttcatattcaggatattagtatatacctcactatcttgatagactcttttagaatcttctcactcctcacatagagaaacagtgcatagacatccaggacacagaagcgactgtaacaattattttgataagacatatatgagatggaagatgaacattatttatgttgaccatagggacagcacagtataattgagttatgataacactaactccttcatcatgtgaacagatgctaagaagcaacatgttcaattactatttgaatacattatctcattctttgcccttaataaaatatcctagtgccacaatttcaaaatgagttgaaactttgatgtactgctgccaacagccacagaacttttaaaagtcactgtctagttattttgcctctaacaaggaaacacatttgctgagaattagaatgaattaatattatacttatcgagactattcatgataaagctgtctcttcaggatctttataaatgatcaacctctcctggatgtgatattttctgctaaattcagaaataatcagaagagacaatctttatctcattgatatcaatgctggttttaatgcctactacagtacctacagacaactaaaccacattcttacaatgttttaatgatgcctactatggtacctaaaaacaatcaacattaggaaaaagtaacagttaaataaatagaaacctgtactttgcactattagaaaaatttatgttttaaataaaatcagcatgtaaattaaataatgaatgcaatatgtgttctaaaccatgctacaatttaaagatttaaacaaatgtgttgagatgtaactaatagaaatacaatgaagcagttcacatacttgaaaaaccaaaaaacttaataaaaaatatatatgcagatgacatttcttgactagtgatacagagaaatgtcctataaaagttgcatagaggcctatgaacttcaataaatatttaaaatctattctttactgagaatagatcttatcataaatttatccatctcttttattggcagaggagagaagcagtacaaatatccttggaatgctttacctttttagcagagggcagctgatacatcatgtagagaattgttcaataggtgctctgagaagacaaaatgtccctatttctttgagactttattcactaatatttcaatttggcaaagtgtgtccatttttttttcttatgtgatgggaagggatttaagaactttattttataagtcaggatctctatttatacaggaaaagtacaattactgtcagtaaaatgaaagtcttctatattcagctggcaaccctaagaggcagttcagagagtttcttaaagcagagaaaggtttaaaattatgaagtgatggatatactttatccaaattcctgctgtcatatttactattatctttaatataccaacacactgttaattgcctaaggaatagaaagtccttggcttatcttgctttcttgcctgcatagaaacctcttaaaactatacttttcttttatctgttatgcctctaacatttctgtcattaacacacacacacacacacacacacgcatatatacatacacacacacacacatatatatacacacacatacatatacttacacatacatttctacgtttggggctttgttatactccaattgcttggagaaaaaaaaatcaaagttttaacgcttgaaaacttttgccaaactttctttttccatatgctctaccattagggatttctttattttcagggactcaaaagtttatgacactccagccctgacctgacatcatgctgaaattgtcaataacccacttttatttctactgttgcccaaatcaacatgtccaacataaaatttgttttgccatccccccaaattctaatacaagttttaattaatggctgtaccacattttagtaatgctaagctttaagcatttttggctcattttttctatcttaaattttagtcagattccaagtcatgtatagtatacattcaaaatgtcttaggcttttgctccccaccttacactcctacactcggtatcttctatcatgtaccatctgttcactataatgtttcctaagtattttacagctgtcttccctgacttcagttcttaataaatgcaatagcaaaataaatcttcctaaactaaagattctggtcatatgcctgtgattgcaaacctttcttttcgtttttcctgtttctctttttttttctttttttttttttttttgagatggagtctggctctgttgcccttgctggagtgcagtggtgcaatcttggctcactgcaacctccacctcctaggttcaagcaattctcctgcctcagcctccagagtacctgggtggttacaggtgcccacccccatacctggctaatgtttgtatttttagtagagacagggtttcaccatgttggctaggctgatctcgaactttacctcaggtgatccgcccaccttggcctcccaaagtgctgggattacaggcatgagccaccacacctggcctgtgattggaaacttttctagggtaccatcacatatggaattaattacagctttctctacctatcctgtaagtactttacctgcactatggtctcttagaaagttacttaactacttaatcccttagttactatttgtaaaagggaataataatatgaaacttttagacatgttgagaagattaaatggctctctctctctccctctttatatatatctagatatatctatcgatatatctattgatcgatagatctatatatggacagattctatatatctagatatatatcgatagatatatatagatatacatatctatatatatggatagatctatatatagatagatagagagagagagggagagagagagagccatttaatcttctcaacatgtctaagactttcatattattattcccttttacaaatagtaactaagggattaagtagttaagtaactttctaagagaccatagtgcaggtaaggtacttacaggataggtagagaaagctgtaattaattccatatgcagtggtaccctagaaaagtttccaatatatctatatctatatccaatatatctatatatatatatctatatatctatatatatatatagagagagagagggagagaaagagggagagagagcaagaagagaggagcattataggtactcaaaaattgacactttattatctacgtttctgacctcactttttaaaataacttattcttttgatttgtttataattgttattacaaataattttcaacatacataaaaattttaaaaatagtgcaatacataccagtaaacctacaaccaaaattaaataactgttaacattttgccatacattttgtatatatatgttgtcttagtctgtttgggctgctatagcaaaacaccatagactggtagcttatgaataatagaaattcttttattacagatctggagacagggaagtctaagatcaaggcgtcagcagactcagtgtctggtgagggcccgcttcttcatagatggccttcttttcactgtaacctctcatgatgacaggagctctctctggtctttcatagcacgaattcctttcatgagggctctgctctcaagacctaatcatctccgaaaggtcccacctcttaataccgtcaccttgggagttaggatttcaacatatgaatcaacgtatgaattttgagtgggcacataaacattccatccactttatatgttaaagtgcaaatgcatgctttttgaactgtttcaaaacaagcggaagacactttaataaagcagatgatactttatccttaaatactctaacatccatctgttattaataatcagaatattctccatgctgcctaggccattatcacatctaacaatattaatcataaatattgagtattagctattatctaagtcttatcacaatctccccaactgttcctttaatgcatttcataactgttttgccttcagtttagtgttattttttaaccaggatgcaattaagtttcatatggttgttagaaatgttctctctctctcttaatttaaaggagctctactggttttttaaaaaaacgcaatgctactttattaaatatctgaaattatggattttaccatttgctaactcagtttttctaaactccatatttctgccaaattggaaattagatctaagaccaaattaaatcatgttagccactttcggtaagcatctttcatgagcttttcataaaatattacatcaagacaaatatatcatggtgtcttaaaggtagtaatgctaaatttgactgatgatttaagatgacctccatatcactttattttatagtttggtaattttctttgcaattagaaaatatgcagtgaatgatacttttactatgttggtttatgaaataaaacatttcttctaaaagtttcagtatccactgagggttctgtaaaaatcaactatttagttataaattttaaaaaaatgtctaattctgtcattttcatacataacaaaatggggtttcttttttcacctcatcaaatcaatatgaactacaatttgtcttaaaaagagaaggtaaaaaattatctccctttaattactaatgctaagaacaaggagttgatatatacctactaggtatacacaaaatttaaaagtaaaaaaaaaaatgactataaaggaataagcagttgaagtaatagtaattttcaaagatagtaaaactttttcctctttttattttagtaacactaagaaatcaggatttttcccccttgctgttttatatttacttatgcccattattctttctcatgctcacattatgtcatatttggccactgagtccattcaggctggctcctgtgtccttttgtcacatctctactagcttttgagtatcaaaaagagtctggcttacatgtactactttttgtcctcaaaatatattgtacttacttactatttttgatactcaaaagctagtagagatgtgacaaaaggatactgtgttaaaaatcattgagaatacgccaggtgcggtggctcacacctgtaatcccagcactgtgggaggccaaggtgggcagatcacctgaggtccggagtttgaggacagcctggccaacatggcgaaaccccatctctactaaaaatacaaacattagctgggcatggtggcacgttcctgtattcccagctacttgggaggctgagacaggagaatcacttgaacccaggaggcggaggttgcagtgaaccaagatagggtgactgcactccagcctgggcaacagagcgagactccgtcttaaaaacagaaacaaaaaataatttgaaatatttttttcactctgtagttttgctatgaacttaatacaagttgtgtttatttgtttagtttgtttccaatttcacaattcaaacatatcattttgaggcctgcacagtggctctcgcctgtcatcccagcactttgggaggccgaggcgggtggatcaattgaggtctggtgttcaagaccagcctggccaacatggtgaaaccccgtctccactaaagacacaaaacaattagccgggtttggtgataggcgcctgtaatcccagctgctcgggaggctgaggcagaaggatccctagaacctgggaggcagaggttgcaataagcaaagattgtgccactgcactccagccttggcgatagagactccctctcaaaaaaaaaaaaaaacactttgattttttaaaatgtgttcaatatgttatacacttacataatttaaagtttatatattcataatctataaaaagctgtactataaaaagttacactttcatttctatcctcttctctgcagtctctaccccaacttcacatcttgtagagatttccctctttaattagtttctggtttatcgttctgatggttctttttttttatggatgtatgagtgtattgttgggtatgtttgtaagtgtgtatgtgcatatgtgtgtgttgcccttccttccttagaaaaaaggctgcatagcttttctcgggcactttatctttttggatatatatagcctaaggattattcaagtactccataatcttccttgtgctttttacacctccttattacacctttatgtagctttatttttttcccaccaagtcaactattggtagtcatttggattgtttccaatctcttaccattatatataatactgctgggaaaagtctaatgcatacattgattctatctgtagaaccgcattttcagtatagagtcctggaagtggaactatgagtcagtggttatttaatgtgatcatgttaaaaacatgaccaaatttcccttgatatgattaaataagtctccacacccaactgcagtgtgtgggagggcatttacagctttgacaactgagtgtgttgtcatcattttggttatttgctggagatataactttaaaaatatattttaataccattttaattattttttctttattatgagtgagataagcgtattttcacatgctacacacatttactttctttttctgaacattttatgcatgtattgtaacctttttattctaccagaactctttttatatcctagagattagctctttgtcttaagttactttctccccttatataacttctaactttactcttatctcttctacaacaggtatcctactgtccaggccaaatttttacatagggaaaataaattaggttccacatgtgtcaaaataaaataattctttttttgcattaaaataaaggaattattttttaaacctagatgatggaaaaaaaaacctattcaataaataaaacagatagtcccttaaacataaaataaagagggtttgggaaagactatttgtatgccaaaagtgagtgatgaagaaaggaaaagcttaagaaagcaatgggaacagactgccttagtagtaaagtggagaggggtccacctccagagtgccagcatgagcttccctgctgatgccatccccagtgaaacgaccataactggtaaaaactataacaaaatgatcattttatgttctacaggcaggaatacaacaaataaggaaacttttgtttaagaaaatgtactaattcaaatgagtgctgagagtctgtgacacttgaaccacaacccattaaccacaacttccagctgactgtgttggaatctctactttcagtgaatatggctgagaagatgaagctaactctcttctcaactcccaatcaacagatattgtatctcactggaaatggaaaggccaccagcatttatctgcttaaacgttgagttgcagaggttaagatcctggttagtgtgactaagagtttacggcttccttttctacacccaaccccaactcatagggcagaattatttaccttagtttcagcaggccaagaatatgtggagaccgattaccttagccctagtttgcttgtactgtgggggtttcacatgcagagaagttcagaggctctcaccttcacgcagggcctggaggagtgactcagagattttgccccggggaaaacacagtccataaaacagagttcccaaaccctctccaagaaactaatttttatttaaaacgtaatgtgaggtagtgcaaaaccaaaggcaatcttgatgacaaagaaaattttgggggtaagtatttaagaggaggctggtatatatagcagagcaacaaactaatccttaggccaattagcttactggagagaaatggggaaaaaagcagctaagaagagcctgggacaggaggaaagtgttaaaacatatctcaaatactagcctcacaaatgactactttggctattggcacagtagtttatctcagaattactgtctttaaaaatctggagaaaatataaaaacataactgaaggcaccagaacatgaccaaagacaggaagaaactgaagaagattcaacccttgaaagaagagaattgcacctagtgagtagaattttttattgtatgactattgcttgagggtaatttctggtcccccgtgcccttttgtgtttgggttgctagagatcaagtacaaagttgcaatttcactggcttaatagagtgtgacaataactgaaagaataactaaaagatgaggggggaaaatactagggcaaatactagaaaggaaacagctgtttgatgtagctcaaaatgctacaatttaggtagttaggcagttagacaggcatgagtggggctggcgagggctcttccctcgtccactaggaatgtcaggtgatggttccgcaatgatcacctggcctcgctaaaagtgattcacggccgggcgcggtggctcaggcctgtaatcccaacattttgggaggctgaggcgggcgcatcacaaggtcaggatgttgcgggacaatcaaacaggagagaccgacaaggttaaggagagcgctttattattaaggtgatcaccggctcagtcagactagggtccaatcaccttttaagctgtttgtggcgggagttacgtgctacgggaagagtacttgcagaagcgagaacaaaggcagttaatcattcttttacatttgttacaccacatgtcttacatccttgggaatacatgtttttgcaacatttgcttatcatccttgtgacttaacagctgcgctagggagagaagcaagaacacgccgtgcctcaaggaacgtgaaatgatagaacacagataagcctctctgggcacagaggagaaacaagcagttaatattctctcaacccaggcccccgggtggggctatattgcattctacctttaaggaaaagaataaatttcttggctattataaaattcattaattttcccttcaaggagatcgagaccatcctggctaatagggtgaaatcctgtctctactaaaaatacaaaaacaaaattagctgggcgtggtggcgggcgcctgtagtcccagctactccggaggctgaggtgggagaatggcgtgaacctgggaggtggagtttgcagtgagccgaaatcgcgccactgtactccagcctgggagacagagggagactccatctcaaaacaacaaaaacaacaacaacaacaacaaaaagtgattcactggcagtggcaccagagagaggccaattcctgatggtccacactgttgcacgaaagtgttaattggatgcaggcaccagggagatgcaacttcctgggcatgttcattaagagacaaaatggcagagtatgaccttccaggggcagttcatcagaaaagtgaagaaagcctcacatggacatgcctacaacttcctaaacacactgtgcgccctcaccttccaagggtaaggagtactttgcatgcaggcagcccaccctaagggagtagtattgagaaagaagacagtctgtgaagtcttaggatcaaggttgaacatcgcacttggccttcacatacccacttggatttcttccaaacgtaccttcctttttttcctgttctaaagaacctttttaaataaacttccgctcctgctctgaaacttgcctgggtctctgtttctgccttatgctgctcagttgacttatttcttctgagaaggcaagaattgaggttgcttcctgacccatatggattcacagccagtaactcggatacctaacacccctaagaaaaatctttacccagctccttaactaatacagaaatagttcatgtataggagagagcatgaggatatagaaggaagcagtagccgcaaggctgagagagcccagcagagactttagctgctgtacactctagggaaggcagagtttagagtagtaatccttccatgtcatctgtctgctaaaggcagaatcaacattctttataaaaagaatccaaaggctcaatagcctatcattcacaatccatttttttaaacatggaaagaaataagaaaatgtgatctacatgttaattttgcactgagctcataaatgttttagccatttctgatagcagagaaataattaaaaggagccaatatcaatatatttaaggagttaaaaaaaaggctagggccacatgaattaacagatggggaacatccatggataaatagaaactataacaaagcaccaaatgaacattttaaaactaaaatttgtattatctgaaatgaaaaatttattgaatttgcttaatattggattagagaaggcaaaagaaactatcagtgaaattgaagtcatataaacagtaatttataaagtactgaaaatacaggagagaacaagtttgaaaataaaatggagtctagatgtcctaggataggagataaagaatagggcagaaaattgtacttaatggctgacattttcccaaacatggtgaaaagtgcaaattacacacaaaaagctcagcaaatccaaagaattaatacaaagtcaaaattgcaacttaggcatgttagctcaagttgctccagtttgtacaaccccaccattgtgcagaccgtggtgagagtggaaaattccactagggttgggaccatgagaaacatcctcctggacaagtcccaggcctaaccgcctgaccacaggaaattcctccttatcagcagccaacctcgctgcccaccccatttcacagtaagcccagagcttcccccgccctagtctgtaaacgaaggcaggctcctgcactagctggtgtccgcctccgcaggtctttgttcaataaacctgtgttgctgttgagctgccaactctctcactctttcttttaccttcaccttcgtttcagagccttacaatgcatatcttaagagataaagaaaatatcttaaaagcaatacaatatcttgtattctatacaagagaataactgtatgaatggtatctgacttccggtcagagaaaacaaaaaggtaggctggaagacaatgaaatgatatcttttaagtgctgaacaaattaccatgaacaacaacagaaatataaaacctgtcagctcagaaatatgttatccatcaaaaatatttttaaaaaatgaaacctaagtaaaaaaagatatttctgaatacaaacctcttattttctttgagtttcaataataattcatttcagtggacctgcatttcagtaaatgctaaaaaaaacacaactgaagagaaattatactgaaaactacactaagaataaagagcaccagatatggcaaatttgtaggtaaagtcttatattttctccttattttttaaaatacacaatttttaaagcaacaattataacacataattataggaaaaaaaatatatagagagagagatatatatgtatatgagtggacacacacacatatacactataacataatggcctggtaaggatatggaaatatagtatgacaagtttttgacattttataagaagtgttacaatattaattctaggtggactgcaataaattaaagattcaatcccaaggacgttaataaaaatggaatgtataaagatatagtcaatagaaaaattaaaataagatattaaaaactttcagttaactgaaaagaagacagaataggaagtaaattatcaataccagatgggataaatagaaaattaataacatgataaacccaaatccaaccatataattgttataataaattaaatggcaataaactaataagtgcatataaaaggtagacattttccaaatagataagtctcaactacagactaatataagagatgtactttaaatataaaatgttgaaagcaaaggtaaaagatgaaaagcagtatgttgtggaaacaaaaagtataagaaatttggcctgattataataatatcagacagaaaaagtcaagatgggaaacattaccagagataaagaaggggatttcataatggcaaaaggaaaaatttatcagaaaaatatattaatcctaaatatgcacatacttaaaagaataattatagttggacatttcaaagattctttataaatacttgatttaaaaaaaatctcaaattcttattaatgatacagaagttgtgaattaaattattaaccactgctatcatttgtatgtttgtctcctccaaatttgatccgtattgttgaagttgggatctgatgggaggtgtttgggtcatgggggtagatccctcatgaatagactaatgttttggggtggtggtgagtgagttccaactctgtagtttccaggagagctggttgtttaagagtctggcacctccagtctctctcttgcttcctctcttgccatgtgatctctgcacctgctggctccctttcacattcctccacgagtggaaacagcctgaggcttttgctagaagttcaagcttccagccagcagaatcttcagctgctgctggcatttttttctttataaattattcagtttcaggtatgcctttatagcaacacaaatttacttgtaagagacccacactcagtatacttcagaatacactattttttcaagtacctttgaatcattatatattttcagaattgaatcaaaataccctatcttttcaactacatttgaatcattaaccaagggtgataacatgctgggctacagaatatatctcagtaaattgtaagagtttgaaatcttatagagtatgttttctgaccatgataaactcaatggaaagcaataaaaataaagtatggaaaaaagtcagacatatttggaaattacacaatgcacttctaactcacccaagagccaaatgaaaaaaacaagagaaattagaaaatacttttaacattaaaaacattaaaaaaaaacaggaaactgttaaagcagtgcttagggaaaaaattacagctttaatagcaattatgagaaaataagaaaaatttaaagttaatgacctaaattcctatctgtaagaagatagaaataaaaagataaatttcaataaaatagagggaagtaaatacacatcagcaaataaattatttaaatttctaataagagaaatcttttataaataaaaatgttgattttttgaaaagataaatgaaataaataaatgcctggaaatactgatgaagtaaaaaggaaataaaacaaacattaccaatatgataaatgaaatagaattatataaatattaaaatgattataatagggtgagcgcggtggctcacgcgtgttatcccagctctttgggaggccgaggcgggcggatcacgaggtcaggagatcgagaccatcctggttaatgcggtaaaaccccgtctctactaaaaatacaaaaatttagcgggccatggtggccggcccctgtagtcccagctactcgggaggctgaggcaggagaatgacatgaatccaggaagcgggagcttgcagtgagccaagatcgcaccactgcactccagcctgggcgacagagcaagattccatctaaatatatatatatatatatatgtgtgtatatatatatatatatatatgtgtgtatatatatatgtgtgtatatatatatgtgtatatatatatatacgtgtatatatatatatgtgtatatatatacgtgtatatatatatacacacacatatatatgtgtatatatatacacacatatatatacgtatatatatacacatatatatacatagatatataattttattctaaaaacctagaaaaactggataaaataaactaattcctagaaaaacacaattttcctaaatgagaaacatttgaatagaaaaccagagtagtcctcatatgtattaaagaaattggtttcactggcatattctatgaaacatttaacgtagaaataatgctaattctacataaactctctaaaactagagagaaagaaacacattccaagtaacattaagtggccaaagtaactctgatactgaaatctgacaaatatattttaagaaaatatgattacaaaccaatatttctcatgaacatgattgtaaaaattattatattagaaaattaaatcaagtaatatgttacaaaaataacatatttgtattaatagatgcattggaagaatgcatgagagtttaaattgtttaaaagtcatgcatcaatacctaattcattgagagtttttagcatgaagggctgttgaattttgttgaaggccttttctgcatctattgagataatcatgtggtttttgtcattggttctatttatatgatggattacatttattgatttgcatatgttgaaccagccttacatcccagggatgaagccaacttgattatggtggataaactttttgatatgcggctggattcggtttgccagtattttattgaggatttttgcatcaatgttcatcagggatattagtctaaaattctctttttttgttgtgtctctgccacgctttgttatcagcatgatgctggcctcataaaatgagttagggaggattccctttttttctattgattggaatagtttcagaaggaacggtaccatctcctctttgtacctctggtagaattcggcagtgaatcagtctggtcctggaattttttttggttggtaggctcttaattattgcctcaatttcagagcctgttattattggtctgttcagggattcaacttcttctttgtttagtctttgcagggtgtatgtgtccaggaatttatcaatttcttctagattttctagtttatttgtgtagaggtgtttatagtattctctaatggtagtttgtatctctgtgggatcggtggtggtatcccctttatcattttttattgtgtctatttgattcttctctcttttcttctttattagtcttgctagcggtcaatcaatcttgtggatcttttcaaaaaaacagctcccggattcattgatttttttaatggttttctgtgtctctatctccttcagttctgctttgatcttagttatttctttccttctgctagcttttgaatgtgtttgctcttgcttatctagttcttttaattgtgatgttagggtgtcaattttagatcttcctgctttctcttatgggcatttagtgctataaatttccctctacacactgctttgaatgtgtcccagagattctggaatgttgtgtctttgttctcattggtttcaaagaacatctttatttctgccttcattttgttatgtacccagtagtcattcaggagcaggttgttcagtttccatgtaattgagtggctttgagtgagtttcttaatcctgagttctagtttgattgcactgtggtctgagagacagtttgttataatttctgttcttttgcatttgctgaggagtgctttacttccaaccctgtggtcaattttagagtaagtgcagtgtggtgctgagaagaatgaatattctgttgatttggggtggagagttctggagatgtctattaggtccgcttggtgcagagctgagttcaattcctggatatccttgttaactttctgtctcgtggatatgtctaatgttgacagtggggtgttaaaatctcccattatgacaaacccacagccaatatcatactgaatggacaaaaactggaagcattccctttgaaaactggcacaagacagtgatgccctctctcaccactcctattcaacatagtgttggaggttctggccagggcaatcaggcaggagaaggaaataaagggcattcaattaggaaaagaggaagtcaaattgtccctgtttgcagatgacatgattgtatatttaaaaaaccccatcgtctcagcccaaaatctacttaagctgataagcaacttcagcaaagtctcaggatacaaaatcaatgtgcaaaaatcacaagcattcctatacactaataacagacaaacagagagccaaatcatgagtgaactcccattcacaattgcttcaaagagaataaaatacctgggaatccaacttgcaagggatgtgaaggacctcttcaaggagaactacaaaccactgctcaatgaagtaaaagaggacacaaacaaatggaagaacattccatgctctcagataggaagaatcaatatcatgaaaatggccatactgcccaaggtaatttatacattcaatgccatccccatcaagctaccaatgactttcttcacagaactggaaaaaaaaaaactactttaaagttcatatggaaccaaagaagagcccgcattgccaagacaatcctaagccaaaagaacaaagctggaggcatcacactacctgacttcacactatactacaaggctacagtaaccaaaacagcatggtactggtaccaaaacagagatatagggcaatggaacagaagagagccctcagaaataatactacacacctagaaccatctgatctttgacaaacctgacaaaaacaagcaatggggaaaggattccctatttaataaatggtgctgggaaaactggctagccatatgtagaaagctgagactggatcccttccttacaccttatgcaaaaatcaattcaagatggattaaagacctaaatgttagacctaaaaccataaaaacgctggaagaaaacctaagcaataccattcaggacacaggcatggacaaggacttcacgtctaaaacaccaaaagcaatggcaacagaagccaaaattgacaaatgggatctaattaaactaaagagcttctgcacagtaaaagaaactaccatcagagtgaacaggcaacctacagaatgggagaaaatttttgcaatctactcatctgtcaaagggctaatatccagaatctacaaagaactcaaacaaatttacaagaaaaaaacaaacaaccccatcaaaaagtgggcgaaggatatgaacagacacttctcgaaagaagacatttatgcagccaacaaacacatgaaaaaatgctcatcatcactgaccatcagagaaatgcaaatcaaaaccacgacgagataccatctcacaccagttagaatggtgatcattaaaaagtcaggaaacaacaggtgctggagaggatgtcgagaaattggaacgcttttacactgttggtgggagtgtaaactagttcaaccatcgtggaagacagtgtggcgattcctcaaggatctataactagaaataccatttgacccaaagatcctattattgggtatatacccaaaggattataaatcatgccactataaagacacaggcatgcgcttgtttattgcggcactattcatgatagcaaagacttggaatcaacccaaatgtccatcaatgatagactggattaagaaaatgtgtcacaaatatacaacatggaatactatgcagccataaaaaggatgagtttatgtcctttgtagggacatggatgtagctggaatccatcattctgagcatactcgcgcaaggacagaaaaccaaacaccgcatgttcacactcataggcgggaattgaataatgagaacacttggacaaaggatggggaacatcacacactggggcctgtcctggggtggggggagcggggagggatagcattaggagatatacctaatgtaaatgatgcattaatgggtgcagcacaccaacatggcacatgtatacatatgtagcaaacctgcatgttgtgcacatgtactctagaacttaaggtataataataataaataataaaaataataaaaagtaaaagtcatgcatatataatattaaaagaggaaaatataaatatatcattacctcaataaatttaaaaaatcatttgaaaattttatcatccattcatgatttaaataactattagcaaattacaaataaaaataaactatttcagtctaataaagggcaatgattaaaaagtacgcatgtaacattagatttcatagtgaaatattaactatgcagtctttaaggtcacgaacagggcatggatgactactctccatcttctatttaacatgttacaagtcttagtcagtataaaccacaaagtttggataaaaagaaatagaaatgcgtctatacacagagaacaagatttacttcccagaagttttatggaacctacagaacagctaataataactaatgaatagagtatttttcagaatacagtatatatgtacatatagtcaatgaatttttatatgcaacagaaacagtttggaaaataaattttaaaaatttcagtttcaacttctctttaagatacagcagttacatgtgcagatttgttacatgggaatatatgctgctgagctttggagtatggatcctgtcacccaggtagtgagcatagtaccctataggtcatttttttagccctcccaccttcctccatcctctagtaacctacagtgtttattattctcatatatatgtcaatgtgtgttcaatgtttagctcccttttgtaagtgagaacatgcagtatttggttttctgtttctgcattaattcgcttctggttatagcctccagctccatccatcttgctgcaaaggacatgatttcattcttttatatggtagcatagtattccaagtgtatatgtatcacattttctttatccaatctataattgatgggcacctggattggtttcacgtttttgttcttgtgaatagcacagtgacaaacacacgagtccatgtgtctttttggtagaccaatttattttcttgtggatatatacccagtaatgagattgctggattgtatggtagctctacttgatgttctctgagaaatatccacactgctttctacagtgactggactaattttatattctcatcaccagtaaataagtgttcccttttctccatagcctcactagcatctgttgttttctgacattttaataatagccattctaatgtgagataatatctcactgtggttttgatttgcatttctctgatgtttagtgatgctaagcattttatcttatgtctgtaggccacttgtatgctttctttggagaagtgtctgttcatgtcctttgcccattttttaacggggttattagttaaattctcaatataagacatttgtcagatggatagtttgtgaacatcttctcccattttgtaggttatctgtttatactgtttatatcttttgctgcaaagaagctctttagtttaattcacttgcgcttatctagatatttttgttttcattgcaattgcttttggagacttagccaaaaattctttgccaaggttaatgttcagaagagtactttctaggttgtcttccaggatttttatattttgaggtcttacattgaaataatttttgactcatgatttaaaagaactattagcagaggtaatttttgaatatgctgaatggtaggcatccagcttcagcctactacatatggctatccagttatcccagcatcatttattgaataaggagccctttctccattgcttgtttttgtctacctcatcgaagatcagatggttgataagttggtggctttatttctgagttttctattcttttctattgatctatatgtccgttttcattctagtaccaagctgttttggttacagctgctctgtagtacagcttgaagttcaggagtatgatgatgcctctggctttattattttgcttgggattggtttggctgcttgggcttttttttttttttttttttttggttccagaggaattttagaattttttttttctaattctgtggagaatattgtttatgatttgataggaatatcttttttaaaaagcacaagtatgaataaatttaagaaaaatgtaaattagttctactctagaaactacagaataatgcagatagaaatttttaaaaagttaggtaaatttaaaatattatcatgttcgttaattgaaagacttaatttttttcattttaattcttcccaattgattcagtccaaatgtcttgatcttaatttcatcatgtttttaaaaatagaaattggcaagcaaattctaaaattgatctggaaaaatcgaaatatttctaaaaatttataataatgttagaggatacacatttgctaattttatgatttattataaagtactgtaatgaaaatgagctattgtgataaaggtatgcacatagattactgcaacagaatagagttcagaaataaacctacacttaaatggtcaattgagcatcatttacaggggtgccaaagtaattcaatagtgaatgtaaaggcttgctgccagattgtgatgagacaactaagtatcactatggaggaaaaaatgaattttgaatcctcacatcataggtaaaattgaattcaaaattaatagacccaaatgtattttttaatggaaaagacaataaaaatgccttcatgtcttgagggttgggaacgttcttaggtcacaaatagcgtagccattaatttttttaaaaaatcaataaagaaggctttataaaaattaagatactctcttcattaaaaatggaagttaaaaaaataagacttagatgggggagaagtagcctccaaacatacatcaaactaaagaattatactcatacatatatttgttcacatatatgtattacatttatacataagtgatgaaatgattaaaaggcaatcaatcctatcttttaaaaaatataagaaggcttaaatgggaacataataattactcaaaaatcttacagattcacatcaatgaataaggagaaaaaactgatataatcttgttttgatttttttctctatacaaaatttattgttcaaacttaaaagttaaatgatagtagctgaaaattaaaattgaaaaataaatcgttgttgggttttttccccaagatggtggaatagaggctttgccagcatgacttatttacctgtaaatagtaaaacagtatatagagattcacattacgaacttttatccatgaaggaacatggggtcacaacataaaagttaaaaaaccattgaatgcttttaaaaataaggcagaaaacagctcacatggcatgtacagcagaagattgagagtaaattctcaatgcataagaaggaaaaagaatgcctttgcaatgcacattcccactgggaagctgggcaactcaggccacaggggaactccttgaccctgctaagccctcggtctgacctggggagcaatcaggagactgtgaggaggattgatactaggaagtgccctgcatgcattcccagacccacatgccaatagaagaccattctttatcctttaattcataggtgactgcacaggaagctgccagcaagcacaggctggagtcactggtttggagactaactggatgggaatttgtgatgtagtctcaagctggggagaagccttcataactagaactgagaggtaaacgtagcataagctccagcgatggacatgggagttggatgtccccacttttgtgagactggatcaggagaagtttagcctgagaactgcagttttgactcaggcagcaaattttttggcctggtgcagtttcacggtctgaagacaaactgcttgtgacttggctaactggtcattcttgctgccagtgtcaggctgtgggagagagccccactgggtcaggagcaggagagtaaagcaggctacactaccacctgctagtctctggagcctgagcttcccctctttccccatgctgcatctttggttcatcagtagttgctgtgctcttctatggaacattattctaggggcctgagaactgccttccaaccacttggaaggctgccacttgtccccactattggccatctcagccccatccaacccaccctagaggcagagcataggactgggaccactgagagttccagggcctaaaccatagcctgggacactcaggtacttctcatggctaacaaagggcaagcataagccctattgccaccaatgcagctgactcccacctgaaagcacaaccttcttgcctggaggtcaacttgcacagctcattacaacatctgctgataccaattcataacatttgcaaaggagacaccctttgcgtgatcttctgctaccttcattgcccattgcaccccagctactgagaaggccttcagctcactcatcctcccagtacattgctattacaactggcatttgaggaagccaccacactaaggctaattataaccaaggaaatcatacagagtatacaccactgaatgcatccagaagaaatgccaaataatcatactttttttcttttaactttttttttttttttgagaaggagtctagctctgtcacccaggctggagtgcagtggcatgatcttagctcactgcaacctccttctcccgggttcaagtgattctcctgcatcagcctcacaagtagctgggtttacaggcatgcaccaccatgcccggctaatttttgtatttttagtagagatggggtttcactatgttggccatgctggtcttgaactcctgacctcatacttaatatatatcatagacacagcctcacataaaaaagtgccatcccaatgaaaagtaaatacaaaagtaagaagtgactcttcccacatatgcaaataaatcaatgtcataatactggaagtattttttttaaaggtactattacacctctaaggaacacagttttctgtagcaatggataccaaacaaaaagaaatattcaaaatgccagataaaaaattcaaaatgctgatttaaaagatattcaaaaagatacaagataaatctgaaaacccatacaaagaaatcagaaaatcaattcaggatatgaatgagaaatgtaccaaagagatagatatcttttaaaaagataaacaaaacttctggaaataaaaaatttgttgaaagaattacaaaatacatttgaaagcttcaacagtagaatagaccgagcacaagaaagaatctcagaatgtgaaaacaagtcttttgactttatccaatgagacaaaatgaagaaaaaagaattttaaagaataaacaaagcctttgagaagtatggaactacatgaaatgaagtaaatatatgaatcatatgtattccagagggagaagaaatgaaacatctggaaaatctatttaagaaaaagctttcttagtctagcatgagatttagacatccagatacaagagtcccccaaaattccagcaaagtatattgcaagaaggacctcaccatgacatgtagccattagactctctaaagtcaatatgttggaaaaaaatttctaaaaccagaaagagaaaagcgtctcattgcctacaaaagaaaccccatcagactaacagcagactcttcagcagaagccatactggccagaaataattatattttcaaagtgcttaaagaaaaaaactgtcaactatatattctgccagaataaccttcatgaaaaaaagaagaaataatgtgttgggcgacaagcaaatgctaaggaaatttgtcaccatgagactggtcctacaagaaatgcccaaaggtgttttaaatatagaaataaaaagttgataccagccatcataaaaacacaaaattataaaacttacaagttatataaagcaattacacaaaggaggaagataaatggcaacatgagaaaatgctatcaaaccacagacaaacagaggaaaaagagaaacagactcaacaaagcaactaaataatgcttaacattacaacaggaacaaatcctgtcagaactaaccttgaatataactggatttaatgctccacttaaaaatatagttcggcagtgtggatttaaaaaaaacatgaatcaactacatgctgcttacaagaaactcagcttattggtaacagtatttataaattgaaggtagagcagtagaaaaagagattccacacaaatgaaaactaaaagaagctatacttatatcagataaaacagacttaaaatcaaaaacagtaaaaaaagacaaaaaggtcattatataatgataaagggatcaatataacaacccaaaatacatatgcaccccaaactggagaacccacattcgtaaaacaaatattattagacctaaggaaagggagagacagcaatgcaatcatattgggtgacttcaataccccactcatagcactggacatgtcattgagatagaaaatcagcaaagaatcacttaacactttaacaggactttagaccaaataaacctaacagacatttacagaacattctactttacaaaagcagaatatgcattgtcctcagtgcatggaatattctccaagagaggccatatgttaattaacaaaaccagtctcaataaattgcaggccagacacggtggctcatgcctgtaatcccagcactttgggtggctgaggcaggtggatcatgaggtcaagagattgagaccaacctggctaacactgtgaaaccccatctctactaaaaatataaaaattagctaggcatggtggcacgcacctgtagtcccagctactcaggcggctgaggcaggataatcacttgaacctgggaggctgaggttgcagtgagctgagattgtaccactgcactccagcctgatgacagaacaagactccgtctcaaaacaaacaaacaaaaaaaagcaaaaaaaatcaaaattagattaaataacttcttgaaatacagcagtataaaactagaaatcacttccaagagaaactcttgaaactataaaaatacatggaaattaaacaacatactactgttgttgtgtcaacaacacaattaagaagcaaaattttaaacattttgaaacaattgaaaatggaaataaaacgtaccaaaacctttgggatatagcaaaagcagtgctaagagagaagtttattgcattaaatacctacatgaaagaaatagattataaattaacaacctgccattacctcaatgaactaaaaaaataggaacaaataaaatccaaaactactagaagaagagaataaccaagatcaaaacagaactaaaggaaattgagaataaaatataagggctcaacaaaataaaaaattggttgttaaaaataaacaaaattaaaagaccatcagttggactaaccaagaaaagaagagggaagatttaacaacaaaagcaaaaatggacaagtgggatctaattaaatttaagggcttctacacagcagcagaaattataaatggagtaaatagacaacctatggaatgggagaaaatatttggaaactatgtatctgacaaaggtctaatatggaccgtctataagaaacttaaatttacaagagaaaaacaatctcattaaaaagtaggcaaaggacatgaaccgactcttttcaaaagattataaacatgtggcaaacaagcatataaaaaaagctcaatatcaatcatcatcagagaaatgcaaatcaaaaccacattaagataccatcttacaccagtcagaatagctattattaaaaagtcacaaaataacatgctggcaaggttgccaagaaaagaacatacctatacactattggtgggagttaaaattagttcaaccattgtagaaagtggtatggtgattcctcaaagagctaaaagcagaactatgattcaacccagcagtcccattattaggtatatgcccagaggaatataaatcattctaccataaagacacatgcacgtgaatgttcactgcagctctattcacaaaagcaaagattaatcaacttaaatgcccatcaatgacagatcggataaagaaaatgtggtacatatataccatagaatattatgcagccataaaaaaagaacaagatcatgtcttttgtgggaacatgggtggagctggaggcttattatacttagcaaactaacacaggaaccgaaaaccaaataccacatgttctttcttacaagtgggaattaaatgatgataacttatgaacacaaagaaggaaacaacagtcatgggagtctacttgagggtggagcatgggagcagacagtggagcagaaaagataactattgggtactgggctgaatacctgggtgataaaataattggtacaaaaaatccccattacacaagtttatctatgtaacaaacattcatatgtacccccaaacttaaaataaaagttaattaaatgagaaatagaaaggggtctcctttacagttgataccacagaaattcaaaggatcatcagagactactgtgaacaactatatatacccacaaatcagaaaacctaaataaagtggataaatttctgggaacatacaactcccaagattcatgcaggaagaaatagaaatcctgaatagatcaataacaagtaatgacactgaattagcaataaaaaatctcccaaccaaaaattcccaagactggtcaaattcacagatgaattctatcaaatctacaaagaaaaactggtaccaagcctccagaaactcttcaagaaattcgaagagaagggaatcctccataacccattttacaaacccagtattttgatgtcaaggccggaaagggacacaacactaacaaacaaaagtaaactacatacccatatctctgatagatatagatgcaaaaatcccccatatctctgataaatataggtgtaaaaatccccaccaaaaaactagtaaattgaatccaacagcacatcaaaaagataatataccataatcaagtgggttttattccagggaaccaaggatgggtcaatatacacaaatcaataaatgtgattccccacataaacggaattaaaatttaaaaccatataatcatctaaatagatgcagaacaagcatttgatgaaatggagtatctcttcatgacacaaaccctcaacaaaccagacatcaaaataacatacctgaaaataataaaagccatataaggcaaacccacaacccacatcatactaaatgaagaaaaagttaaagaatttatcctaagaactggaacaagacaaagatgcatactttcaccatttctagtcaccatagaactagaagtcttagccagagcaatcaggcaatagaaagaaataaaaggcatccagattggaaaagaggaagtcaaattatctgttagttgacaatatattcttatacctaggaaaggctaaagactcctgcaaaagctttctagatttgatacatgactttaataatgttcccaaatgaaaatcaacaaaaatatcagtagcctttctatatacaaatgatgacaaagagatacaaataaataagtcaattatgtttatgataactaaaatattaaagtaactaggaatatatttaaccctggaggggaattatctctataaggaaaattacattacactgatgaaacaaatcatagatgattcaaacaaatgaaaaaaacatcccatgatcatggattgcaaaagttaatgttgttaacgtggccacactatccaaagcaaagtacagatttatgacattcctttcaaaatatcatcatcacgttttacagaataaaaacaattctaaaattcatatggaaccaaaacagagcccgagtaagccaatgaaattctaagcaaaaagaataaagttggagacatcatattagttgacttcaaattatactacaaggctatagtaacccaaacaacatgatcctggtgtaaacctagacctatagatcaatgaaacagaataaagaacccagaaataaagtcacgtaactatagtccattgatatttgacaaagctgatgaaaacatacactggaaaaaggataccctattcaataaatggtgctggccgaactggattgccatatgccgaataacataactggatccttatctctcattatgtacaaaaattaacttaagattaattaaagatttaaatgtaagacttgaagccataaaaatactaaaagaaaacttaaaagaaatcttggatatttgcctaggcaaagaattcaaaagcaaatgcaacaacaacaagaaaatagataaatgagacttaaactaaaataatcaacagggtcaacagacaacttgcagaatgggagaaactatttgcatactatgcaactgaatagagactaatatccagaatctaccaaaaggaaaaaaaccattataaaaagatatctgtacttgtatgtttattgcagcactattcacatgcctttggtattttaataccaaattcaaaacatgtatagaactggaggccttatcttaagcagaacaacttagaaaatcaaatactgcaggttctcacttaaattgtgaactaaagaatgtgtacatatggacataaagtgtccacaatagacactggagtctcagaagggtcagaggtgggtgagggatgagaaattacgtaataggtacaatgtaagttattcaggtaacgggtacagtaaaagcccagacttcactatacaatatatccatgtcacaaagctgctctcacagcccttaaatttattcaaataaaaaataaattgaaaaaaataaactcaaaaattaaaagagcagaagtatataataactttaaaatagtctggttttttttgaatttgctttgcaatttacaataattattttgagaatggagtgcatattatgtgttaactattaaaataaaatgcagtaaattttacccttgtgctattagtcataaaatgcctttttttttctcattggttttcaataacaaaaaacctcatttgattcaacttcacctacatatgaataaagtagccactatcttttaagggaattgggcttcaaacacaactggacaatttttacatattttaaaagaaaagcgtgtctatgaaagaaacacttctctagaatgaacatttttacaaatacaaaaaaagaagtttcacaccctttctacaaagatgaaatagagaacagagcctaccagtatcaatcatacagcctcagttttctaagttaaaagacaagaatgtatttattcaaaatgctcaatgtaggaccaagacaaagaagacatgcacacatgcacaaacacatataactatgtaaaataaaatttaaaactgtataatatagacattaaaattaatgcttttatatatctatatgttacataaattgacaaatttatgtactttatgtaatcaattcagaacatcgtcaagatcagattcagatatgtgagatatttaaacagatctgaaaaaatgtaccacctcaaataacatctgttaataagttctcctgtgtaataactgctttcaaagtcctttctgttgatctctgggttcattcaagtttatactatcaagtgccataaaaagaatacaagatcagaaagggtatccattactcatttgtttatttagcaaacttttatggaacacttaatgctatactctgtactatgcactgtgaatacagacataaatatttaaaaccataagtttaagcatttcaatacagaaataactaaagtttaactaattctaagggaaataagtgttttggagtgtaacaaattcttaatggctaaaagcaatgctttgcaagtcacaaaagaaaaatttttactgatagataaaatggggagaatagaaaacattgtattacctgttaatgtgacagacattgttaaataacaatgtgattaaacaatttttttcacactctcaagaactgtgaagcttcagaaattttgctgtaatcacaagctaagagtaaactcataagcatttcaaggttttatggagattggcagaagaaaaaagacaaggtaagagaaaaaggacctgattaactctattactcacggcagagcaggtagcatgaggttcataatattgtgtttattccccttgtctaattgatggtgatacatataaacatagctaaatgttatcttattaatatccttgttgtattgaaatatagtgcccaaataattatctgcaatgctaattttttatgtatgtatactggaggtttcttaaatatatacatacacatacaaacacacacacagacacacacacacacacacacacacacacatatatatatatatatatattttttttttttttttttgagatggagccttgctctgtcacccaggctggagtagtgcagtggcgcgatctcagctcactgaaatctccacctcccgggttcaagtgattcttctgcctcagcctcccgattagctgggactacaggtgtgcaccaccatgccaggctaatttcccaggacaatgtggagtaatccaagtggatgactctttggttcattacaacattcatgaagagggaattttcagtgtcaaagttcattgaacattgatgcatttaaatatataatctcaccacgcaaactgtggtaattgttattacaagaacaaaaatgacaaattgtgaaacaaaagcaacaatcaaaatagtaacatattttaagtatgtatatgtggataactattctaccaaaattcaaaacaaaatcaattagttggcagttagaagggagaggtgaaaataacgagggcattattattttatctttctcagagctgaatacaaaatatgcacattggtgcatatttatttgaagaccaatttttcaatgtggttccatatgtctcacaatgtatttaattgactaaacagttctacatctaataataaatcctacagaaataattgcatacccttatatgaaagagatttaaaaaaaacttcagtgaaaaatatttcgcaataacaaaattctggactcgcatgaaattctaaacaagaatttggacaattgagttaaatgtgtttgcactaatggaacatgtaaaaaatatatcaggaaaaattttagatgtattcatattataattccacttatatctgtactttgtttaattttaatgagtattctaatataaatgtaatactatatatttatatgtatgtactatatataaatatatatacatatataaaataattgctacatttatctttcttatacagcaataaaattgtatctagttgcagggttcatgagtggcaatctaaattatatttctataatataatctatattataatataattataatataatacttataattatattataattataatataatacttataataatattataattataatacttataataatattataattataatacttataatactctcattgaaagtagatttgggaaggtgatgacattgtcccatggaatatgacttcacatctgaggctagcaagtgaaatatcggttatgactcacctgcaatttcctcctcctggattttggagctatgtttcatgaaaataaagcaaagcttggagggaagggaagaacaatgattgaatgacttcacgagttacagctgttccacaaacctgggcaggtcttacgaccatcaaatattgaaaagacagaaaaacatctaactgtaatgccataaaaccatctatcacaaatccacagccaaaatagtactgaacggggaaaagttaatagcattcccgttgaaaactggaacaagacaaggatgcccactctcaccacttctattcaacatagtactggaagtcctagccagagcaatcagaaaagataaaaaaaaataataaagggtggtaaagaggaagtcaaactgttgctgtttgctgatgatatgatcaaacgtttacctagaataccgtaaggatgcctccaaatagctcctaaaactgataaataaattcaacaaagtttcaggataaaagattaatgtacacaaatctgcagctctgctatacaccaacagcgaccaagctgagaatcaaattaagaactcaaccccttttacaatagctgccaaaaaatataataaaatgcttaggaatttacctaaccaatgaagtgaaaaatgtctgcaagggaaactacaaaatactgctgaaggaaatcatagataaacaaacagagacacatcccattctcatggatgggcagaatcaatattgtgaaaatgaccatactgccaaaagcaatctacaaaatcaatgcaatgcccatcaaaataccaccatcattctttacagaactaggaaaaaaatcctaaaattcatatggaaccaaaaaaaagcatgcatagccaaagcaagactaagcaaaaagcacaaatctgtaaccaatagcaaagacttggaaccaacccaaatgtccaacaatgatagactgggttaagaaaatgtggcacatatacaccatggaatactatgcagccataaaaaatgatgagttcatgtcctttgtagggacatggatgaaattggaaatcgtcattctcagtaaactatcgcaagaacaaaaaaccaaacaccgcatattctcactcataggtgggaattgaacaatgagatcacatggacgcaggaaggggaacatcacactctggggactgttgtggggtgggagggaggggggaggggggagggatagcattgggagatatacctaatgctagatgacgagttagagggtgcagcgcaccagcatggcacatgtatacatatgtaagtaacctgcacaatgtgcacatgtaccctaaaactttaagtataataattaaaaataactaactaaataaaaattattcaaaaaaaaaaaagcacaaatctggaggcatcacattaccttacctcaaactatactaaaaggccatagtcaccaaaacggcatgatactggcacaaaaataagcacatagatcaatggaacagaatagagaacccagaaataaagccaaatacttacagccaactaatcttcaacaaagcaaacaaaaacattaagtggggaaagggcacactattcaacgaatggtgatgggataattggcaagccacacgtagatgcgtgaaactggatcctcatctctcaccttatacaaaaataaactcaagataaaggactttaagatctaacattataaaaattctagaagatgacatcagaaaaacctttctagacattggcttagtcaaagacttcatgaccaagtacccaaaagcaaatgcaactaaaacaaagataaatatatgggacttaattaaactaaaaaactctgcactgcaaaagaaataatcagtagactaaatagacaactcacagaatgggagaaaatcttcacaatctatacatctgacaaaggactaatattcagactctacaagcaactcaaacaaatcagcaagaaaaaaaacaaacaattccatcaaacagtgggctaaggacacgaatagacaattctctaaagaagatatacaaatggccaacaaacatataaaataacattcattatcactaatgatcaggaaaatgcaaatcaaaaccacaatacaataccatcttactcctgcaagaatggccaaaataaaaaaaatcaaaaaataatacatcttggtggggatgtggtaaaaaggcaacacttttacaccactggtgggaatgtagactagtaaaaccactgtggaaaacaatgtggaaattccttaaagaactaaaagtagaactaccatttgattcagcaaccccactgctgggtatttatctggaggaaaagatacaaaaaagatacttgcacacacgtttatagtagcaaaattcgcaattggaaaaatatggaatcagaccaaatgcccattaatcaatcagtggacaaagaaattgtgagatatatatgcatacacacacacacacacacacacacatatatatatgtgtcatggaatacaactcagccatgaaaagggaggaaataatggcattttcagcaatctgaatagaattgaagaccattattttaagtgaagtaactcaggaatggaaaaccaaacattgtatcttttcactcataagtgggagctaagctctgaggatgcaaaggtataagaataatacaatggactttgggaacttgggggaaagggaggcaatagggtgagggataaaagactacatattgggggccaggcatggtggctcacgcctgtaatcccagcactttgggagaccgaggtgggcgggtcacgaggtcaggagatcaagaccatcctggctaacacagtgaaaccctgtctctactaagaatacaaaaaattagccgggcgtggtggcgggcgcctgtagtcccagctactccggaggctgaggcaggagaatggcgtgaacccgggaggccttgcagtgagtggagatcacgccactgcactccagccggggcgacagagtgagactcgtatcaaaaaaaaaaaaaaaaaaaagactacacattgggtacagtgtacactgcttgggtgatggatgcagaagaatctcagaaatcaccacttatttatgtaaccaaatcccactggttacacaaaacctattgaaatcaaaaaagaaaactaactctacattatgtaggtcaaataattatgaggtcttgttaaagcagcttagctttccttaaaaagaaaaaaaacatgaagttgaatcacctatttttaaaaaagtatgaaagggactatgaagtgatacagaatataaatcacagtgaggatttgcatgggttttaatgcataaaattatataaaatagaaatatacagcacaaaaaaaaacccggataaacatgggggagcccacacaaacacaaatgaagacataccctttaataaactatttagtcttcagcagattaagtaaacaagtgtaagtataagatgtgagtaacacgtatgcaggcctgaaaaaatgagtactgtcataacttgttgacccaacaattcttctagcttaaataattggttggtttaaaaaattaatcaggcatgtgtgcaaaaatgtacctgcatttagcagtactgcgtatgacagggaaacccttaagacactttatatccaaagcaacctattctgatattcagcttattttaataaagcaaaatgcttgtttacctctcttattaaataattcagacccaaatctttttgctttcagttccaaatttaatccttttactcccaattccaaattcctggggaaggaagtctgatctacccaggtttgataaaactacctcattttgttgggatacaattgtccatgggtctctcatgtttctgcatgtcatgtgcccagagtcaatattctggacaatcttcacaaggatgtttgtcttccttcagcgtaaatgacagatttgttagctatttgggaaaaaaaaagtctccctcaagggcaaaggctgggcaagtttgctagtatatctcctataaaagattaggattacctaaacttggattttccagctgtgatgcaaactcactacatgtatagcatctacaaggactgtctgcattgtcctggaaacaaggagaactaaaacaaatgtgaagttgtgatgcctgctgtgccatgaaaaatcaagtccattgtttctgactcaagtatcccttagatcctaccagaatttatgaaactttagcaatctaacatgcaagtttacaaaaagcagaaaatagcagaccattcccagtttttgacatcgtgtttaatttgaatattgtattaatgcatagggcaaagatgattgcctggcatacatgcacacatacacacacacacacacacagcagtaagtaatgtactaaattatctatgtgcaatggaaaatacagatgaaaatataatatgtttttaaaaagtctggaaaaatgatgaccaaatgggtacagtaattatctttgagtgttagaattttctttgtttcctattttgtcttttcaaataagcatgtatatttttataacttataccatctcatttgaaaatgtgaaatccttacaattgtgatacatcattaaagtgatattagtcatcacaatgttgtcagtaatcaaacactgcatagggcatttcttccaaatcactatcctaagcttaaaaataacatttgatggagttcatttcttcagcatttttctatatccagttagatgacattacaccttctttatataaatattttttctctctttatattcttttgtacatctatacatttgctcatattttaaatattttaattatttatattcaataggctaccaaattgttttaaataataactttgctgctaagtatacccctgttaggaaagtcagaatattatttaccataatcacttctaggtgttcttgaagcaatgaaggcaataacaaaaatattggctgtaaattgtatagtccattaaaattcaagataagaagtcagattgtatgaaggagctagatgccacatatgaaaattcgtcctagaggagtagtatgtggtaacacattgttctcattacaatgtaagctatgcattaatatgatggaccatttattttaactttgtggcatgaaaattaataaatcatgagcaactgcaaactggtgattttttctttaggcatattttcaaaatatttttaacctggtttttttctggtgctcttcagctaagtcttggaatctactgtgtgacttatgatcaaattgtgttttttacttgatatatacagaaattgtccctcaaattaattttccaaaatatgaagaatatgaaaactttactttgcaggaaatatacttctaaaaataagtatttccttttagaaaagagggggaaaccaagaaaatattttaataaacacgtcttataaatagggacatgattattaatgattaaattctcattgtataaatgacaatttgtagatacagaattaagtaatttgtctaaggttagacaggtaagaattaatagggtcacaataaaatccatgtcttctcattatgtagatggttttccacatggcatttcatagctggtattgtcatgttcatagtaaccctgtatccactcttaaaatgttacaacccttcctcttctaccacatctcaggtggaaaaggagagtgccaagcatgggccatcccttcacctgcatagggcaccaattcacctcagcctttcattagccacggaccaaatccttcatccagttaaagggtagccaatagggacctcacaaggagtacagaaaaccaagaaacctggaattgggcccttgagccgcttgctctggcccactcccaccctgtggagtgctttctcactttaataaatttctggtttagctgcttccttcctgtgtttccttcctttgttactttgtgcagttttgttcaattctttgtccacaacatcaaggacctggacaactcatagtcaccaccttgcttcctgtaacaaaaagacactgcgtaaccttaaatagaagctcacttgctcaaagagtgctctccagaatatgattggggcagattgccatttacttcatgttgccatgttttcttgtggaacatttatgcaaatgctcacaggaggttggagatagtttgaattatggtcaggacaacttattttatagttcaaaagcagcagcctggtcttcactttatgaaatgatatatgatataggtgctgccacctcgaataaacctgaaagttacacagggattctgtggacagaaaaagagtattgccttgaaagaaaaatgccgtaccgtaagacagagctacggagatttttgcagaaaatacaattttctgacaaggttgtctcatcttgacaagacatgaattaggtgttaatactgtaattaggcgtctcattactaataattaaaaagacattgtttacctcaaaaattgattgcaccaatatttgatttacaagaaaataaaggctttaagacaactgcttcaagcagaaagcaacattgtattttaaaagttaaacctagaaatgcttgtttttagaaaatagaaaatatatctttgtattaagacagttgacactttcattgtgttttaaactccctgttttatacatgtggcttatatatgtgtgcccacaatagtgtgtacagggttgaattttgttactaactttctttaataagaggaaaaaaacactaagaattgcaattcaatagtttatgtattacatgcatatcaagatgaaaatctattaaaattggtcaaattactctgctatgaccatgaccattaaccaagaaacactgggtttggcctagtcttaggcatcaccggaaaatgtaaagaatataatgaatcggctcattcttactctgtccagtttaattctacagaaacaaggtaatacaaaatattcatccaagagtataaaatttaatgagaaagattttcagatacacagatatgatgcaatataaatattctaagtatgctattctaaatacgctatgctattcctcagaaccttttcagacttgcgcccctccgaagtcaggttgtctcttccccgaagtcaggccatctcctcctctaccaaatgagactccggtctttataggcacaggatggggagtgcattctgactggtttgtgaatatgcaaaaatggttaaagcaaagacaccactcaaagttgggcacaacagtgtggagaaacaattaggaaagggtaggtatatgtaaaataggtgaagggtggggattgataagaggaaagtgcaccgaacccagaggacaagttctcaatctggtccaaggatttaactcgtaacttggctttcaggctttaaggtgccttcagcttggagatggggtttcactaggtacctgtccctatctgcctaggcatttggctgcctcctgctactatcaattccataacagaaaaagacatgtagcaatgtgtgtgtgaaataaaatagtgtgtgaatgtgagtctaagaaatatccttaacattctcagctatagaatatatacgagctgtagcatatgaggcacaaaaggtaggtggagtatacttcataaagtgtcttagttaaagagataagagtgtttgtggaagcatgattaatctacttcagaaagatagctttagcaccagtgtgaaaatgatttgattgtgaggatcctggtgatgttaaaggacgaggaagctggaggaaggaagttgggggattatggaaactttatgttcagcaacgaattaggatcctgcacaagcaaggaatgttaaaggccagaattaagacaatagtgaaacaacaacagaggaattaatgttctggaagcagtgaatgatcccagtggaatttctgaatattgtgtatatttgtcagaatgtagcaccaactatgcaaatgttcttgcaccaaaaacttgcaaaccacaaaggcaaccccttaattactaatgccagttagtgccactgcagtaatttcctgagtaagcaatgagttcatttctctggcaagttatctcaaagcatggaaaggctgaggcatttcaggacccacgccctgcaaaagaaactgaaatgctctaaggtaaaacagaagacaactatgcaacaagagagccaaattctcaaaggcaatggagtgtagcacagtttgcatccaaagatcaaattcataaagccacacatcaaaacaactattagaagaatgcattctaaaatcatccgcaacaccactgacacagtcaaaatattcataaaccaaacaaaacaatgttcaagcacccacaggtccctatcaatcttttgaagtgcaaaacagccaaggaaaatgcatttttaagataagtgcacctaatatgactttgtaaagtaactttatgtcctaaaatgccagtgttataggtaataaatataaaatcaaggcaataaatattccttcaaacatgcagcagcattgagcagcattcccttttggtttccagaatatgatttccaaaactgcagcagggaaaatacttactttgaacctcctgcctctccaaatccaacataagctggtctggattggaacaattgtcacctatagtctcagcatggaatgtgactgttttcaagattcctttcatgatgctgtcagcgtgaaaacactcaattgtgtcctcagcttgatctttaaatgtcatttttaaaacagatttgaagtaaaagaataccattctctccatttgttcaaaaggagatatttccttcataagtttataaaagtctaggtgttaatgaattactcacctaatatagactccttaaggcatcagcagcagcttgcatcaggcgccctagggagtataggggacttagaaataaagaactatttacctataaatcttgtgcacatgttttcagaagggcaagacttgttcttggtttcaggtaaggtcaacaagcttaaaaaatgacaattcttggaatttctcagtgactctatgagacctatgtaacagccacttaatatatatgttaaataatgttttctgtgaaatttctttatatattaagaagggctttcctgtatttcttattccactggattcctggaaggggactatcccactttggcaaagctccatgaaacgaataaccttgggaaaatgtgcataaaaatgtattactgaaggcattatgttccaatatatgagcctttagtttctttgcttttcaggggctcacaaagctatatattttcagagaactaattgtgttcatttattgcaaattttataatagcaagctaaatatgttggtattttagaagatgaatttgaagaagtaaattgtagagatctttgagaggcaatgtggtctgcattacaatgatggtggtaaaataaatggaaagacttggaaagattcaagaaatgtttgatagacaatgacaagtaaattattgcatgtagtggatgagggagtacacaaagaaaacctcattgttttgggcttgagtaactgggtgattatattaataaccatgagaaaaaaagataaaatctagtacgggaagtattctaataagtgtcttttcccagataaggaataattgagaggaaaactttcctttttgactcagtcatggctttagcagaaggcaatatgacataatagatttcactgtcaacagacaagtttttaaaattttcatctagcagttgactcgtgtgtaatattagtaaagccatttgacttatttgaaacacattttctttctttctttttttttttttttttttttttttttgagacggagtctggctctgtcgcccaggctggagtgcagtggcgcaatctcggctcactgcaagctccgcctcccgggttcacaccactctcctgcctcagcctctggagtagctgggactataggagcctgccaccacgcccagctaattttttgtattttttagtagagacggggtttcaccttgttagccaggatggtctcaatctcctgacctcgtgatccgcctgcctcggcctcccaaagtgctgggattacaggcgtgagccaccatgcccggcctaaaacacattttcatgatctctaaaataaataggctgatgagaccaccccctctaccagttgctaggagaacaaaattagatcgtgtataaagtgccgcttgaaaatgtctatctagtctcaaactctcctgcctttttctagatgtgttaatatgtaggtgaccaaagcaaattgtattaatagtttaaagcagcagtccccagttttttttttttggcaccagggaccagatctgtggaagattatttatccatggactgggggtgagatatggtttttgggatgattcaagtgcattatatttatcatgtactttatttctattacaattacattgtaatatttaatgaaataattatagaactcactataatgtagaatcagtgggagccttgagtttgttttcctgcaactaaatggttccttctgggggtgatgggagacagtggtacctgaagtgtgttgcttacgtccagtctactccaaaattgcttttcagttgttgtcactgcagaaaaccgtgcttcacaaagatagcatgatggaaatggaagcaggcttctcagtgcttttgtggcaatctcaggatattctgccttgactttaatctgaaatgtatggagatttgaagttgtctcaaacatacttttaaggccaccatcatttgtgatctcaagagggtgatcctcttctagcacagacaaagttgattaacctggcttattcacaaatgggctgcagatccattccttccaagtttgggggttttctgtggctgggaagtaatgctcagatgcttgaaagctgagataggtgatgatgtaccaactgggagaaagaagaccctggctcagtctctttcaaaatctctgctaatgtttgaaacatgtcaaaaatcccaatgctcactcattgccctcataattcccatttggctttgaatgcctccactttatctgctgactggaacagttatcatttgcccctgacgtcacagcttgaattcgttgagcaggttgaatacgtcacacaagtaagcaagttttgtcacccattctgtgccactgagttgtgcttccagtggtgactgtttttctaaaagaaatctctggagtggctcttataactccaaacctctggccagtgatctacctttagaaagtcacctaacttctgcagataaaagaagaaacaagtgctctgcctccatctcctcacagagctgcatgaagagacgtgtgagttaagggtgtatagtttagtgtggttgataattttaatcacaccctgcaaaaggttaagttcaggtgacatttttgagttagccagcatttctctatggatgacacagtgtgtaaactcacattcagaagcaatctctttgatccaaatagtgaaaccagaaagcagtcaagtcatggtagccgctccatccatccatatattcagcacaaaaaccaattcagttttcctggcacgtaatcattcaaagacttggatagttttgcaattgcgatattggttggcaacaaaagcacacataacatgtgttcatgcacctcctgaaaaatatgttgcataaaaacaagcattgttgccttgttatcaacattggtacactcctcaacctggattgcataccatggtgattcattaatcctctctaacaattgtgccttaatatcctctgccatttcaccaatttgtctacttatggttctagctgaaagaggaagacgttgccaccttttgaactgcagcctctctgagaagttcatgacaaatgtccttagcaacaggcaggatcaactcttcaccaatagtgaagagcttcttggctttagcaatgcagttagcaactaagaatgatgcgctcagtgcagacacatttgatgaagtggtagtcttcagtaattgcttctgttctttacgttgatatttttttttcttttgaaaaactccaaaggcttgtattttaatgcaggttgcttggtctccaactggggaagcagttttgaaggtttcatgcctttgttggatagctggttgccacatattatacaaagtgggcttggagaaagtgaatcgcctgtagcaatgaactcatgatttaagtaggactcttggtattttattttaaatgcagatttttgttggcagtcttagagtcttctgctgtctcatcattggctcttcccccttttcaaagttttccagtaatgtttgattttaactcattttggctagggttagcttgtgggtttaccaaaaccgtgactgagacaagtgcatagtgtgagaaaaaggtatagatggaagtggtaaataaaataatgagtggaccacatgtggactaaaataagtgtcagattctgacttaaatcctgccaccagatgtagcttgtcgcttgccagtcactaatagggatttgatatgagtctgcaagcaattgacgtattatggtctctgttcagtgaaacctgtctgctaatgttaatctttatttgcagctgctccccattgctcatatcaccacctcagctccaccttagatcatcaggcattaggttatcataaggagcttgcagcttaggtccctcacacacacagttcacaatagagtttgggctcctatcagaatttaatcctgctactgatctgacagaaggcaaagctcagggcggtaatgtgagtgatagggagtagctgtacatacagatgaagctttgcttgctcactgatcacctcctgctgtgcagcctagttcctaacaggccacgaactggtacctaagaggccatgaactggcacccctagtttaaggaatatagagtttttcctgcttacttcaaaaagagtgtatcaaaccaaagtccataccctttgaaactatgctatgaggcttttctcaaaattccatcatgtaatgtagaggtatatgggtctttacacttaggttcaaagttgatggaggccagaaattgtggtagaatgcttatttattgggccacactatgagagtcactacctcaaaagcctttagaaagattatgatacatattaaaatttctcagtatagaaattcctcaaaattctctttttcacattttctttgatgaatgcagagaggaaagagagacagagtgtatgtttgtgtgtgtaaaataagctcagacattatgaaatgaccctgctctgagctgttctgcctcttactacagttagttctgctataacaattgttttgaaaacacaaatttattctagtgtaatggatatattagggtacaatttaagcatggtgtgaatttcctgtttacttatgcatgaattcatccccgaggaacactaggtgaatgcataaaaccacttagctgaactgagctaggtaggaatccacaacagtgcaagcacaaacacccctcaagtatctaccagccgccttagctgatgacatgggttatgagccactcccatccacccctgtagttacagctttccacctgatttcaaataaccctcctttcaccacttcacaattacttgcaggctgaaaccttccaataacctctccctaaagcaaacttcacatctttctcaaggtaaaatacatatttcatgtatttttttacatatttatcaattccttaatgtatatgcaatgcacttttgaccttatcagtttatcattttttcaaatgtgtcccttatgaagttgttgaatgttatacacttcacctcatctccaccttaacattcacgcttttcattgtgtgattttgcatagcacagtacattttaggaatacatatgcctcacagcataattgactgtatctaacaacttgttcaggtaacatgatcctcttcagtactccctgtaaaaggttaaaaatagtagaatcaatctcagagctgttgacaaaattaaaatacgtgtggcgcatttagtatatgccatgcaatatcatagtacttaatacatgttagatattgtgataagcagtatgatagctccctgaaggtatccacacactaatctctggaacttgtgaatattttgtgttacacggaaaagtggactttgccaatgtaattaagactttggatattcaaataaagagtatcctggatgacccaggtaggcccagtctaaatacgtgaacccttaaaggcagacgattttcttaggatgaagtcagaaagatgcagcagaggaaaattcagtgagatttgaaattcttgacaagccattgctgatttgaagatgaaggcgggcaagtgatgtgggaatgtaggagtctttacggacaggctccaggataacagtcagcaaggaaaaggaaattagatttttcccttaacctcaatgaggttagaaccagattcttcctagctagctgacaccttgatttgggcctttcccaacctgaaatggagaagcaaaacaagtccatccatacttctgacctacggagttctgggatatgttttaaactgtgaacttttgggtaatttattatgggaacaatagaaaatgtaagttttattgctattaaatatttctatttttattaagggaagagtacattgctattgggaaaaatatcattttaaactaaaaatgttatattttaagtttttaagttaacaagtcagtcatcagttactaccttaagagcagcatgaaaggaacaaaagaaaaattcctgagagagaaaccttggcaagaaggagagatgttgcaggcaaactccatttgcctcacaaatgtgttttgggccagtctttctttatatgtcgctaaactttgttaaatatttgtatatacttcgggaggctgaggcaggtgaatcactggaagtcaggagttctccaccagcctggccaacgtgggaaaaccccgtctctactaaaaatacaaaaattagccaggcatggtgcgcatgcctatagtcccagaacgggaggctgaggcaagagaatttcttgaacctgggaggtggaggctgcagtgagccgagattgcaccacagcactccaacctgggtgacagagtgagactccatctcgaaaataaataaatagtatgtcaactccaagtcttgccgttagaaagaccataaaaggtttaaacctatatgttagtgtcctattactgctgtaacaaattactaaaacactagtgtcttgaaacaatacaaatgtattgtctcccagttctggaggtctgaagttgaaaatgggtctcactggtataaagtcaatgtatcagagggcatagggctactactggaggcactaagatagaatctacttcctcaccttttccagcttctacaggctgccagcagctgttagcttatagctccttcctccctcttcaaagccagcagtgcagcatcttcacatccttctctaacctctgcttccttcatcacatctccttctctcaccttttccttcctgcatccttcttatgagggtccttatgattacatcagttctacccagattatccaggacaatctccccatctcaatatccttaacttaatccttaagtaaatttccctgtgccctgtaaagtagaatattcacaggttcttggtattaggatttagacattttgggagggccatcattctgcttcccacagccagaaacaaatatatttctaatggaacacatgatttcttaaataattataacagttccattccagctatttctcttaaatcatatattcttgcagttttccatcccctagagtctctttttgcttcaggacatgagtagatagaacctcattaatgagacaataggctggaagaaaggttccaggtgaagactatactagtgagggggaaaaaacaaaaatactgtgtttttggactcctccaatattattccagttgttctacaaacaacacacacacataccagtctatctttctctttatcaatctatccatccatataactacctatctatttagacatttatttttcaaaatgatttatggtgcctcttttggtgtttaattttctaaatgtgcaaacatctgcatttttttatgaaagcctaaaatatgcatcataagcatgccatattattaagcatgttttgagatctaaaaccagttagtgctctgtaaactgaaaataagtaataaggtgtttttatattctctaagccaaatattccaacttacacttttattctacaactaattatcaagtgtctacaaagtgccaggctctattctgggcctggggatttagtaggaccagaaacaagaacaacaggaacaacaaaggctaacacaaatatctgtctttatggagctcacaattcaataagatagctgagcagtaagtaaataaataataaaacaaggacagtataatatgtcacttaatgatagtgctacaggagagtgaaaaaaggcaggaaagtggggctaggggcaggaaggttccaaaggaaactgcaattttaactatggtggccagagtcagatgctttgctgagaaagtatctgagcaaataaaaaggaggtgagagataaagactcaagagtatttcaagaaaagaatctttggtggaggaagtggaaaatcctagagcaggaaatgagatttattctttgagaacattaattccatcttttaactaatatttattgatggcctcaaatgggtggggcactcttacatcagtacacaaaataaatcccctttcttcaaaaaacttatattccaaggaataacttgactttcctttaatttattctactctgtcatttttctgaaaatgagggaaaatcaattttcctgtttatgaaacaagaatagcacgataagcccaaaagagaactttagagattatttagctaaaatgtttaaagtactaagaatcatttttatagaataatgattggccagtataatcaccacattgaaatcttggttttagtttgcttattgttagtttgaattttagttccatcgcatctaggccttacatttgtagggcttcagttggaaccagatgatatttggaacaaaactgatttcatgaagatgatttcctagagtctaacacccagtaaatgcagtcagtttattcaaacattacactgtttccagagtaatgtatgttgcacaaataaaataaatcatggatttagagagaagctgaagtgttgtcaactgggctgtaaatgtttcaacataataaactgtacagtagaatagaagtagctcaaaagttgaagatttcagtttgtgatgcagggaaaaaggatctgatttaggtaggaaagaaaagagaattttaatgatggaaatggtctaaaagaaatcgtatatattacggttgtcagtgtgacagatggtgagactgtatataataaagtcaaaagatattttgacaagaaagaagatggatctgacagttcagaaatcagaatcctgggcagtaaaaaatgagaaaaatataattgaatgtgtgctcagctgatacatagttaattttacacagcccaaggcaacagagtatgggaaatggtcagtagtgttagcagacttgataaaacgaagagaagaggagggataatgtgaaaacaaagcaaaggaagacaacattctaccacctgtaaaatagtattttcagtaaattatttgaaaaaaaaaaaaaccagaaactaacccatctgaatccattcaaaatggtcatttgaacaatacagggctagatttaaatgctattatactttacataaatatacaacatcccttaaagtaaaactaatttttttcacagctacaaaggaaatacatttcattaacactgtttcttaaaataatcctagaaaacaaggtctctttttgacacaggtatttgaatttccttggccattaacatcttgtaactaccattgttttcagatataattctatttaaacaaatctaaaaagtgatagattctttagaacatgaataagttatataaaggattacccctttttctttcaaaaagtgactgtgttattcgcctgatgttatgctaggcttccgtattgttatcacagggacactctcaagtatagcttaaaaatacacttgtccttcacattcttaatacttttaggtcagtatatctgtagcagcaaccccttatgttaaaacctggaaagggtaaaacataatggcttcatactgaaggtttcagaaggggaaagaaaggccctaaggaaaaaaaaaaaagaaactggtttaagaacacacagtgagcatgggcagagtggacacatcgaggcagacattccatctgtgtagtccatgctcttaacaactttgccataatgacttatgagccttacctgtgaaacattccttgtcattatccttgtcagtcacatgtgcatttacaacaggaaaacgagacaaatacctaaatgctttcagaagaaacccaacagtaggaaaaaataccagaaatgaagaatgtctctatgttgtttttgtaaaggacagagttctcagagatattttatgtgtatagatgaaactaaaaacggcactgcaggatgctttaataatctttattgcatcatatttgtgaaaattatactacatcactgccatctgtagtgatgcataaatcacaaggcaataaagcctcctaataaatcttacgcccactctcttcacattattgatcccttttatttgctgatgcaagaactcttccatatgttgatgcagcatccgtgatctatgtgtcattatcctttatgtctaatagcattttctataaatcaatatccttcctctttgaagatggtcctgcagaatgaattgctatatgcttgtgtgagcatcgctgaaagcctggaggtgtggcatggcttgccattccctcattagtctgaggaaatttgtaggtgatcgtttgtggatcttccatgggttttgtcacagcctcaccctgttaactctatgttcctagtgagtagcctcagcagttttagcctcatcactgcactgtgcctagtggtcagcagtcttggatctgtgcttatcatcagatacagccctgttccactacttgacactctccttaaccataacctcctggtggtcccacttctatcagcctccatctgctaacacatcaatcacagaggatttgtttgagactcttaatgtctcataatgttataatcattgttgtttttttttttgttgttttaacatttaatacaaggaaactgctatagtgagaacatatttagtgctgatttgatagtaaacttgaggagctgatttaagcgattgtaggtaaagtcggttatacactagttctctaacccattcaggctgagccacttacagaaaacccaatctgcagtgttgtgttatatttcttttgcctgccagcctctcaaagcatgtgcagttttgacagtttcttttgccttgcctgctagccaagcaggtgacagaacattgctgtaaaagaaactgctttggatagctttcaacgttaaatcactaatgtagatttttaatgttaagcaaaaagtccatggtgcaaatggaagtatgtctgccttcatatttcacagactcttagcctaatatgtgtttgatatgctatcaccttaaaccactaaagccatgtgctgctcaaacatcataaaacatacaatcctatttttctataaagaatagtttacatctgaagtcagatttattttgaaatttcacatgctaacacaaagcattaatgttgagtgggaaaactatagaatctttagaaaggtatcagaataacttcaaaatgaattcagtatttttatgtattattatatacatcatctgatatgcactgaaaggatgaaaccatttaataaaggttaaaaaatagcatttgtgagtcaataatgacttcaaaattaaaacaaataggtaacattctaataatacaagtaatataccacttttaagaaaaataatttgtaaaaggtggcttcaaattttgctatagaaattatggaaagaacaacttaatctcaaaatcttttctagtatacccaaataagctgactaagaatttcaactctagaaacttaacaaaaatgaaaaaacaaatcaaacaaaaactccaaaatacaccaaaaatgtaaaagtgtatatttattagggttaataaataaagaagaaagtaaaagaagagataacacagaatgcttcttccctctaaccacccatttctggtcacagatgggaaaatcttacatttaagatcctctctaatatagatgttgcttgtaatatgtaggatattaatagttccctttggaccacgatgttcttgacaataagtccagtaagtcctacaattccttatatccaagcagaaagttattgtagtagaaatgggtaatcaaatgacatttgattcattcattcattccactcattgaggagagggtttcatgttttgagttactttcctatcgtgttctcccagcccaaccccttcccacccatcagaataggggctaatcccccaaagtatcatatcttattgacttatttactcagactcagagaagcaatgatttaaggcattatgagctcaactggtttatcttcctagagaaatgaaggactgctaaaataagagtcaaaatattcatatgccctagccctattatgaatacaatattaaatttaactcatctattcaggcaaataaaaataatcattgtcattttgacttcaaagtgtcctctgacttactcctccaagtcttatttcagaactaaacagcatcaccatccaccaagacctccagcacagaggaagcaggagtcatcattgattctacttcatcctcaacgttcattttatatccatgtcttattgatttcaccttcagtaactgtttaatcaacctcttctgtttaatcaagctttttccttcttctgtttttacatcctacaatttcctgagagctctcctcataaaacataaaattaatcatgtagctacattgctgatacatttaggtggccttctaatgcctacaaattaaacccaaaacctttatcactatgcaatgtaaacaaaagtgtttcaacatgttccatttataatgaacacttaatgttacaggttcaaaaatacccctattcttcccaagtatgttgacttgacaatatccaagacttttgtctccctcattcttttccttctttataagttgtctttcatcttcttctctgccaaacaaaattcaaccaaccctcgagggcccaattcaaatctcactcttcttttatgagccttgctctatacactctttcccccacatcacctctttttctagaaattctaattatttggatgttatgatgtgtgatgaatgtcttttaacaatttacatgcctgcatgtaaatgagattctggagggcaaagaatatctaattcatacttgaatctcaatatttcacacattgcctagcactggagtttataaatatttattgaatcaagtaaaattctctaatcttttaaatatgcaaacatgatctatgtatcttatttaaataaatatggctcatgacttagtagctaactatagatagatattataaaactatattgtttaaagttctgtcatggtatatttctaccaaaatgttcagatagaaaaagaagagattcagttggaaatgctcttgtaaagaacacttttattctatgataaatagaagaatttatccctgactaattcaaccagaaaagtctttttgtagaattcaattctataaccctattcaatggagttaatgattgtttcacatgagtgatagtaatacattaagatttatagaaggatgtgcaagaaaacatagccgaaagcagatataatatttaaaatataattcctgtagaacgaaaacaaaatctataagacagggctccatagaaacataatgttccatttcaggctttcaaaacagacttacaaatgaaacatttcataaacaatgaataacatgcacttaagaacctcacacagagaaaaattgcaactgagcatgcatgtgtaatttgcactacagtaatcttactttttagcaaatgcaaggaatcctgtcaccgaatggtgagcaaagtgatgggtggcatactgatgttactgaaattctctccagaggaatatggatacaaaaatataagtgtaatgttttgtacatataatttttaattgccaacaaatgtaaataaataatttgaagcttgttttcatcaagctatcgatacgctctttagaagaagccactcataagactgaggaattagacatattaaattcttaaagttttatcttggaggtgggacgatgctcatatttctgcattgcgtaattatgctttttttcagagatacaatttccttcagttttctcacttgcacaaagcatggaattctggtacttaaaaaatttattagacttttagtttgttttatttctttgcatacatataaaccatgggttaccagctgtttacaagtttactcatgaatctcaactctcctgcactgacctatcatcaaacggtagccatatcacctaccagttcctcagggaacacatgttattgaagctacttttttctctttaaatgtgttacaagtagtaaactatataattattttccggaaaaacaatccttgaatttcttgtgaatgaagataaaaatatcagttgaattaaatagtgaaaagtaaaggtgagtcttgtttttatatttacaaagaaaccctaattaattaatcatcttagccaacaacatcttagcacacaatctcataacacaatgtttagacagtgacccaatcctagaacatagtatggacttcatttatggttactgaaccaaaggtgatgacatagattttgtaaaataactcagaggaataagttgtttctttacaaagtagcctaataagtactttgtccaaaacaacctacctaggtaccatgattcctgtcagctacatcatcacttctaattctatctgaagatacaattgaaaccactactgaagcaggaaatttccctgaccccttcacgggtggaaactggaatgcatgggcactggaactagctggctgcttcttcggggcggcaggggtggactcccctggctcagtctcactgcattccaccccttgaggaggggagtgcaggtgaacaggtgcaggagccagggcaagtgcttttgggcattggcaggagcaaaactttgtgcggaccctgtggcagtgtctagtgaggagtacccatgacccctgaagccccagaggatgtgagttacagtgtttttttgttttgttttaaacctgtgtaaaaaaaaaatgtaaactaataaatactaatagctttaaatacctaattcaatgtttcttctctttttatttattttttatttttttgagatggagtcttgctctgtcgcccaggctggagtgcagtggcacaatctcggctcactgcaagctctgcctcccgggttcaccccattctcctgccttagcctcctgagtagctggggctacaggcgcccgccaccatgcctgactaatttttttgtatttttagtagaggtggggtttcaccgcattatccaggatggtctctatctcctgacctcgtgatctgcccaccttgacctcccagagtgctgagattataggtgtgagccaccgcgaccagccatgttacagtgttcttttagttttgccatctgtggacagcttaagtcttaaacagctcagtgggccccctgccttttcacgtgtggtggttgctctccaccagcaagggcaaagagtcagtgtgacagtcttcactgtctgcacccatggctcctgagctcttgttcagtgtccaggaaaaatcaggtcttactaacgaattggagggtggtgaatgtggaggattttattgctgatgaaaatggctctctgtggggaggggagctggaaagcagatggagtgggagggcaatcctcccctggagttcagcagtccttggccagactcctctctgaagccacgttgtcaagttgtctctttgaagtcaagctgcttctcttggatatccagttgcttctcttctctgctctctgctgatggagcctggggtttttatgggcacaggattgggggaagagtgggccataggtggttttggaaaaggcaacattcgagtgggaaaacaggaatacatgttctcacattgggccacggttccaggtttgagggtgggacccttgccaaagacctgccctcttctgcccagaatttccctgcctcctatccttatcactactaaggctgtattgtatcaagaaacccaagtgagataaattatattattgcttaacaagtattcactttctatccccttctgtgaaaggaatatattccctacccaattgatgttgaacgtggctatgtgacttgctttttctaatgggatgatagtggaaattatgtgagtagaatttgaaatgtgcttgtgtgatttgacttggtctcctgcactttgatctttttttcataaaaaggatatgtctcagctatcttcagttttaagaaggatgagaaacaagtgaatgtagttcacagctagaaagcaagcctaattgcgccaaatctaaagtagctgaactcatgtcaacccatagatgagtaagaaatggatgcttattggcaagcaggttggtaagtagtttggtataaaagtaatcatgtttttttgtccgtaaaagtaatggtaaaaaccgcaataacttttgcaccaacctaatacatgccaatgagttttgattttttttttacacaatgttattatggatacaaacgactgatacaccaaggaataaaagcatttcatcaatacacaaggagaagaaataattttaaaagttacttaattgtgaaactattggtttaactggtaaaatagttgtacaggtgaaagtttagttttgttatgcatgtaaagacattaataacagaagattttgaaaagtaaagcatccagtgagaaaatataaaaggaaaatgacaaatatagaaaaatcttaggaatgttattggtgaaaggaaggaaaaactaagagtgaagcttgaaggggtattagaaaatggaagccttgttaaatttttgtttctttttttctttaaaggaataaatgatctaaatatatttacaattagaagagaaatatcaatgaagcaagagccctaaaatgcaagggagggacttattaactgatttcaaacaaagctttggctcagctgagttgtgaatgacactctgcacaaagtgaaagagaggaaacaaacttactctgagacaggaggaagaaaagagtaatgttacagataagttctaaagacataaggaagctgtgatcacctagatatgttgaaatgacaagatagatagcaaacaaaggcacttgtgctagatgacctatatttgccaacatgggataaggagattgcatgactgaatatcttggagaagagcacaaacaacttttacttttacttatttattttttttgagatgggcatcctgctctctcgccaggctggagtgcagtggcgcgatcttggctcactgcaacctcagcctcccaggttcaagcaattctcctgcctcagcctccgagtagctaggactacaggcacgcaccaccatgcccagctaatttttatatttttagtagagacgagttttctccatgttggccaggatggtctccatctcttgacctagtgatcagcctgcctcggcctcccaaagtgttgggattacagccatgagccaccatgcccggcgtgtatcaataacaaagatgatggtgacaagagcaaactgtctgaaaattcgatgttatttatattagtaatactacaaactcttagtcttgttaagattaattccaaaatgtgatcttaacgtaaattcgaggattcatttggggcaggcaattcaatgtctaggatccatttacttctgctttcctgtttttaacatagggcaactacagtttcatcttggagaaaagaaaatcatagattttatcaaataacctcatcttttacatgaacaagataactatttactttctctttaaaaataaagcataatgaaactggaccccttccttataccttatacaaaaattaactcaagatagattaaatacttaaatgtaatacataaaaccataaaaaccctagaagaaatcctaggcaataccatccaggacataggcatgggcaaagactacatgactaaaacaccaaaagcaattgcaacaaaagccccagttgacatatgggatctaattaaactaagagcttctgcacagcaaaaaacaaaaccaaaaacaaacaaacaaaaaaacaaaaaacaaaaaactatcattacagtgaacgggcagcctacagaatgggaaaacatttttgcaatccatctgacaaagggctaatatccagaatctacaaggaacttaaacaaatgtacaagaaaaatacaatgctatcaaaaagtgggcgaaggacaggaacaaacacttctcaaaagaagaaatttatgcaggcaacaaacatatgaaaaaaagctcatcttcactggttattagagaaatgcagatcaaaaccacaatgagataccatgtcacaccagttagaatggtgatcattgaaacgtcaggaaacaacagatgctggagaggatgtggagaaataggaatgcttttacgctgttggtgggaatgtaaattagtttaaatgttgtggaagacagtgtggcgattcctgaaggatctagaaccagaaataccatttgatccagcaatcccattactgcgcatatacccaaaggattataaatcattatactaaagagacacatgcacacacatgtttattgcagcattgttcacaatagcaaatatatggaaccaaatcaaatgcccatcaatgttagactggataaagaaaatgtggcacatatataccatggattactatgcagccataaaaaaggatgagttcatgtcctttgtagtgacatggatgaaggtggaaaccatcaatctcagcaaactaacagaggaacagaaaaccaaacaccacatgttctcactcataagtgggagttgaacaatgagaacacatggacacagggagaggaacatcacacactggggcctgtcggggttggggggcaaggggagggatagcattaggagaaatacctaatgttggtgatgggttgctgggtgcagcaaaccaccgtggcacgtgtatacctatgtaacaaacctgcatgttctgcacatgtatcccagaacttaaagtattaaaaaaaaaaaaaagatgttattacctcctggactggattgcagagaaaactgtaaatgttttaacacactagtgtttctactgccaaattcctgttagctcattaattgcattccatatacacctttgcaaatgtttgccctatagtctgtttataaacatcttagatatggcagaaatttaaaaaaaagtaaaagagataaaaaacaacattcatatgaattatactaatttatttttatttttgaattcttattttttgagggaatcgtaagtataaatttactgtatacctagtggcgtatagtaaaattgtaggcataaggataaaaggaaataataaacttcatagtgctcagcttcaaacccaaacctctaaataacaggacaggctcagatacctcagggatcaggcagataatacaaataaatgaaacaggcaaaaaagagtacagtcttgccaagagaggcaatccctacttaactccaactgattgttctcgtttgaaaacacaaatcacaactgccaaatctgattgttcaggagaagccagaaattctgatgtataacgtgaaacctctagatttcttatatggtagcacaattttctctaaaacactaggtaatctaaataaagctgaccatctatcagtttcagtgctgtgttgtgcaaatgatgaatggcatatcccctaattgtggtattagactgcctctcaccagccacaatttgtaattgcaacaatggcatcaccagataggactctcctgctttgctatgcacacattcctgagccctggagaacaactaactctacaggaaaaagtggaaggctcatctaagccattcttgctagctttcatgactagctgctggcctacaggcaataaattcccaactgctcctgcaagtaggctttagggcctgggaggtctttatctggttcagaaggcaaggctgcttctcaaagcacctccaagtgctttggggcccctgttcagatggcaggcatttctggttaccagcacctgatgactgacaggagcagggcagtcatactcacatccaggagcttggtgcttaacagatggtacactgatttcacaacatcatctactctggggatgatccacttggccaccacaatgatgctgctgacagtggttgaagtcttcttttcagcctctgagcccattgtcatggcaacaagtttttctctcaaagtgtgacaaatcttcaagatgacaatgcagtgggacatgagacccaaggcatcctagatccagtcttcattctccagaatgggctctatgccagagtgggcgatgatgacatcatctagttctaactcagagagctcagattgggtctccatggcacccaagagactcataatgggcttagaatcatagcgctgcagcaggtctcctggccagcagtagcgctgcactcaaaccaccaccaagactgcaaacaaagccagaaagatggtagccagcacgcttatggcaacaatcactgtggccttcttgcttctctgtggctcctgacttagtctcactcatatcctcctcataggctaaattttctgaactgtagatgaccagtcccatggcggtgggagcaagctatattaatttattttttaaagaaatgaagaagtattttttaaataccacaaaatatgataccttcaattacgtttaaaacaataaaacaaacgaaacccttagatgacaaatcctagtaacaatattatattgtggtgcttacccaatcacgaatcttctgcccatattgcagatattttaagggaaaaaaaaaaacaagtagaaacaaacaaaaaaatagatttactgctggccatatggagaaattctattttcaataaataatataattcagaaaagctttgttgaggactaaagcgaataagcactttgtaacctttacttctaagaaacattccttttattatccatgtaagttatctatagaaaaaaatatttctagcatgtttttattttttttttaagttttgtttgaagctttgaagtattccttagcaatttgtgtttggagagaaaaactagatatctggcatatgcaataggcacaacttttagtttgcaagtgttttgatgtgattttttccactgaaaatattgctataagagcatagaaatcagaataagttaaatcaatctccttataaaaaattttggggtttgtgtagacaatctgttgtaagttgtttatgactatttctaagtatttctgttagccatttacaattttttgtaaaagttgaggccattctgctccattttctctaagttctctctcaaggaaaaaataaattctacctaaaactacactagaaagtgtgtatatgctcgcacatgtgtccacatggggaagagtagagattggagaaaatgttcacacggacaggaaggggtattactgtgccctctcagaaataaagaacaaaatcaagaacactatgatttttcttaattttaatatatcttttgagtatttgtatatagtgacattctcattaactatgatttcagaacaataggaattctatatttattattctattatttttctattagttctttctctctaatatatgttgcacagaggtatgcttatataaacctaaatatgttaatgaggtgattaagacataatatgcactatattataagactgaagtgtctagtctaaatgacttactttatggtacagtataggttaagttttctgactttgttttttttgagacccagtcatgctctgtcgcccaggctgtagtgcagcggtgcaatctctgctcactgcaagctccatcttccgggttcacgccattctcctgcctcagcctcccgagtggctgagactacaggcgcctgccaccatgcctggctagtttttcgtatttttagtagagacggggtttcaccgtgttagccaggatggtctcgatctcctgacctcgtgatcagcctgccttggcctccaagagtgctgggattacaggcgtgaaccaccgtgcccggccagttttctgacctttttttctgcctcctgtgcactatcttatttatttaaatttggatagtgacacaactgatctgaaaattgcatgaatatactcctttcagataataatatatccatgagaagaaaaaacacaaaatttgaaaaaaattgtataacttatactttgtcttatttaagtatttctactacatagcaagtaaagtatatgagtttgatttcactttcttaaactgaaaggaaaatgattgtacacatttgaataatatattattgaaaccttaatggtattagggacatatcaaaaaagaaatatttacaattgttacaattgatggatagtgtctgacaaaagtatttattttttgacataaatgtagtttggctattgatgaagttgttaggtagcaatttactaatgtgtataatataataaccaatagatacaaattcctatttcatggaggatggaaataaagacaaaataaagaactatgatcacactgggagactgaaaacataagcatataattagattaattgaaatagagcttttttgagttacatatttcagttacaatcaaaccgatagcttagtccttgaagttctataaaagatgaattaaatctaatatatgcaattggttgtatgctcgaaaattagttactgaaattctcaagccctttctatattattacaaaggttttcttctgatagcatatactactggttaataaaaattcacagtaaattcactgaaaatataacaatttaaattttaacaattttgaaacattccacactggatttgaatttattctttccattcccttttcattacatgttttaagaaacttctatgaatattaccttttataaaaatgagatacttaaatacattacatataaatagaaatcatgtagttaaaaataaaattctatttttgagtattgaatgaacaatgaggaaactactgacttcctagaatattttagatatattcaaaataaaattctctaaagagtggttgaagaaataactgaaatgttaatttcttaaaacagtctttactcttttagtggtattgcactaactctatgactcagtgacaataaaactactttaaagtatttttgctagaatcattacagagtattggttacaaaagcttccccaaacttgttcctccctttggcccattctcgtaattgttactattttatcttttctgtagagtctttcctggtaagtcaaatattttcctgtttttaacattatatttctattgcgaaatgagtcctgcttgaggtatttctatatttttgaattagcagtgtttattaagtgcatatgccagttctcaccactgtgtcagacactgagtcaaggctggactatacacgagtgagcaaaatcagataagggaagcttactattgaagaagacagagaataaggtaatcacacaaagaaacataaaataaaaattcacaataattcctacaaagaaaaattgtataaaaatgtgagggacgtgtccttttctaggaaacagaagaatacaatttatcattttatattaccttatgatgtttcattgtgtattttcattttatattagtatagtttgcctttcaaattgtgtgtcacccaaattgtgaagaaacaatgtaatgtactattttttattcatccctttgaatctaggcacataaaagatgtgtctgtagcttactacctgcatgaagaccaatatcattttttgtgatagaaatcttataataatccactgtgatataaaaagtttctggatgtgcatctttaaaaatcataaaatgcatttctttagcaaaacagcctaatcaaatatcattgatatcagtattcttttcttttcctaattcaatattcagttttctttttttaactgtatgctctactttagtaaaagaccaagttttattgggtaaaatataatttatgatgttatataacggtccattttaaaccaaatgcaaccacgctttaacctggtagagaaaaacaatggtaattcattatccaatgatcattgcaaaacatttctctgaagcaaaatctggaaactttcacctctcttttcctaaagctgattcagccacaaagatggcatcacaagcttggcatttggtgtaatttcattttctgctgtcaccatcttgaaatttttaacatttttatcttggaatgtatgttttgcaagtgaggtctgataggtctgataggacaatggaacatgccagtgagcagagctgcttcctttgtagacatcatgcccagtttcttatgaacacagaattcttgtggatccacaacatgcaggagttcaggaagactcagatctactacaaagtcagagtgttgcatgaaccatcgagtaactgtgataaggaaagggagcactgacattctcaagaggtcacagtttccatttgagcaatacttgctttaactgtggaaataatgcaatgatgttctatcatgaatgaaaaactctccatatcctttatttgttttactcctctgtattaaccaaccatcgatgctcaaagccatggttccttttccttatagtctttctttagcttatcactatgctaaaggtatagaggttggtagcatgtgtactatcgagaatgaaataaaaacaattgtgttagtttgtgcagtatttccaccattctgataaggatttgatgtaatttagatatttgtcccctcaaaacctcatattgaaatgtgatctccaatgttgcagatggggtctgggaagttgttgggtcatgaaagggctggatggggctggatccctcatgaatggcttgataccctccctacagtaatgaatgtgttctcactctaatagttagcgtgtgtctgactgtttaaaagaggctggtacatttcttgcttcctctttccttgtgtgacaggtctgttcttccttcaccttgctccataagtaaaagcttccaaaagctttaacagaagtcaagcagatgttggtgccatgcttgtacaaggtgcagaactgtgagccaaataaacctcttttctttataagtaactcagtctcaggtagctctttatggcagtgaaaaacagactaatgcaggataaaatatgtgttgtggaattttggtgatgctactttcaagttaaaggcccttatatttgtataggaaatggcattgcacaatagaaaatgaacagtttagtctatgttcatatttgaaaattttaatttttctttatttaaaacaacaatagtggcaattttaaaaatatcatgacaagatgagagaaaggccatgcaaaaaaggaaaaagactcaaattttagtaattttttttaagatgtaattttgcccttgttgcctaggatggagtgcaatggcacgatcttggctcactgcaacctccgcctcccaggttcaagagattctcctgcctcaggctcccaagtagctgggattacagatgcctgccaccacatcccgctaatttttgtatttttaattttaaccatgttggccaggctggcctcaaacccctgaccttaggtggtcagcccgcttcagtctcccaaagtgctgggattacaggcgtgagccaccatgcctgtccagtaatttaacagtacttttttcttcctgtttgtacaagagtgtcctttttttcactctactgagctggacctctatagcctcagacaatcaaatactctttttcatcatacaaggtagatgggttagtcatgcaacaatcatttcagtcacatctcagtaaatttatgataatcactattttgtttttgaaaactaaaactattcactcacattaagaaattaaaaccatgctgtgatgccatttactggaggaacttgtaatatagtagtttaaaatctaaacaagagacaaaggtgaaaactaaggacaattgtctgtgtataccaaccaaggaagataattatttttatgagttaaactgcaggtttttctttaaagactaaagtttagcaataatgatcatgaccacatataaaataatttctatggtgctagtatcaaaatgttattaccagaaagatctgtttaggcatcttaatctctaatcgtatcagacagattgcatgtgtactaaagtattcaaatttattttctctatatcccagttgtacctattgttctttgctaggtaattccattcagaaccattacttttctatacaacagaagcacctagaataaaaaccttgattgctttcctgaataatattaaaaaatttctatttaccacaaaattctgtaaggaccttaaaacaataccgacattccttcaaattctcagaaattctaaaatgtaatttacataaatgttagggtcctagaataaccctattagggttccttcatccattttgtaggggcaggggaaatataaacaatactattattaggaaaataagtgaataggaaataatgtttttaaactcttattttatgttaatagttgttacacacattaggctaaggtgttaataataaaaaaatataagaaactcttagaactcattagcaaaaaatcaaaccaatcaaaaatctggtggggggtgtatttctagggagaggtaactaaatggtaattgctaataaaacttactgatttcttttcctagtcttaggaactttcttcaagcatttaaagtatgaagagaaagtattctttctcctcctcatcagaacccccagcacaatctacataatcacaataaatttacataaaatacagttatgagcagttctaatacatttcctaaatcttgaaatactttattctattgtttctactatattttcaaattataaaaaaaatatgagaatgaattatctttgttttatacttcagtattaggtcatggaatctacataatggttaaatgattattagtttcttgtatttcaaacactcattaaaagcttatatattctattcaccttggagaacaggtgatctatagaagcagagcaaaatagtttctgtgtccataacttttaatgctaatctttattttagtttactttggtacctaagcaaacctatattctagcataattaagcagaggagagaccatagagcacctacaccacagaacaaagtaaggtgatggctctactctggttgtcacttcccatatgtctgtgagacacattatcatacatgcctgtcattgcacagtaactttgaacatccagctaaaattccagagtctgtccagaaagaatatgtccactttttttttttttttttttactgagtctcgctctgtcacccaggctggagtgcagtggcatgatcttggcccactgcaagctccgcctcctgggttcacaccattctcctgcctcagcctcctgagtagctgggactacaggcgccagccaccacgcctggctaattttttgtatttttagtagacacggggtttcaccatgttagccaggatggtctcgatctcctgacctcgtgatctgcccatctcggcctcccaaagtgctgggattacaggcgtgagccaccgcgcctggccatgaatgttcttaatgacatctagcatgatgaatccttttcagaaggtttttgattgactttgtctagatctaccagagaaatcactgcctatgacagctgcagccttatgaaatgtatttcttaaataataatacttgaaagtcaaaattactccttgatccatgggcttcagaagggaagttacgttagcaggcatgagaacattaatattcttgtacatctccatcagagctcttgggtgaccaggcccctcgtcaataatatttttaattttttttctgctcagtaagtctgaaaaacggacttaacatattcagtaagcaaactgtaaacaaatgtgctgtcatccacgctttgttccattcacagagcacaagcaaagtagatttaacataattcttaagggccttacgatttttggaatggtaaattagcattggcttcaactaaaagtcactagctgcatcagcccctagcaagaggcaacttgtcctttgaagctttgaagccaggcactgaattctctctatctgtgaatgtcctaggtggcatcttctaagaaaaaggctattttatctacattgcaaatctgttatttggttaatcaattatgttagctagatcttctagataactttctgcaacttctacatcagcacttgctccttcaccttgtacttttatgttatggaaatggcttttttaaaaaattaaacattatgaagcaaccactgctggcttcagatttttcttctgcagcttcctcacctctttcagccttcacagaattgaagacagagagtcagggtcttgctctggattagagttttggctaaagagaatgtcatacctggtttgatcttctatccagatcactaaaactttcttcctaggagcaatgaggctgcttctgtttcttactatttacacgttcactggagaaccacttttaattttcttcaaatatttttttttatttgcattcaaaacctggctatttggtgcaagaggcccagatttcagcctgtcttgactttccatatgccttcttcaataggcttagtcatttctagcttttgagttaaagtgagacacatgtaactctttctttcacctaaaaacttagatatcaatatagggttattaattggcttaattttaatatttttatgtctcaccaaatagagagatttgaggagaggagagagctaaagaagagcgagtttgtggagtagtcagaacacacatttactgattgtttgccatcttatatgggtgtggcttatggcccactcaaaacaattacaatagtagcatcaaagatcactaatcatagatcactgtaacagatttaatgacaatgaacaaatttaaaatatagtgaaaattaccaaaaagtgacccagaaacacaaaatgagcacctactgtggcaaaaatggtgtcaataaaattggtcaaaacagggttactaaatacttcgctatcttgaagtgtaatatgatgaagtttgactgtacttaaaactgatcgagagagtagaatttatgttaaatgttcttcacatacacacaagtaataataaaggaggcagtagaaaaatttgggaagtgatggatgtggttatgtccctgatggtagtgatgggttcacaggtgcatacttattctcaagcttattgagttgtaaacattaagtatgtacaactgtttacatgtcaatcatatttaaataagacaattttaacaacaagaaagaaatactcccctgagaatttcaggacctcagagggaatggctccatgatgcacacagggagcttaatcgtgtcattcattcagtttttcagttttgtcaaagcttctcacattacgaggcaagtatgaaagccacaaaatcaccggtgataaaggaattaggttaactgcaaataagaaaatttagtagtgaatacggaagacttaagattaaaggatttagtctctttcctcccatactgtgctatctgctaagatttacttctttgtctgaggacagagtagacatctaaaaatgacctcatttgaattatcttctagtgaaatgagatggaaaccgaggtgacattcaagcagaaacaaaatgaacaaatgtgataaacctaagtttacagcataagactaatatctgctataaaattacattttaaagatttacttattttatagaaataagtctataatttttttgaaccttactggtagtgcctacagaaccatggggtgatttcataaatatgacatgtgtaggtgacaaaagacaaaaggcaccaggcccaatctaaaatgccttttaatttcacatctggccaaaccacataattgctacaattatgtaaatgaaagtctatatttggcaaacttccatataaattttattggttatagaaatagtaaataatgatttactgtcaattttcaattttttttctaatggtaaagagcattcttaactattgatatttttgaaagttatcttcacagaatggtccatgaaaagcagttctgattgcttttcaaagtatctgcagttattttacagtaaaagacatttttcatctcatgagatcaaacagcatggaaataacttaggatatttgtgaaaagtaagagtgttataaattcattgatttaaatatccaaagttctggagaagttacttgatttttttgtttattttattggaaatactatcacattacataagggttagaatatttagaattgttacaaaaagtgtcagaaaataattgataatcttaacttaaaaggaacaaagcacaataccaaattaataagggggaaatgataccaaagtactgctcttctgtagatgaaatacaagtggctatcaaactttagtgattgttacattactctaaaatagagaatactatcatatcattttctatttctagaataattctataatgcatagatgactctttgtaaaatttggtatacattctctacattcatgtctttacatgacattaaaatattgatgaaatatgtggcttaattggcaatcttggcctaaattaagctattacgaagaatcttatgtttctaatatttaaaaaaagcatattttgccattcaatgagctttagaaacaacacagtttttaagcaaatcacctagtagcattattgaatcaattctagttggtaaagaaatcagaaaatgggtcgtaaaccactggggctccacaccactaatctataaattcaattttccagttaaaagagacttaaatcccaagttgggtaagacttggagtgagaaacagatgctgcttgttttgtgcttctaagccaatacggaatctctggaggctgtattcaagagacccaatcaaggcatcttatcacctgcccaatattgggttattctagacattttctaagactcctctcacatgttcctagccaatatagtaactatagtacagtttcaatgtctatacgcaaccagtatcagaatttacggaagtagactaaaagttaaacaatctggcatttatattaacaaaattagttattaaaactttaatttagtaaaacttgaactaaaaacatgtatgtgtaccaaaatgcatgcacattatatatgcagattaaaagtaatgctagttttagagtgtatacactgaaaaaacagttcccttttaagaagaaataaaatatgattgagaaatttttatctcaggtacatttattttaaatttaaaaagtagagaaaaaatcactttaattatgcgaattgctaaaaaaataatatttgacaaaaattgcacactaaaagctcttaaacattatttccagatatactggaaagatttttcttctcagtattgccaaattatttgaaatagatgtttgttattaaaaactctggaacagttatgaaaaaatttctatgtatattttcttacttctctaaaactctcataagcagcatgaggggaaacagtgtgtcatgcaccctacagccctcgtttgtcctaatgggaagacagagtgcgctcatcatatttgataacattttcacacaatttcaaaaagaaaactgtttcatttttttctttgaaacatttctaaaaatacttcaatttagttttcctaaaaaattctgaaaaaactctctaagcatcacaatgactgttctgagatatgtataataaaaatacatgttattaataagatgttaagaaaaccaggattttaaaagtcagtacataaatgtcaatatacaaaatggcagtcatttatgggcttagtaggtgaatagtgaattaaaatgtgcaaaataaaaaatgcagtttattttgttaatgaatatttaactattttattaaagtgaaatttatataacaaaatttagccattttgagttgtaaaattcagtggcatttagtatatcataatattgtataaccatcacctctatcaaggttccaaaatattttcataaccttccaaaaatagactttactcattaaacagttacttaagcgacaatattttaaaacttgttagccactgtaatccagaaaaatggtaccactatgtataaaaataagcagttacttaagcaataatattttaaaacttattagccactgtaatccagaaaaatggtacccctatgtccaaaaatccagaaggggaaaatttcttatggtttttgaaatcttataaaggttctccattggcaagcattatagcttttgttttgttttgtttatctggaataaaatttgaaagcagctctaagtgtagagaagaatcaaatctgattcccttgaataaagtagagggatatatgttatacatttgatctcattccatttcattgcaagcatcacacatatccttaggaagtccttgagtagtagcctccaaaggctagagtgtaccttagggaatgcagaacaggcactgctgggatataagaagaaaacattgaaagttttatttctcatactttaaattttttatttgaagtattgctgtggtttgactagcaataccccaaataaaaatttagaagtatgagaaataaaagttgaatattgttacaagggcaattaaatttcagcatgagtttcaaccaaaactcgtgttgaaatttaattgcccttgtaacaatattaagaggtgggactattaagcgatgtttaggccataagggttccatcctcataagtggattaattaatactattgtcaaggttcattatctcaagaatgagttccttatgaaaagaagagtttgtcacccctactttgccttctctttgcccttcaccatgagataatgtagcaggaagacccttgccagatgctagccccttgatattggacttcctagcctccagaaccatgagccaatacatatatgttcattaaaaaaataacgcatctgtggtagtcggttacagcgtcataaatagactaaggtttgatttttaaacatttacaatataacactacagtaacacatttatgtgttttttaaaccaaaacaagtcataggagaacatgaataaagaatttaggaatcactggatgtctagtatccatcatgttgtttcatgttgatacctcttaagcattttgaattggctccaccacaaggtctatttttagcaatttccatacagactgtatataggctgatgtgcttttgtggaggataaagcaactttgtcagttcatccatcactaataatcctgatactcaaaatcctcctgtaggttgtccaatgccctttggcatagtcataaatatacatgcaattttatgattataagaatttggaaaacttaatcatttcaatttgctatggctgattaattctgctatggtctatggtactggaaacagaagagtactcagatttctggctgctaagagctttcctgcctggagctgtcttcctcaaagcaacagcttggggaatacaaattttctaccactacaaccactctgcaggccacccatctgtaactattctctgggtagaacaacagttagagtaacatacttttaagttagtttttgtgagtgtaaacttataactggatgatgaaaagcaagtaaaactactttgtaatttttggtaaggatcaatgggttatatcatctaggtccagagtaatttttaactaccgttaatttccagagaaggctttcccatagtcattccattagtccaatgcttatttgaaatcttttctcttctctgcatttttctttctggtaacccttatgttggcgtcatttttgaccttgtagttctgtaatcccagaatctttttggtttgtttttgttttgagatggagtctgactctgtagcccaggctggaatgcagtggagcaatctccactcactgcaacctccgcctccccggtcctggttcaagcaattctcctacctcagactccagagtagctgggattacaggcacgcatcaccatgcccagctaatttttgtattttggtagagaccaggtttcaccatgttggccaggctggtcttgaactcctgacctcaagatctgcctgcctcaggctcccaaagtgctgtgattataggcgtgagccaccatgcccagccctagaatcacttaatagcgccttcatttctctctctgatctgtttgagccattagtgtacctaggggaaagacatagcacattcagggatttacattgaaaattctggttctttatacttgtgctttagggtttgtgcacagaattagaatgaccttctttatcttttacaaagtctctcaaaaaaggaatacatgattgggagtgggataattgcatttgtcacttaaattaaaattctgtttttatgtctgctgatgaacatacactttgtcagttgttggttacttctctttgatgtttttcacatatttatttccaatatctgtcatttataccaaccaaggtagtcccaaataaatgtcatcaagaatacagtactgctaagagtgtggagaacatagatttctacaaactaactattggattagcagtgaaattgtactgtgtgatacctacaaagccaagaacattattcagggtaacttttgttcttgtgctacatatttaaagacatgtgattcaccaggaaatacaataaatgtaataataaacacacatcaacacatttcaaatatgctggcattccagctactctaagtaggaaagttatagagcagcgctccccaacattttttggcaccagcgaccagcttcatggaatacaatttttccacagacagggtgaggaggaacggtttcattacacctcagattgggcattagattctcataaggagctgcaacctgcatctcttgcgtgcacagttcacaatagggtttgcactcctgtgagaatctaaggcattagcattaattggcatttatagctcagtatcatctacattccaaacacttaacctaaagaaagttcaatttgctttttcaaaataactcatctatcattgtgttcccagaaggaagggtatctgtggatgctatggagctagagaagacagtgattgagaaaacacagtggaatctgaagcttctatatattgtaattaaccaagtgggcttgggaagaggagatcaaagtctaaaagagcaaaagaatgatagcatgtataatgtcacatactatttaaaattttttaattttttattgttttatgagacggagtctcactctgttgcccaggctggagtgcagtggcatgatctcggctcactgcaacctccacctcccaggttcaagcaattcccctgccccagcctcccgagtagctgggattacagggttgtaccacaatgcccagctaatttttgtatttttagtagaaacggggtttcaccatgttggccaggctggtctcgaactcctgacctcaggtgatccacccgccttggcctcccaaagtgctgggatgacaggcgtgagccaccatgcctggcctaatgccacatatttaactttgctccaaagattcaggtttggaaccatttagaaaattgtaatttcataatttaaaaaatatggtatacaagagattttatgggcaagtatattaaaccctagttcttatcaaaatgaaaatgagatatacaattacattaataaaaattgtaacagactattgatgtagattataccttttgtacaccatttgatcacctagctctatgctttctataaaatctgatttatttaagaccttgttacaacactcagaattttttaaaagcctatgccttctaatatcaaagaacatggactttagaactacttagattgttttgttgagtcagattagggcccacttgtttaaggcatagctaagcaagaaatggttaattacttacatttgaaaatttatcacatgtcaaatactgcaaagtataggtcacatacttgggttcttagtattcataaaaccatatgaacttcttctgctgcttctacaggttgaataattcaacgactattctaaaaaaaaacattttagcaagtcttgctaaattagaaaatagaaatctttaaaacagactgcagaaatttgattctgttgaacagataccatcaaaaactaaagcagatttgaacaacttggactagaaactatgaacaggaatcgatagcccaggttgtctactctggagtccacagtcacaatcactgtgccattgtgtctttttttcatacatattttgatttttaatatttgagtaactgctggcatttaggaagttagaggctagtacgtaatatataatagcaaatattttaatattgctaataatagaatgccttatagtaattcattacttatatcttttaatattattagaagtattataatttctaatagattattagagttgtgtttcattacaaaattttattttgtcatttgggattaatttgactacagaatataagcaattcatctttgcttggtttattttggaaaactccactttttgtgaacataatatctcttacaaaaaggttccaaagtaatttaatactttattatctagttatttttaaagctatattttgggaatattttgctgaaagctaaaattataataaaatagagagcaaaagaagtactttaggtcagcttctctgttacccaggtgtcaaatgataaattcctagattcttctattggacatagatctaaggagtaataggattagttagactgagaataaagaataaatgaaaaaagataaaaccatggctttgagtttagagcactgagagtagtaattttacagcaaataagagggaaagtaaaaaaaaaaaagctttctttttctgaaatattacagagaagctaaatggtaaataatttttttttactataatatgtcatccaaagaaaactactttagaaaaaaaagaaaagataagagctaaggttatacatttgaatgtgatctgcataaagctggatggatcagcttaaaattacaattttaaataaggcatagcagcataagaagaatttctaggttatttaaatttacattttagggttcttttcttctacgatgttggattggaggcttttagagcatctcatccacttggaaatagcaagataatgcatagagactaacactgtgagagtatatagaaggtatatgggaattcactgaaaagcaaaggacacttcagattttagacaagagaaggtgggtgatcagcatgcatggaggcattcggctgagaaaagtaggagccccagtacatgagaggggcagagtccccctgagctgcccctcccttcccatgccaagaacttggtgcagcagcactgtctctgctccacattctgacaaatttcgaggcacttggagcacctattcttctagattaggagtttaggcccctcctttgctgtgtagagaacttgatgcagtggcagttttcatgctacaagcctgggcatatctcctggcttttggtacacctgccaacctggattaggagcttgagttgcccctcccttcccatgcaaagaccttgttgcagcagtagtttctccactccttgcctgggcagagtttttccaggcatatggcacatttgctcccctggttttggagcttaagctgccccacccctcccacgcagaggagttggtggagcagtgctctttccactccacacttagatatctctccaggcatttgaagcaactatacttcccggttaggagtccacgtcacccctttcttccaatgcagagaacttggaggagtggaggtttctccactccacacccgggcacaagtctgggtgttgaatggctgcccccggactcctcattggagctggtgcttgcacctgcctttgagatacctgtaggtggacctgcctggtccagctccaggcagctttgtcccccactctggggctgagcacagagacaaggccacagggcatagcacagactagcccattgcctgaggaaactgagtttctcatggttaacaaagatcattcatatacccatctctttcagccactgttggctcctatctgtaaacaccacctatttgtctggaggtggaactgcacaacctaatagaaaatctgctgacaagagtgctcagacttgaggaacaacataaacttgccaagacctctgctatcacagccccatatgtggcagcaagtctgctcacactcccaggacatcactactacaaccaggatttgagaaagccaccacacaaggctatctgtaaccaatgaacttatactgaatccttgccatttaaagcacccagaaccaaagccaaagaaccctgcacaacatacattataatcacatcctcaaggatgtgactcattaagaaaaaaattaaaaataagaatagacagtttctccagatgagaagaaacagataaacaattctggaactatgaaaacaaccaaccaaacaaacaaacaaacaaacaaaccgtgttacaagccctcaaaggttactctaactcttcagcaatggatcctaaccaaaattaaatttttgaaataccagataaataattcaaaatgtgatttaaaaaaaactcagtgagatccaagagaaagttaaagctaacacaaataaatcagaaagagaatgactcaggatatgaattaaaaatccactgaaaagacagctttttaaaaaataaacaaacataacttttagaggaaaaaattattgaaggaattacaaaatatagttgaaagccttaacaacagactagaccaagcagaagaaagaatttcagagcttgaagacagatattttgaattaaaccagtcagacaaaaataaagaagaatattaaaatataaacactgcattcaaaaaatatgtgattatgtaaagtgtccaatcttatgagtcataggtattgctgagggagaagaagagtaaaaaggttggactatctatttgagggaatgattgaggaaaactaccttagtcttgctaaagatttaaatatccagatacaagaagctcagagaactccaggaagatacattgcaagatggatttcaccaagacatatagttactaggcaatctaaagtcaacatgaaggaaaaaaaatactaaaagcagcaagagtaaagtgtttaatcacctctaaaggacatctcatcagatgaagtggatttctcaattgatacctcagaatacagagatcatcaaagactactagaacagctgcatactcacaaacttaaaaacctagagaaaatggatacattcctggaaacatacaaccctataaaccagaagagactgtggccctatgttcagtcttaaagggaaaaaaactatcagacatgcattttgtatactgctaaacaaggcttaatacatgaaggagaaatagtctttttcagccaaacaaatgctaaggaaattcatcactattagactggtcctacaagaaatcctcaaaggagttcaaacatggagataaaagggtgatgcttgccatcagaaaaacacacagaagtataactcacaggtcttataaaataagtatacaattgagactgcaaagcgaccaggtaaaaacactatgacaggaacagactcacatatcaatattaaccttgaacatgtaccaagtgttcacttaaaagatagagattggtgtaatggaaaacagcaacaacaacaacaaacccaaaaaacaaaaacagggttcagccaaatgctgctttcaagaaacacacttagctgataaagacattttcagactcaaggtaaaggggtggaaaaagatatgccaatggaaaccaaaagagaacaagagtagttatacttacatcagatagaataggctttatatcaaaaaacagtaaaaaaaaaaaagacaaaagaggtcatcagataatgatacagggttcaattcaataaaaagtaaaacaattgtaaatatatatccacccatcaccagagcacccagattcatacaaaaaatgctactagataaaagagatagacagcaatacaatactactgaagtacttcagcaccactaacagcactagatagatcattgaaataaaacaaagagacactaaacttaaaatggactccattgcaatgaacctaatagatgtctacagaacatgctacccaacaatcacagaatatatattcttctcttgagtgcataaaacattccccaagagacaccatattttaggccacaaaacaagtctcaatgaatttggaaaaattaaaatcacatcaaatatatttttaacctcagtggaataaaactagaaatcaattccaaaaggaactctgaaagctatacaaatacaaggaaattaaacaatctattcctgaatgatctttgggtacatgatgaaattaatttggaaattaaaactcttcttgaaaaaatgaaaatggaaacataacatactcaggcttctgggatacagcaaaaacagtgccaagagggtatttttattgtgttacatgcttacatcaaaaagatacaaagttcaaaaattaacaacatatcatcacacctgtataaatgacactactataaatggctatacattcacaacccagaaaaatctaaagaaaatgaataatttcctgaaaacatgcaacttcccaatattgaaccaggaagaaacagaaatcttaaacagaccaataaaaaggagtgaaatagaattagtaatttaaacatctctctggaaaacccaggaccagtcagattcacagctgatgccaccagacatacaaggagaatttggactgatcctactgaaactgttccaaaaagttgaataggagggattcctcctaactggtactatgaagccagtatcagcttgatactgttgccagacaagtacacaacaaaaaaagaaaactacaaaccaatatcactgattaatatagatacaaaaatcttcaataaaatgctagtaaaccaatttcaatagaacattataaagaatacaccaaaattaagtaggtttcattccagttacagaaagatggttcaacgtatgcaaataataaatgtgattcactacataaacatttgataaaaagcatctgatgaaattcagaatccctttatgattaaaaaccctcaacaactaagcttgaagtaagctatctcaaaagtataaaagccatgtatcgcaaagccaacatcatactgaatggagaaaagttaaaaacattccccctaagatactggagcaagacaaggattcccactttcatcagtactattcaacacaataatggaagtctttgccagatcaatcaggcaagagaaagaaataaaagatatccaaaccggaaccgaggaagtcaaattagctctgtttactgacagttgatcttatacctaggaaaccctaaagattactcccgaagactcctagatttgataaatgatatcagtaaagtttcaggataaaaaatcaacatacaaaagtcagtagcatttctatacatcaataacaaacaagttgagaacaaataaagacctaagttccattcataatacctataaaaacctatggaaaatgttctatgaatacatttaaccaaggaggtgaaagatctctacaagacaaagtacaaaacactgatgaaaagaattataggtgacacaagcaaattgaaaaatacctcatgctcatggattggaagaaaccccaaagcaatctatagattcagtgtaattcctctcaaaataccattattgattttcaaggaattgaaagtcctgaaattcttatggaaccaaaacagagtctaaatagcaaaagctattctaaacaaaaataagaaatcttgagaacatacatacacacacacacacacacacacacacacacacacacacacacacacacggaatactatccagccagaaaaataaaagaaatcatgtcttttgcagcagcatggatggaatgggagagcattatcctaagcaacataattcataaacagaatgtcaaatactgcatgttctcacttgtaagtttgagctaaataatgtgtacacaggggcatagagagtggaataatagacactgggaactcacaacagtgggagggtgaggggggtgagggatgagaaattgcctaatgggcacaatatacactattcagatgattattacactcaaggcccagacttcactactgtataatatgtccatgtaataaagctgcacttgtaacccttaaatctataaaaaatgaaagataaatttatagttcatttatgtaaaatgcattttgtgaatctataagttaatacaaattttataaaagtacattcaaacccacatcaaaataatcacttacattgagacttgttctatttgaaattcttctctagcaaatcattagcaaattattaaatatttttctactccaaacagatatgagtatattctatcataatccatgcatacactgacccccaaaattctttaggtattcaacattccatatttgttattttatatgaaaattttgtttcacaatttgttttaaagtccaattccatatagttattttgaaactttttggattttatatttactttatggcaatgtttaaagtttgcagcagtagaaaaactgaactccaaatgattaaaacattaactttccatttaatgtaagtttgtaggcatctactcattttcagtctgagacttttatttgaataaggatcttgcttttttaagcattagatgcacatagaatatgaatgggaatgggaccatggcagaattcaagccataatgccttatagcctggtttcagataccttagatataagattatttcctcaaatttaaggtgtgctgatttatcaagcacatttatgacatttttataatcacatctataagttttaaataacctttcatgttttaaaggacaaggacaattatatatctccaacttgtctttaattttagttgaaaacagaaccttattaaaattggagcgttatacatgtaaaaccactacagagtgtccttttactcagcacagaatacatcttagatgaagttcacaataaaatattcttacatgaacttttgtcttgttttgaatcataagtgtagaaataaagtcctgaatattttctcatgaaacagataattttaaaataacaataacaaatcaaagtcaaaaaattttctgaatttaaaaatacaaagcatcagtgctttttttttttttttaacagatgtgatactccctgatgaagttttctagggagaaagaaaattttaatagagtcactttggccttaggctcatttatatcccttctttgagacttggtagatggatcttcacatatacgtacagaccccaaactaatatctgatttataaaataaaaaattcttagggtgacattgaaggtgctctattacctgtcttcaatatatttttctatccttacctcttattcacatttcaacattcggttttctaaggaagacatactctgttatgacctgatgttttttgtctgtaagaaatgtgcttccttatcatctccccatagaggaatccttctccaacctgaaaagttagtcctgttgatttctccctgactgtctcaggaaaattgactaattttcttcactgctcccacacgtcttgttcagacttctattataactcttagtgcactgccttggaattatctcttaccataactttctttatcaaaagactaaatattttgtggcaaaagacatgcattttttttttatttccagcatattgaggagtggcacattaaatacacaagtatgttttgactgtgtgagtgaatagtagaatacacattttggtagaaaaactatgctatcacgtcttaatttgtatcatttaaaatgtatgcatctgcttaaccaatggttttatcccactcccctaactgacagaatgaatattataccactgtatcaatcagtaaataagtgggttttatgtcttctcactccacctgttctgttccttcttttactgcacagctacatctacaaaagattaattttttttctttttttctttgtgtgtgtgtgtgtgtgtgtgtgtgtgtgtgtgtgtgtgtgttttgtttgtttgtttgagacggagtctcgctctgtcgcccaggcagaagtgcactggcgcgatctcggctcactgcaagcttcgcctcccggcttcacgccgttctcctgcctcagcctcctgagtagctgggactacaggcgcccgcctaagtttttttgtatttttagtagagacggggtttcaccgtgttagtcaggatggtcttgatcgcctgacctcctgatctgcccgcctcggcctcccaaagtgctgggattacaggcgtgagccactgtgcccggcccaaaagattaatttcttaacacgtcaaacacagacatgtctcatctagtacgcacgagttatttgttgagtgtcagtcttgtgctttgttctttgctccaacagttcattgatagggatcctgggaaaaacccctttggaagcctggacattctcccatttacctcactagccactatactctcctctaaataagttaaaacttctgtgtcttggattaaaagcagactaatacaacttgattacaatgtaggggcaaatgacaacatcaaaatataagaggattattggattttgtcaataaaattgaaatttatcactactggggtactactgcttggatagcctggaacttgggtgtttggttttttttgattagagacatgactagactcaactctacaaaggaaagagtttacgacaatcctctctcagtggcaaactgaggaaacagaacttgcacccagtccatgctacaattattgtgcctatagaaatccaccagtggaattacttttctccctctaattaaggacacaaacccagttttatcattccctccactgcagtttggagtgagaaaaagtcagtacacactacatctcttttgacaacagatttcttttctttcatcaacacccagctaggagaataatgggagatggagctaaagtctatttttgttttattaaataaagagtctaccctttgggcaaagagtaatcaatttggatggggagaaaagataaaactctatcaccaatgatagtagaaaattagtcttggccgggcgcagtggctcacgcctgtaatcccagcactttggaaggccgaggtcggcggatcactaggtcaggagatagagaccatcctggctaacacggtgaaacccggtctctactaaaaatacaaaaaaattaaccagacgtgatggcgggcgcctgtagtcccagctactcgggaggctgaggcaggagaatggcgtgaacccgggaggcgaagcttgcagtgagaagagatcactccactgcactccaacctgggcgacagagcgagactccatctcaaaaaagaaaagaaaagaaaagaaaaaaaattagtctgaagttgtaatgagacaacgggtagctatcaagagatacaggatttggggctaggtgatacttgtttcaagcgagacattcctttggactcatcactaattattgtagtgtgaaatcagctcatggatttagtgacatgatacactacttatcaccacttctcttagtctatttgtacaaagtccaattaataacttatttttaggtatttgtaaatatagttttatgtacataattttacttgaaagtaattctgtagtaaatttgcctactgttctaatgaaaataatgtgtctatataaaacaaattgtataagcaaaatcatcctatttttaggcaaatataactaataatttaattacacttatgctcttagttcaacatgtaatcagttgtacagtaagtgcagaattaacactgagaggttaaaaataactagaagttctacatatatttcatagatatagataaaaatatatttaaaatcaaaataaaggaggatttaatcatctaataatccacaaatgattgcaggaattcactctttctgaattatttttaagaacaatcaagagaaaatattaacaattagcaaagagtaaaaccttcaaaaaattttgaaaataaaaactaacagttcactttataaaatgaatagtgtctaacaggacaacatattactgcttattactaccatggataacacctgtatgtattaatgctataaaaatggtcaaaaatgtctcattacaatatttaaacctttgtacaatatttgaggcaaaaaaatgttttcagcacagaaatgcactatacattttgtgggatttacctttgccatactaatcctacatttctgtactgtcattaaaggtaccaattatgtttttaaaatatattttacacttgttggaatgctgagtacaaactttctaaacaaggataatttgatgcaggccacagtgccctctgtcttctcaccccaaatagttgtatagttttttgatctttcccccatcagcatctgtacttttccactctcctttacagcttctgcatgccataaagcttctcctctctttgacactctaggctggtgaggattttcagatattatcttgtatatagagtgaccagctatccaggtttgactaatatgttcccggttttagctctataagttctgtgtcccagaaacccctcagtcctagacaccccaggagggttggtcatcctgttgatactttctacatcatagcttctgatgtaacgctgccatagagtaaaaatggcatcaagctaggttaaggcagaaagagagagagtgagtccgaagaagtctgcttctacccagtccccttttcttcaggttgctatgagaaatgacatgagccaagatacttatcatggccatggcaaagaaagctgataactgagggccaatgtgccctcccagaagacctataaacacaagctgttgtgcaggacagtcctgaatattcatcagtggatcaacaatgtctttaattgcagcttgtcagttggaagtgatgagcaggtccagtgcaaagtgcattcataaggccaagagagagggctgacattcagccagccatggatgcttcggtgggaaccctacaaagtcagaggctgactcagagaactggtaagatgagacatactgaaagaggctggtggtaccagtgaggaattgaggacactttagaacctagccattgtctccaactctttgatgtaactttctgggagaaggagtaggaaggaagtaggagaagcatgttttttgataacttttactaaaaaaattgctttaaatgacaaagaagtgactgaacatttttctgtcacatttttctaccatcagtggatttgggggtttcgtaactctacttgaattcagttagaactatctgcacaagtgggttgagacctaacaacttaaagccattgcaatattctccaggaaattggaaactcaaggctcaggagagatttatgtggagcagtgagggattaaaagacacttaccttctcaatcaagtttagaaaatcagactgtttgaagatcaatcctgaatcctgattatcacttagaatttacttataacttttccttccctgagaaactgagtcagtttctctgcatttgatttaccatctgtaaacaatggataagacctacgtcctcacaagctttttgtgaagattagcagagacaatgtatatttgaagtatacattaagtgctcagcaaaaatggtattaatgttgaatgattagtattattttatttatttatttttgagatggagtctcactctgtggccaggctggaatgcaacctctgcttcctgggtttaagcaattctcctgcctcagcctcccgagcagctgggactactggcgcatgccaccatgcccagctaatttttgtatttttagtagagatggggtttcaccatgttggccaggatggtttctatctactgacctagtgatcggcccacctcggcctcccaaagtgctgggattacaggcgtgagccaccacacctggctgattagtattaaattcttcgaggactaaagaacaaatagaaaaggtaagcacagataggacataatatatagatgtataaaatatcactttccccatgtataatatgatttatagataacatatgaacacataaaaattaccttttgggggagaaaaggagaaatattggttaagagtataaagtttcaattcgataggagaaaatattcttggtgatctgcacagcaaagtgactatacttaataataatgaatgaatgatatattgtatatttcaaaattgttaaaacagtggattttaaatgttcttaccacaaagaaatgataagtatgtgaagtgttatacatgttaattagctgatttgatcattccacaatttatacatgtaactaaacatattgtactccatagaccatataaaattagtagccaattaaaaattaaaatataattttaaaaatgactttgtaatggttgtcatttgtaatggttgtcatgattgactgctgaaaaaaagtaatgaacaacctcacttaacaagttgcagaaggcaaaagctaactactatatttttctgcactattcactcattagggactcaattcactcattacctgcacagccgtctgctagagtatgatcttaaatcatggagtccctgaaaacccaacttggagcaaatatcagttgcttgttatgtttctctgaagagcaacatgagagtgatgtaacaggaaattggggcttattcctctgcctctgttgacagtaagaaatgattaaattctacaaaaaattcatcttttctttttttctgttgtatttcttgctttctccacacagagaagagcgcacatatgcagatggttccaaaactatttatgatgtatttttacatcatgttggagaatgtaaacacacacacatgcacacacacacacacactcacaaccatggtgctcacccctcatagataggaaagtgtttaaaatttatttggtatttgggtctttttctttgcaatactgattatcctgttttatacaccactatgttattgtcttgaaagaaaacaagcatttatagtgtattgattttagcaaatctatctctagtttactttacatttgattgctctagttttgaaatggaatttatttcataaaatactctgtggaatggcatgttagaaatacattccctgtgcaagtatattaataaagttattgaaagtaacttgctgtaaaaccaaactttctgaatgggaattatgaacacaatataaaacagggtattggattgcttgccatggtcattctttaacaaaccttcagtgcttcttttattttgaaaaaatataaatatttgatataatgttaaatattaccacaggaataaatgcaaaagcaataaagttaaattttaaggaactatttttatgggtgtatcagtctgttttcactgtgctataaaagaactaactgagagtgggtattttatgaagaaaagaagtttaattcactcactgttctacaggcttaacaggaagcatgactgggaggactaaggaaacttacaatcatggcagagggcaaaagggaagcaagctccttcttcatatggtggctggagagagagacagagcaaggggagatgtgccacacacttttaaatcatgagatctcatgagaactcactcactatcataaaaacagcatgaggcaaatcctcacaatccaatcacctcccaccaagtcctttccccaacactaaaaatcccaactggagttgagattttggtgggcacacagagccaaacatattattccaaccctggcccctcctaaatctcatgtcctgacatttcaaaatacaatcaagccatcccaacagtcccccaatcttaacttattccagtattaactcaaaagtccaaatccaaagtctcatctgagacaaaacaaatcccttccacctatgagcctataaaataaaaaacaagttagttacttccaagatacagtgggggtacacaaattggataaatcctcccaatctgaaagggagaaactggccaaaacaaaggagctacaggcccaccaagtccaaaacccagttgggcagtcattaaatattaaaggaccaaaataatgccctctgactctatgtctcacatccagggcacatcgatgcaagaggtagtctgccaaggccttgagaagctcctcccctgtggctctgcagggtacagctcctcctgactgctttcatggtctggcattgagggccggaggcttttccaggcacactgtgcaagctgttggtggatctaccattctggggtgaggaggatggtggccctgttctcacagctccactaggcaatggctcagtggggacactatgtgggggctccaaccacacatttcccttctgcactgccctagtagatgttctccctgagggctccgctttgcagctgacttctgcctagaaatccaggcatttccaaacatcttctgaaatctaggcaggagttccaaaacctcaattcttagcttctgtgcatctgcaggcccaacaccacgtggaagctgccaaggcttggggcttgtaccctttgaagccacagcctgagatgtatgttggccctttttagctgtggctgaagctgaagcagctgtgctgcagggtgccatgtctcatggtagcacagggcaatggggccctgggcccagcccacaaaaccaattttccctcctaggcctccaggcctgtgatgggaggggctgccatgaatgtctctgaaatgccctggaggcattctccctattgtgttggttattaacattttgcccatctttacttatgcaaatttatacagcaggcttaaatttctccccaggaaatggggttttcttttctactccattgtcaggctgcacattttccaaacttttatgcactgttccctttttgttttttgtttgtttgtttgtttagacgtagttttgcacttgtcatcctggctggagtgcaatggtatgatcttggctcactgcaacctcggcctcctgggttcaagtgattctcctgcctcagcctcccaagtaggtgggattacaggcatgcaccaccatgcccagctaattttatattttaatagagatatggtatctccatgttggtcaggctggtcttgaactcctgacctcagatgtaccacctaccttggcctcccaaagtgctgggattataggcgtcagccaccgcgcctgccccttccttctttttaaatataagttccaatttcagataatctctttgttcacacatatgagcatatactcttagaaacagccaagtcaaatcttaaatggtttgctgcttagaaatttcttctgccagataccctgaatcatctcaggttcaaagttccacagatctctaaggcaggggaaaaatggcatcagtctctttgctaaagcatagcaagaatgacctttgctccagtttccaataagttcctcatctccatctgagaacaccttagtctggacttcattgtccatatcactagcaccattttggtcaaagccatgccacaagactctaggaagttacaagcttacctgcatctttctgtctccttctgagccctccaaactgttccagcctctgcctgttccccagttccaaagtcacttccacattttcaggtatctttatagcagtgccctattcttttggtaccaattttctatattagtctattttcacactacagtaaagaactacctaggctgggtaatttatgaagaaaagagtttcattgaatcgcagttcctcaggcataacaggaagcatgattgggaggactcagaaaacttacaactatgctacaaggcaaaggtgaagcaagcaccttcttcacatggtggcaggagagaaagaaagagcaagggaggaaatgccacacactttaaactatcagatctcatgagatctcactatcatgagaacagcttggaggaaatctgccccccatgatccaatcacctcccacctggcccctcctccaatactaaggatacaacttgagatgagattctggtggggataccgagccaaaaaaccatatcaatgggtgtatttcagatttaataaattctgaaaatatttagtaccataccttcagcttttcttcattgagctattggcactattttcaagtaattagggtcaaatatattagctaggctatgggaaaaaatgaaatccccctttttttttgtaaaataatatttgtaaaaaaaacatgccatcacacccagctaactctttgtatttttagtagagatggggtttcaccatattggccaggatggtcttaaactcctgacctcaggggatccgcctggctcagcctcccaaagtgctgagattacagacatgagccactgcactggcccctccccttctcttcccttccctgatctgcccttctcctctcctctcctttccttttttctttctctctcctttattctttctttctctatttatttatattttttatgaaaatatatccaacaaggccaaatgcagtggctcacgcctgtaatcccagcactttgggagactgaggtgggcagatcacgaggtcaggagttcaagaccagcctgaccaatatggtgaaactctgtctgtactaataatacaaaaattagatgggcatggttgtgggcgcctataatcccaggtactcaggaggctgaggcaggagaatcacttgaacctgagagacggagtttgcagtgagccaagatcatgccattgcactccagcctgggtgacggagtgaaactccgtctcaaaaaaaaaaaaaaaaaaatatatatatatatatatatatatatatatatataaaatctaacaaattgttcactgtgcccttccactgagaaacaaatacgagatgatttcacagacaaacttagagtgaaatgtattcattattttctaagtctaatatgtacttaatcatttgaacagaatttgagtattttattattttgtgacaataatttgttacttcttaccttaaaggatgctaaggagagcaaaagaataatttgtttatagtgaaaaagcataggttcagtacagtaaaagaaaaactgaaaagaagtcaattattttaagtctacagatcattgaaagttctgaagtcaaatcaaacagtttgaaattttatatgtgatgatatcactggggttaacctcactttatattcacatgagctatatatttttttgctctacaatcaaataaaggtaaaattgtattttttcctttttacattagttttcataagtgaatttaatttttaattggatgtactaattgtacatatttattgtgtactagtgatgttttgatgtatgtaatatatagtgatcacatcagggtaattagcatattcatcataccgtacatttattatgtctttgtattggaatattttaaatcctcctctagctagttgaaagtatataagatattactgctaattatagtcaccctgcagtgctacagaatgctaaaacttattcctcttttctagctgtaattttgtatcctttaccaaatctctccccatcttccctttccccatactctttccagcctctagtattctttgttctatttttctttttctattttttacctttatgatttttattttgcattcatatatgaatgagaacatgagatagataactttctgtttctggcttattacacttaacataatgtcctccagttctttccatattgacacaaataacaaaatttcattcttttgtatggctaaatagtatttaattgtttatatataccacattgtctttattcgttcatctgttgttggacacctaggttgatttcatatcttgactgttgtggatagtgctgcaataaacatggggtacaggtaatctctttgatatactgatttttttccttttggtaaatgcccaatagtgggattgctggatcatatgttagttcaagtcgtagttttttgaggaacctccatatttttctccatagtgactacactggtttacatttccatgagtggtgtatgagctccccctgtttttgcatccttgccatcatttggtatttttttgtgtttttgatagtagccacgctaactggggtgagataataccttattgcgattttgattggcatttcttgtatgataaattgtattatttgatgaataaattatcacctggagcattctaatattcccaatattaacatgaaataaaatttaaattaacctagaataatgaaaaataacaaaatagcaatgtattaaactattctgtttgattcatgtatttcaatatatttcagaataatcataagagatatttaaaagcattctactgtaaattcatattaagattctgcaaagtatttattaaaaataaaatagaacactttgagaaatttcctttttttgaaatagaaaatataaaaaccatgatgataataaaaatgatttttaatgttgccttcatgtatatatttagcaagaggaatactcacacaagatggacaggggtgatgaaattgaattctattttatgagaaatttaaaatggttgaatcagaatctgatggtatgctttagtccttctgaaaagtctattacttttttggtctttaaagaaaattattggcaaggaattctttatataggggtcaccctatgaaaggatgaaccatttcccttaaatgtgtccctggtcatatcagaaagttttattatcacttcagggtagctctctgataaattgataaagacatatttaactgaatttgcaaccataatatgagccctttggtgataaaggtacagaagcaaagctttcttatgatgtgttttggagtttgagaaaaatcagttttccatgaaccacctcaatgagcaaagccctgactgctagatcatcccttatcacaaaaagggcaggctgtttataatcatatcttctacccttccgttattcatgtctgtgaaggcagcaggagatcatgagacacttgtagggccatgacaaggaagagcctacatatcttacattgatgatgctggcaggaaaagtgttggcaattgtgtatgaatggagctagatcctgttgcttccttgagtcaccttgtggcttgtttgctacactccaagccaatgccagctagtcactttcatattaagacaaaaatagatctaattctgcaggtagaaaataagaacctacattacttttttatcatacttatatgaaaactacatggcgtaatgggacagcaactaaagaaggtgcgcctcactctactattacaggcctaaatcatttctttttaggtttatagatgttctgcagataccagctgaactgtgtgttcttatgtaaatgagtatttagtattatttttgctctaaagaatgcctaactctgtttgcctagctcaaaagcagccacagaaagacagaaataaatgagcacagctgtatttgaatacaactctatagacactgaagtttaaattttatataattttatataattttcacattattaaatattattcttgttttaaaattttaaatcataagtttaaaattgctttcccattacgctatgtaataactattgctagctcacgagcagtacaaaaatgggtgtccagatggatttggcctacatagttcccacctgtgtaatagccaatttagtgactacagacacatgtagtaaataaataaccaggtgatttaaacatcgttttataaatgctaagattaaaaagggcaggatatgattggatcacctaaaaaatgtatccagcttgatcttacagaaccacgaaattcttcctgaaggagatgaaaaactgaggtaggaaagatggaaagaaggcatccagctgaacatgagaataaggtgtcaagctaaaggaccagcattggtggaggttaaggagatcaagagagagcaaagcaagtttaaggaactaaaagtattaaagaagagctaaagtgattttgtcaagactatatctacttttcaaatatgtttctgcttcagatatgtatatatatacacacacacatacagatgtaaatatatataaatataaatattcatttattattgttggtagaaataattttttttacttctatccttatattcctttacataagtttgacaatgacttcaacaacagaaattgcttgtctctcaatctttgttttactgcttagtagattctagaaatgttttcttattagcaaggagtaggaaagcctaccactgaagtttgagagattgttttgagaccagtccctattaatactttcttttgactacctcttaaaagaattatacaagcatatttcaggtggaaaggatatgtatatacaaacaggaatagaaatggtttgtaaagaaatgaaaagttattgttttaaagaaattatatcaaatactatttgttttttgtccgctgataaaaagaacatggaaagctatataggtatgattatttcaaacagtcgtattcagaaaagacaaacaagctattctcagagtagtggtggtgatcactaattgttttaaaaacaattccaaaaggatttatcccatatgaaaatgggttaactcaccagtgtactttaatagaaattgtagacatattgacccataatggttgccagtgcttctgaggttcactgtttcactaaatttcctttaaactcaatcgtcgaaactaggtgcagctttacagtaggtgagtttggaaagactttgaaggtatgcaacatcactatcacagtcaaagtgctctttaaaatgcatcatatttctaggtgaattattattattagtagcagtattcataaaggaacctcaaatgagcttttgcatttacaaaccgaaggtttagtttgtacaaagcattttaaaaatattgaagtctgtgacattagagcccgtctttgtaggttacttccttctacagcacagcagaagtttgtacattcttagaaactcataattatgaggaataaatacttttttgatcaagagggatataatatattgcaattcaaacaagtccaaattgccaaatacaattgttttaactgagcccttgtctgtttgaaatttccttgatatttaacactgatgagcgccaattccccttctgaaacttgctattcctttgattccaggatatctctcattccataatctcattctctttaacaactattcaaattcttcacttttccttctatgctatatatataatttctcaaacttttgctatattattgtatatagtattaatttctagtctcaaatttcttatgtatctatagctagatcccctttcttattcctagtatttgtgattctcctctttctgaattgccaaatatttgcctatgttatgagacttttcaaataactatcttgtgtttttgttgataaaatctacacttttgtcattactttatatgttgatgttcctgtattatttcatattgattttgatttctattttacttaggaatgctctctctacttattttggaattaatttgtttttcttatttttctttagcttacttgctttaatttatccattataaattgctattaagtttactgcatacatttcacattacacatttttctttgtactactttgcataagtttttagtatgtagggcttcattgcaattcattcctaaacagcttataacttctgttttgatttcactttcatcttaggaattctgtaagctgctttcattttagtttgttgttaatttcatttttaaattgttttgtgttcaataaatatggtctaaaagacttctgccttacagaatttattgattatcttgtgctttcatacatgttcattttgctctgagtttattcatgtctcaaaagaaggctccctttttgtctgctgtatgcaatgttctaaatgtaagaactagtcacctcattgcattatgcagatattctgtgttcttattgtttttaatctatcttttgtattcagagagaagttcctatttgattgtattttaaacattttttcatctctcgtgtaaatagatactgctttattatttttcaaaatgttaatataataagaaatatcctgtttcatttagtagtttttcacatggaatccttctttcttttttggcattttcctgttatttttgaccaacaattaattttataaaaatatatctttattcatctttttgagaataatacatggttggtgttttccagtctaactaatctgtttttagggaatccattttggggtagactttcatacattctctcctatatcagctgtcctgtttagcatggtcttcatcttccatattggttgtttttcaaaagtttgtgaacatggttgtctaattagttttgaatatgagtatctgttgatttgtgtaagtagctgtatcagcttttcttttgaatttttgtagttacatagtttttgtatacatttatggggtacatgggatattttaatacaggcatacaatgcataataatcacatcagggtgaatgggatatccatcacctcaagtatttatcctttctttgtgttacagacaattcaattatagtctcttagttattttaaaatctacagtaaactactgttgactgtagccatgctgttgtgctatcaaatactagaacttaccacttttatctaactatatttttgtatccattaactatccctacgtactctgcctcctccactacccttcctagtctttggcaatcattgttctactccctttctccatgagttcaatggttttaatttttatctcccacaaataagtgagaacatgtgaaatttgtctttctttgcctgggttatttcacttaacattatgtcttttagtttcatccacgttgttgcaaatatatctttgttctgttggtatgtagttctcaggatacctgcgtcctaactaggaaggtttcctcaaacttcttctacatggatatggcatagttcattaggttatgtggatacagaaagaggaagagtgacatatcctttctcaacttttcttttccacttttaaattcagggggatgtggacaggtttgttacatggataatttgcatgtcacaaagatttggtgtacagattatttcttcacccacgttttcagaatagtactcaataggtagtttttcaatcctcaccctactcacactttccaccctcaagtagtccctggtgtctgttggttccttctttgttttcatatgtactcaatgtttaatccccacttataagtgagaacatgtggtatttggtttactgttcctaagttggtttgcttaggatatggcttctagctccatccatgttgctgcaaagggcatgatctcattcttttttatggctgcataatattccatggtatatatgtacattttctcaattcagtctaccagtgatgagcactcaggttggttccatgcttttgccaccgtgaatattgctgcaatgaatatacatgtgcatgtgtctttatggtagaacgatttatagtcttttggatatgctcaataatgggattgctggatcgaatgttaattctgttttaagctctctgagaaattgccagactgcattctacaatgggtgaactacattacattcccaccagcagtgtataagcattaaattttctctgcaatctcaccagaatctgttattttggactccttaataatagtctttctgactgttgtgagatggtatctcattgtggttttgatttgcatctctctaatgattagagatgttgagtattttttcatatgtatgttggccatctgtatgtcatcttttgaaaagtgtctgttcatgtcctttgcccactttgtaatggagttgtttgttttttgcttgcacatttcaagttttcaaatattttctcccattctgtaggttgtctgtttactctgttgattgtttcttttgctgtgcagaagctctttagtttaattaggtcctatttgtcaacttttgtttttgttgaaattgcttttggcatctttatcatgaaaactttgccagatcctatgtccagataatgaggtctttactgtaagactggagcatttttgtttacttctgtcaaatcccttatgaattacctttcattattacacatacttatgcattttgttttataaaaatacagaacactaaatacacaaaaactctagattctacccacgtgatcctggttgcacttctgaggctttcccaggattaatttttggggagagattggggaaactgaagataatttttcaaggtgtctcctcttatctttccttataatccctcttcttttacggaataaggaaggggaaacagcaggaaaatgttaacataagtccatagttgtaactgcaaaggcttgtgattggtattatttaatgttgacttgcagatttatctccactcaatctgggagcacacctagacctgcagagggaagggaaagcataaaggtacctgctatcaccatgcatctgcttagtgtggagtagattatagcattagctcaccatttacctccatacaccagtttctcaattcagcaatgggtcctatgtggatctgtggcttaagttagttaatagccagtacaaggacttcattttctgtccttgaacctcagtctgttatgtataaattatagttcctaaaactgaatctcctgataacatgtgcctgctgcttaagtctcagtcagccctaatctggccaatcagatagactccaaattcctcaccttgatttgaaacttcccactgtaaaatttacttttctcagactaaattttgggcccatctttccctgtaactctctcctttcctaaatttatgaccccttatctgacaccttgcctttttctgatatttgacatgcttaaatctaattctttcttctggcactaaattagagtgctataaaatatttgtatttgcaactatttcatgtttatcttacagactcgtttttgtcactagggaaaggtatttctagtgcctatcagataagtaaatagcctgtaaatagggagtgcaaactcgaatgcctagagatgtccgtgacagataatgtaaacaagtgaaactctcctgggataaaacagcaggagggggtaactgctgaaaaccttacgactgtttaaagacattccaaatcaaattatttctaaaaatcagtaaaatatgagtcaacaaacagacaaacaaaacaagtgtggtctgcattgccaccttgagtaactcctctaaaccaaatagacttctgctcatccttgcaaggccacatccagccattaggtaacttcttgtttgcctcccataaaggctgttcatatagttaatttttgacatgcttttacctcaataaaattatcctgaggcaataggatagaagataaaccttggttcaaaccccaactttgccacttaaaactgaaccaccgcacggcaagttattaaattttaggagcttcattgttctcttttataaaacgggcataaaaatgtatgtaataaattattgttgggaagattaaatataatctaagaaagagattataggaaaaaatcaaacatttcatgttaatcctcttttctgtcatacatgttctccaaatattgatgtttttctctaggccacaaaattttcttaagagtaatcctacctatagcagttggaagtcaggaccacagtatttttgaaagacaaatatttacaatctattataaaaatttccaatatcatttttgtttttatttggaaatatcttcatgaattcctattcaatattcaaaacatcacaaatatgtagaaaaggggataaacatcaaggtagtacaatatatctaattttttggttgaatcaaaaatttaaaatatagctgctagctgttttgtgttttgtttctatgtagacttatctctcagtaatgatgatgcttcaaaagaacacatctatatcaggttctatctctacacaccctttactattatcaacttgtaaaatgtatcagccaaacaggacctgctacaggattgctgatgtctataaaaatgcagaaagcactaaatcaaaacgggctgctgaaaaactaaaaatcaaatatcacacaaatcactcagctgcctgggcttagaaagagagcatttgaaagctcatatgtggactgatattgccaattgacatactcggttgttttaagcaaatcttttaaaaattcattgcttgaggagatcgagcaaacctgtttttctggccagatatgcttttcctatttccctggcttatgaagtttcacaggatgagttttaaattactcaggaaatagctatagggtatcctatttacatcataaaagatatactgacagaactgcagggtttacgccaatctataacaccagacaaagatttttcactgtgctgcaggttttataaggagacatttaaaaacatatataggaaaaatataatcctttatatgctatttaaatatattctctggctatctgaaaggctttctattctttgaaggaaaaattctattcccttttttttgctgactactgctctttgtgtgtagttatatgaaattatcagaaatattaaggctatctatatgtactatatttaaagtgggactcttctgagctcatcacatgtctcatcattagcctttcacatatatttcaaataaaaatgtaattatattagtaataatgcttttggtgcttagggaatgaataacacttgccacactgtccagttggtatcttagactaaaatagttgacacttgctgaaaatttttcctatgcttcattagcttactaagtgagacaggaacattcctgtcattgggatctttgctagatttctgatgttatgttagtttattctcatgctgctataaggacatgcctgaggctaggaaatttataaaggaaagaggtctaattgactcacagttcggcatggctgcggaggcctcaggaaacttacaatcatgacagaaggcacctcttcacaggagagcaggagagagaatgagagcccagtgaaggggaaagcccctttttaaaccatcacatcttatgataactaactcactatcatgagaacaagatggggggaacccccatgattcaattacattcaagaactacaattcaagatgagatttgggtggggcacagctaaaccatatcagatgttatctaattatatagtagactgggatataaaatagacaaggcagactgttgtattaagtggaaactctagtttatagatattaacatgattttaggtattattctttataccttagattctcaaagcacttgataaataatgaccctaaattggtggtgaacatgctgttggagtgttgaatccaataaagttaaataaacaaaagaaagaaatggcatctaaaaggacaaaaaaataaggtacttaaggctctgcacctatttttctgtgtttatagtgccttaaatatcaccctctgaccaagaagtaatgaacgggtttggggcttttcttaatgtgttttatacttgctttattgctaatatattgattagtttcctaatgagatcacagcaaagttgttacttctaaataaaagctttgccacaaaggttgcaagtaatgaacactataaactgtatgtaataaaatgtttgcaaatagtcatcctttggttcatatataaggtattctggagaaataaaaacttccatgaatttattttatactttttccagcaatcctaaatgctaacaacaacacactattttaatctgaggaaattgccatgaatttgaaaataatctcaacactttgaaggaattaataaaaacaaagagttgtgtacatattcaattccagtagataatattacagtatcatagatatattaattaagaatatgaatgtttaaggataattcttaagtttcaatgagattccaacccaattaaacaacaaagatatgtttcccttttaaattatctagttgacttaatctattgcttttagaaaaggattgttagaagtaatatgatagtgatgaataacccaaggtttcattactgccaagaatccagaatgtgtttacatatctctcagatgccagaagaacttggacaggagcgaatgccttcatgattggtgaagaatttttcttgccttgactggtaattgtctgaatcttctagtagtgatcttacctcttgttttgaagttgagaatatgaatactcatgaagagaaaaggagaggagacacatttgaattgagcttcaaggtattaaataaaatgttgcttgtccagcatccaaagaaatctgcaaaatctgcaaaatcttaggctccaagcactagtggtctaaaatgaaaataacccaagatatccatcagggttatgcaaacaataggggaagacaatctgcccttgggcattttcttctcttcttttgtcacacaggtctacccagctataatggaatacaactaagagagcttcttgttcgttggctgcttctctctgagaatttaaacatgaatctctcactaaaaaatgtggcttggtcaagagaatgacagataagccagcaactgggataacatattttcgaaacacattaactgataatgaactggtattcaaaatatacaaaaactcctaaaaaccaccaccaacaacaacaaaactacatcacaagcaaaagatcctaataaatgtttcaccaaataagatatacagatggcaaataagcatatgtagctatccacacgatttcttaaaacccatcaacaacaacaaaattacattatgtgcaaaagatcccaatagatgcttcaccaaataagatgtacagatggcaaataagcatatgtagctatccacgctatttgtcatcagagaattgcaaattaaaacatcactacatcacctattagaatgggtaaaacacaaaacactgacaacaccaaatactggcaagtatgcggagcaacaggaactcccaatcatttctggtgaaattgcaaaaatgatacaaccactttgaaagacagtttggcagtttcttacaaaagtaaacatattcttaccatataatccagcaattacactctttggaatttaccaaagtaaattgaaaatttgtgtacactcaaaaacctgccacaaatatgtatagcaggtttgtttctaattgccaaaacttggaagtatttaaaatattcttcagtaggtgaatgaataaatgaactgaagtatatctatacaatagaatatgtttcagggatggaaaaatgagctacctaaccacaaaaatgacatggaggacacttagacccatatggctaagtgaggaagccaatctgaaaagtctatatactgtatgattcttattatatgacattctggaaagaaaaaaccatggagactataaaaagatcagcgtttgccaggagttgggttgggggaagggaagaatagaggaagcataggatttttagggcagttaaaatattctgtataattctgtaatggtggatacatgccattatacattagttatacctattgaacgtacaacacaacaaatgaactctaatgtaaaacatggactttagttaacaataatgtaccaaaattagcttatcaattataatgtgtcccatgaatgcaagatgttgataaaagaggaaactggggtggaaggagggatatgtttatagaaactcttcccacttctcactcaatatttctgtaaaactaaaactgctcaaaaacataagagctataaattaaacattattttaaaatgctgtttgatagattagtgataaaatggagaggctggaactggtttagtaattactagtgctctcctgcctggggatcacctctctccaagggccaccataaatgctaacttatataaatgatgctctctagatttatgcaatacttaactacaaagagatatgaaataacaacatcttaatctcttcttaaactcaagaatgaacacaatccagggcttggtttttgtgctttttgaacatagagactagagattaatatctccatgtgaacatgagctaaataagtagatatctgggagagatcaccaatataaaggaaaaatgacatatgtaaatgaagcagattttaaatcaaaggattaaaaataaccatgtcatttagccttatgtatgtaaaggaagacactagtaataagaggctgaaataagattttatttaaatgtggatttttgacatatgaaaaatataatggttgaagaaaagaaaatggtagatgggatttttaaacatcaggattattactactgaagaaagaattatggatggagccattaatctaaacgaaataactcagaaacagaaaatcaaatactacacgttctcacttataagtgggagctaaccaatgggcacacatggacttaaagatggggaaataacagacactggggactccagaaggggagagggaaggacggggttgagggttgaacaattatctgttgggtacaatgttcattattgggcgatggatgcattagaagccaaacctcaccattatgcaatatatccacgtaacaaacttgaacacatattccctaatccataataataataaaataatcctgcaatgaaaggcaaaaaataaattaattcatctgggatagctggaatcctgtgacccaagtgaagaccatgaaatttataaaataattattaattcttgccaaaaatattctttaaaaaaattattctatagaggaattcaccattttttatttcctttcaccagtgtcttggaattattttctaagaataaattcacaggcaaaggaatgaatgtgtatatatgcttctcaaataacagtctaatgtgggaaattaagaaacaaaaataaggggataaggtttatatttctttacatcacagttgatttgtaaaattaatatgttttatattcatcgattctattgattctaggacagaggtggtactcaagactcaaggtattagaatccttgtctgtcacagggacaaattcttaccaggagaggataggaagtgcctgcagggtagagttgacagatttggcaaataaaaatagaggatacccagttaaatgtgaatttcaggtaaataatgaacattttttttagaataggtatttcccaaatatcgcatgtgtctttcatactgataagctagccccaccacagacctattgaatcagaatttgtggggatagggactaaggcatctagtttgtataaaaattcgtcagtaattctaataggcagacaaggttgaggctcactatgtttaacgattatttatcaatcaaacctcctataagatatatgaaatgacacttatggccgggcggtggctcacgcctgtaatcccagcactttgggaggctgaggcaggagaacggcgtgaacccaggaggcggagtttgcagtgagccgagattgcgctactgcactccagcctgggcgacagagcatgactccgtctcaaaaaaaaaaaaaaaaaaaagaaatgacacttatgaggccatgaccacacaacaaatccagatatggataaccctcagcccttgggcgtcatgttgactatgatattctgtgttggttgatgactgctatcaagttttcaattttatcctggttttctttttcatacattggagaacaagctacaagccccactacccccaataatttcctcattttcaaagtcatcagggaatgtgtgcaaaaataaaaataatgcctgctataaaactgtttaactactgtgtgaaaaattgaatttccaacataactcatattatgtttcctctcataaaacatgaaatggttgaagatgctaaatatggcacagtggatatgaaattgattatatcaggaaatctagtcatctgtttcctggctatgccatttaacttctttgggcctcaatttcttcaccagtaaaacgatgttttgtcttgttgactgcccacttttaaatgtctgtaagatttagtgtttacaatgtctcttggaaacactaaggttggtattcataagttattggcagatcatatgttttaacaagaatgttgtagaaacaaaatagattatcatctgtatttatgccccatacttgtcatctgagagaattcttaaatgcaattcaatgtagattacaaatttgcagtctacaattgataatcacactgtgaaccttccagaatattgaaactctattttagaggaaacaaatgtgtcttgctttaggcttacctgcagaaatagtcaataccctatttagggtcatgaagcaggcacaacgaaattttcatgaatattaattgagatttagcttgcaaaatgaacatggaaatatctctcagatactgcccatcttttaaggactgacactaaagtaaggctttcctttaaataatatttaatagactaatatactctttttccttctaatttttaagctaggataagtgcattccacattaaaaaactgttctctttaaaaaacttaactgcatatgatggtgatggatgattacttttcttcatttcaagtttattgggtctatctcctagtttatttgtatgttttaaccaatgcatctgattatattaatctcaagatgaaataaatgtgccattaaagtccatatgtaaaagaatagtttaaagttatgaaaataggccagttctcaattacatatattttttgttcaccattaagtaatttatcactggttcattttagggcacttgtatttttagtatttacgattcaagtacattacagtagtcctttcttatctggagcttggctttccatagtttaaattaccaatggtcagccatcttctcaaaatgttaaataaaaatccagaaataaacaattcataacttttaagttgcatgccatgcttagtagtgtgatgaaatcgtgcactgccctgtttagtcctgtctgggacgtgaatcatccttttgtccagtatccacaccgtaggcactacccacctatcagtcacatagcagccatcttggtcatcagattgactgtcatggtatcacagtgcttgtgtcctagtaacccttattttacttttattacagaatattactatgattgtcctatttcattactagctattattgttattctcttactgtgcctaatttatgaactaaaccttatcctatatacatatcctatatacatatacatatcctatatacatatcctatatacatatatcctatatacatatatacatattatatatacataatataattaggtttcagtactatccgtggattcagtcatctgctagaggtcttactgccatggggaaggcggaactactctactgcaatcaatttatatcttcattatgtgctaaaggaaaattaattttaagaaattcaggtaaaactatattcacgttctcttatgtggcttttcatatctaaaattattatacatattgtgctgatacataaatacaaattgtaaaatgtgtcctatgtaaataaagatggaaatcagaattcaataatatttcaatggctataccatttaaaaatacacatgtatagtcaatgaatacaatttttaaaatgctataattttttagccaaagcttttatctttcatttgagaacttgaagactgtcagcaaatttcaaaggctttaatcatccaaatttttttaacattccaaagtattaaatattccaaaagtagattcgaactttctttaccccaactctgctttaggaaccctagttcagtcaatgattctcaaaactgaaaattattttagagacagaaagtcttctttgagataaatttaacaaaaatttaatcaaaatattacttttaaatgttatctggaggggagaatatggtatgttcatgaccttacagagtttatgtacatattttgaagcttaccataaactttgcttttaattggttactatatgtgattaacatcaactatcccaacacttaagttatttttataattctcaatattatttgtgatatctttctaatcaatatttttgagttttacctatttttattgaattatctttcttttcttttttgtttctgtaaatttgtattcattgtttattttttaaatttccttccttctactatctttaaaataattgttttttcctaatttttaaattagattattagtgtagcagttgtatatactttatatatatgtccgtgatataagatctattccctataatttcatttttattttgtgaagctttattaagtttttttaaacctttttatttggtcacaaacactaacattgttgcactgtgaataggtaatatggtttgctagctatcttgcttattgtcttccccctttactggaatttaagatttctgagggcaggattttttgactgctttactcattgttatgtcctctgaaccagaagagagcctggcacatcataaacctcaataattacttgttgagtaaattatttcattctagaggtttcagctgtcttagatcagtttttatattactgcttgttgttgttgttgttgttgtttggatttctataacaaatgactgtgtaaattcaagccatcaaccacttttcacacagactggcattttcaaattctcgggttttttttccccttcacttattgcttgtgttggatagaaagttctcttaatatcagtattgctttgttctgatgtgtaaagtgtctctaggtctccagttcacagattgtacagcccttagatcagttgtattcgaggccccttttctgccctctgacttgggagaacacaagatgtcttctgtttctgtaacagtcattaaaatcctgtcctaagctggacatggtggtttgtgcctaccattccagtgacttgggagactgagctgagaggaactcctgaacccaggagtatgaggccaacctgggcaacataacacctccatttctaaaaaatcaaataaaaataaatcctgaactgcaatttcaagaaaatgttctaatgcatatttaagcctgtcactacttcagttgccagcgtttcagctaaaatatacaatctatctttaatttcctttttatttctagccctagggatttctttctttccagcttagttagctgttaaaattttccttacatgttttatctagcatttttatgtgtatgtactaatcaatcttgtttaaatctcacagtctttaagtcttgattggaaatgaatatagccaaatcttgctggcctaaaactgtttcatttctttgagaaaatgtgaacaaattacctaaggtcattttctgaaagcagccataattttcttatttcagaattcctacagctctttgttagacaaaaagattgagcaccaccaggttagaatttctcatcttaaacatatgcttccttattctcatgaaaatactctgtctttatccaaagagattgttcttaggatcccaaaataaacatatttcaccttctgaaacatatttacagtctcgacaataaacatcatgtaatagtatcataacctgatagctaccagtatagccaaaaccaagcttatttattcaacaaatatttgttgcactttgattatttgtcaagcactatttttatgatgtattgtgctagttgctggaggtataaatttaaataaagtagataaagtccttgtcatcatagatcttattttctgatagggaaaactgtcaagaatagcaaatccaggttaacccagacccaactgaatctttcaaaatgtcagtaaatacttctaaatgtcctcctatgtgccagtgtggcaatcaccaacaaaataagaattcctgttgtgtgtatcttatagtcaagtagggaataaaggcactaaatgctgcaaagaattaagtaaataatcgtaactgtgcaaagtataggctgagagaaaaatggaatattttagaaattctagcagaatataactcaggttttacaatgagcccatctagcttagctagactgagctttgacctttagacttggtagtctttactggttctacatttttttttttttttttggttttaagaagcagagggtttaataggcaaaaaggggcaagaaggaagggagaaggaagaagctcccctgtacagagacagaggggtgggcactccaaagccgagagacagaaccccaagtgtggcggaaaccagccaggtgtatatatagacgttggaagaggcagtgtctgatttgcatagggctcaggggattggtttgaccaggcatgtcattcacctagcccacgaaaaagctggctctcccaccctagtcttttaatatgcaaatgcagggcaccatgatgttctacacacatggggatatgcgggggcagtcatgttgccagcaacatgtggggcaggggcactggttctacttttttatcatgtcattcattctatctctcttgacaccataccggggtccccactgggtcatattaggtaatttctaattgctgatgttgattctcagtccaggtttacctctcagagcatctggtccaggtgttatctgtaaatcttacacccttctttaaaacttaaatgtctctcaacatgattttttaaaaaattattccttccccaggggacctgaccttggcatagcagactgtgccttggttagaattttaaccttctttggagctactctagtgataaatcctggggctggcactcagctttctctgacttcactctgaggagatgaggcccttttcatatgctgccaagagagtttgctgagtttcactcttggctttcaattacttgttaaccacccttagcattttgttatcctttttctagaggtcagtagagtttggcaatagcatgcaatccaattgctcttgaagctactatttccctcgcgcttttcaacatcaaaccagttagtggattcctctttcactgatatatcccaattcaccaccagtgaaagttgcatgattttatgagtcccttgtgccagtagaatctagactccgtgtgctcagtagtgcgttcctcattgccagctaggcaatgagaggtctagctcaaagagtagttttatcacttgcattttcagaaaactcctgacataaattaccatattttggattcattatttgattcctatacatgattgattgtttgggtggtataaaattggaaagacatttttcctaaagttttgcaagcattgttcccttgacttatgacttttgatattatacttgagaatttttacttatcctttgcatattatttttaaaaactttgtttttttttctctatgttgaaaagctcagaaaatattttctgttttcttttcatttgaaaatttgaaatggtctcattattctgattgtttccaggcctttgttgagcccttcacaatctaaaaatgaatgaactttagtttcaggaaacaataatgaattattcctttttacttcctctttcctgttatctctttctgaaatattaagaatcagatgtaaactaataatatgtctatatattatttatagataataatacatatataacattttataatatatatatcagtataaatattttattaattttctcattttctcattttacttctgtgtggcttttctttgggggagaatttgctttctgggaaatctgcttaattttatatttcaagctttctctttaattttcaatttttcctattttctcagtttagagaagctctttttctgttatctgggtttcccttttacatcatgcccctttgtaactgttgtttttaaatgggtgaatatgctgcttgtctatctgagtataataattatatttttgaagcttttttttctgtttcctacattgcttacaatttctccctcttcaatgtttctggggttgtttgtttgttttaagtgttagaagatttatccagagatctaacaatccctatctgtctgctcatacttaagaataaggaactaaatatcagattggaagttatttaggcatttacagaattttaaggatctggtacagattaagttgaccaaggagggatccggctgtttcagtaatacctccaactgttaatttttctttccctgaggtgggggagctggtcctacctacggcctggaaatcagaagcttgagtgactgtgatctggcagctgagtaggaagagaggtgtggaccttcaacactcagtgcgtagacctccattaaccccagtttccacacggcactcccatctctagtgatgcctattgttcaaaattgcaaattccttccattttaacatttccagagaaaaacttttcaaaattgtttttaggtgttcatgtgtatgtttgttgcgtgagacgtggtagaggggataacagtgcttggaatggagagtatccaggggtctaaatgcttctaacactgatattcaagtgacttcccgtttcagctccatccacacaacctggccttcacaggcagcaagcgtctccaattctccatcttttaaagagttattcaatggcagtttcattgcttcttaatttctttccctattgtcacttacttctcttgtctgcaaactaaattacaaatgggcatttttaaaaaagatgttaatacatcttttctcttgtgacttcctgtccttgtctcttctttgctttatggaattacatttttaataaatattttaatagttattttgtagtgtttgtggagtttgtagtggtaaagatgtgtttaatctgctacttgtaacccaaaacccgtaagtcacctcaataaagtgattgcaattttcaacctctcattcagcacccccatccagttattcaacaacttattcaattcaaacactggaatatatctccagtcagcccaataatctccatttcctatgctactatacaatgtcaagccaccatagtatttgacctaagtcacaattccagtcttatccacttctattttcaactgaaacaaatgtatttatctttctaaaatacaaagatgactgttattttcctccttacaagatttttaacaatttttctaattcctagaaatactttctaaactgcttcgtaatgcacacaaatcacttgagaccctgattctcagccatctctctttgtgcttggattacattcaatttatgatacatccttctgcctttcttaaccagaggaacatgaacatggggtgaagcatgcacatacacgttctctcatacacacacatgctaacatgctccatcaatattaatgtacttacaagtctataaacatgcaagaatttttttatactggactaccaaccaccaaattgtccactaaaataatgtctttctttatatttttaataccgtagtttagctgtaacccataccaaggtgcccttcctgattctgtgttagacaatatgttcacataatactttccatttatccaaaattatcattatcacattgtatcgaattctctttctccttcccctgtacaccacttcctgtgctctaacctcaagactgtaagcctttcttttttttaaaactgcaagctctttaaagaatccttgtgtcttttcctgtatctaattttaatttctgatatactacatggcacagcagatgctcagtaagtatctgataagccagcatccaatgactactacaaggaaagcgatgggattctaaagttgtatgatatatatatatatatataaatgtcaaaaagctaggggaatatgaataatcttcgttataactagtttgtggtgggaagcaatatatcattagatttgttcttttttttacgaggaagatacaacaaataaatccttataaaaacagccaataaatcatttatcatcatattgattttctcactagatttgttttttaagaaaacgtttatttgctggaagaaactaacaggaatcttttttgctttgcttttgtaagtaaaaacaagtgaaaggaaaagaataggctgtatgtttatagtcaccaaaaagactgcaaaaatgtgacagaaagaagagaataaggtctttaaatatcttttcaaattaaagagtagactggatctatgaataccaaacatcagcggcatgcaatttacccatgtcataaacctgcacatacaccccctgaacctaaaagttgaaaaacaaatgaagtataataattatttatagcatttaaatgatgaccaaatcaaagatgaattatgaattcagttagttcaatcataagacaagaaaaaaaatgtacatctaacaattagcaatcacccgataagatacagaaaaaataattaactttttatgactatttttatttcaaataagtgactgaaaagaaataaatttcagtgggatttttccagtaacagttttatgtcactaaaacaaagacaaattgcaatagaactttcactgtagattttaaataagagtaaaatcattccactttggtttcattaaggccaaatgtagacaaaggaaataagaacatgatcacattttattctcatctgtttcttacttctatgtaaggtttaacttacaaaagtgttatcatttcaaagatacgatttctggtatgtatttgaaaggcaaagtaagaacaaggtggtacattatccagaagcattattttttcttattctttttatttattttgcatttttcttaataaaagaagaatgaaaatgcaggaaaaaatttcctctctacataatttaaaaacatctttcaaattatactttagagttcatttgcaaaattatgaacaatgttttacatgcagtttttcacatgctgaaaacatcagtttttacttaatctccttatgctgtttctttcttccttcctgtagataaaagcctaaagtgggtttgcatggattacagcttttctcattctcctttcatcatagctcattgttttgcataatgtgcataaaatacatataatatatccaatccattttagcctcagatcagagcaagtattgaacttttacaagttttataaaatttgcaaatttcactcagcaagacgaaaaaatacatacattctaatgacttttaatttggtaaataaatgttgttaaaattaatgcatgcacacacacacacatacacatacattaggtgtttgttcattaagacctaaaatttgccatttccacactatattattcacacagaaagggcatcaagcacaatgtaccataaagctgtttaacttctccttaattgggaaaagtaaactcaaaatatctaaaaggcaactttatgacagaatagaaatctgctataaaagcaacattttcatgagtatttaaaattatctctacattttaatagctatttggacaggaatgtgtaaccaaagagaaaacttagaaaaaggcagcatacaacattgaatcagtgatgaattaattgttggcagcaactacaaccatttttgtattgttttgcatttaaaaatgttttaacctgtgtacaaagtgtaaactaataaatactaattgatttaaatacctgattcaatgtttcttaagcttgagacacatattaaaggaaaaattatgctatgtctcacaatattgcattatttccagaatgtcatttaaattagaatatacataaaacatggcattaatcgtatatatttatagtttttatagaaccatatgactggaacaagattttaatatacttttcatagaactacaaaactaatgaagtttaaaataatagtattattatgtggtccatagcattgttttctgaatgaaaaaccatcactcacaatataactatgatattcatcatcctagtgcaggttctgttgagctcatcttgtctgtactgcatttttttccttataatgactgactcaattttctcacacttttgggtattcaaactactgtgaagcctttattcatccattatggtatgatgtcaggtggatataacttggctccacttttagatatacatattaaccttgcccaaattatttcctattaacttctaatgatgaaagtaacaccactaggcagcaatatgatggtaagaagaatgtgtctgtaactcataatgttctggatcagcattagatcatatatttacaatccaaataatcaggaaatatttttttagacatttataaatattaaaatataaaatttagattgttactgtggagaatttttagacaccaagtttatgatcataggcttgcatttaaaaaatagtaccaaaattatacgtgctgtgacagttagttgctacctaaagttaagcagtaccaagctgtgaagagttaatttttaagattaacattaatttggagttctaatatgagatcaattgccattgaaaaattgagaaaatataacaaagatatgattaatacctaaaactccaaagcacagggaaattcaaatattttaggaagataaatctgttttcaatgcagcaaaagcagcatgtacccgtgtccaaaagttgtttatttatttggcatagtcagctattatattgtataatgttaggctaagaaagggtttccaaaggaggattcctttctgtctccctgtttcggtctctgacaatgtcaaagtcataattgttttaatttcatacgatcttgacacgtgtgtgtgtgtgtgtgtgttagatgtaacattaagggaagagctttagtaattataactttaattgttatggctgattttttagaagaatatttccaaatataaaacatatatagaaattcataattatatggaaacataatttttatgcatatttcaaaactgatgtatgaaagtcatttagctaattaatgagtcagaatctcttcctacatttgcattgttacttgtcactgtatgactttagaaataaagccacctcctagtactatttatgagaacagatggaatatgaagagtccaaaaagaaatgattctttactggatattttcaataactatgtaaatggcttaagctttgtatttattggtgtaaatcaattaattccaattgtagctagtgttagctatattccactacatgttttgggtaaattatatgctataaaatagttgaaaatcaaaaatgtaagaatttgatagctaaagtctcacaaaattttaaaaattaagtatgacctgggaggaagaatactgggcagtctttaggaatgccctaatgtcgaggatcttaagtaatagtagggaatgtaaaaacattgagttccgttagcagatgaaaaaaatgctcaaatgcatattggataattttgcctaaatgtggctttaatacatggttgtaaatttgctattgcagatgtaactagatcacatgctagacctgatcaaaatacagtaaatgttgtagctacctttttttatttacggtttcaaattcaatggcttgagtttcaggaataaatattccagtgaatatcattgttcatagttgatgtccaaggactatactaaatttcctcttcttcatctgttttattacataagttgaaattttaagaaaatgttttacaaatgtctttatgaacaattatttttccatctgtttttttttgtttgttttgtggtaagaatatttaacatgagatatactctcttagcaaatttttaagcatacagcccagcattttaaagcacacaacacaatatttttaaccctaagcacaatgtttcaggatctctagaacttatttattttgcataacaaaaactttattcccattgaacagcagctccccattttttccttgccccaggccctggttaatcaaccattctactctctgtttctacaagtttgactgttttggatacctaatataagtgaaatcataaaatatttgttgttctgtgatgtgcttatttcacttagcataatgtcctcaaaagttcatccatcttgtaacatatggcagctatcccacttcaggctatttatgcaaaggaattgaaattaggatctcaaagagaatttttttaccttcatgtccattgcagcattattcataatagcctagctgtggaaacaatttaaatgtctgatatggtttggctctatgtcctcactaaaatctcatattgaattgtaattcccaacgttggtgaggggcttggtgggaggtgactgaatcatgggggcagacttctctcttgctatcatgatagagttttcacaagatctggttgtttgaaagtgtggagcacctcccccttctctcactctctcttctgcccaccatgtgaagatgtgcctacttctcctttgccttctgccatgatggtaagtttcctgtggcctccccagaagcagaagcctgaccagagccaattaaacttcttgtctttataaattccccagtctctggtatgtcttcatagtagtatgagaatggactaatacagtgttcatcaacaaatgaatttaaaaatgtggcatatacatacatattcagcttttaaaaaggagaaaatcctgccatatgtggccattgtttttattccttgaaatgggacaattcaaataatcaattcccattactatgattttctgaaaaaaatcacaggatacataattgagataaagtcttctattataccccaccaaccacccacacacaggcacactgcccaatgctaagcatttattcttttctgtatcttggacatttatactacagggatagaaatagacattaccagccaggtgcagtggctcatggctgtaatcccagcactttggcaggccgaggcaggtggattacctgaggtcaggagctcgagactagcctgtccaacatggtgaaaccctgcctctaccaaaaattcaaaaattagctgggcatggtggcagatgtttgtaatcctagctactcataaggctgaggcagaagaatcgctagaaccagggaggtggaggttgcagtgagctgagatcacatcattgcactccagcatgggtaacaagagcaaaactccgtctcaaaaaaaaaaaaaagaagtagacattgccttttattttgaaattatacatgatatttgtgtttcctagaagtagataaagcaagcaaatatcattgaagaaacgcaagatgaagtgggtggttggttgaaaatagagaggaagtagatatcccgagtatgagagaaggaacaccattcttggttggacaaatatctataattgtttttagtaggattattttatgtttctacatatcatgccacatttttatgcagtatcaaattttgaggactgctattgggtacttcatggaattgaattctgaggaccaaagtcttgaacttcttcatgattaatctctgcatccaggattggcatcaaactttatggcatttcactctcaagggaccgtgtaaacataggtgaaatacctggaatgaccagaatattgtttcctaattgttcttgatttaatacaatttttgacacttttaatgaacttcagtgggcaggtaaactcaatggctggattttagtatcccctaatgagctgtgacagaattttagattagattcaatttgatttggagaaaaataaacacagcggtacttttttcaaacatatacatgctcagatctgctatatgtgaggacctcatccagatgtgtactgagggtttatgcattgtagaatgatagcaatctacagaaatggagagagatgcttttgagacaagagtgttgacctagttgcaggacttgcgtacgtggatgagtctacactgagaagtaactactgatttgaagtacagcactaacgtatgctgaaactaagttgattaaaaactgctcacgcatgaaacaaaataaaaacgcgtacatctggatgttattgaggcagtactgaaagaagacaatgcttctgaaaatccaacctatatccaacttacataattatttattcatgtttgcccaatcatagaagattatgctttttacatggaagcaaactatctctggaatcctttagtgcctcaaatttatatgtagctactgggatgggccattctttaagagacttacaggtttactgatgaaaggggttgtagaataagtagcaaggagagaaacagctgaccagttgcttttctactactacttccaggaagaaaagaccagcagtgtgttctaaaaacccattaaggggagaggatataagacagtcccacaggagtaggagacaggagttagagatttagtagggcaatcaaccacttaaaaatttttagcgtgaatcccaagttatttgatatacagttgagtttaaggctctgaaaataatggacacctgcttctaattctgccaatttttctggagaaatagcagaactacagggagaaatatcagaccgatacacacagacgctatattctgaggtatccaaacttccatatttggtcaagtactgtacgttgagccagaaagagcagaactgactttcctcaaattaataatgtggagttgaatatgaacatttctattacaatgaagagttgttcttttgcatatcctagacaccgtttaagcctcaggtatttttgtgtgacacaaagatgtgtgagagataccaaaacatattactgaagttcaattttacaccattcttgtaatttggggcttagggattatttagagaaattaagcaatgtagaatatttttctccggcgggtggtgaagggaaactcacatcagttatattttcattgtgagtgcttcccatggtagtcacaaacacatccatttctccagtatactgcggaatttcaaacaaggagaaaaatctgatgaagttcagctcctgcctagcaaattctaatcgggttaatcaatatcagccagctctaccttcaaaataacaaatgttgtgacatatgctatgcagagtttggcagcaaacaattgaccaagaaaagaagtaatgggatcagatgtgaggaaagagaaaaataagtatgatagcaagaatacccgtactctttaagaggtaaggcagaagaattaaacatttaaggcacagcagggattgacaaagaaaaaaaaaattgaccttcagggaaggttcccagttcggagatgtgagattattgttaacagacactttatgcctgaacagtttgttatctaaatacatttccatggacccatacgtttgaaattaaatgggtgaattttcagagaaatccttagttttcccagcattgatgtcttcccaaagcatattatattgtgttttaaaataaatgattaaaagggtatatttaacacctcatatattatatctcacctgattgaccaattgccaaataaagcttatctccattttttctgagtttaggattatacttataaaataaaggttactataaaaatttggttttttaaattatactttaagttttagggtacatgtgcacaatgtaaaaatatgtttttatttcccgtaaatacttttaataagacatttaaaataggttaaaactacagtgcctggataaaagtgcttgaatctcctaatcctccatgtaaatcttaaataagcaatatacccgtgagatctctaaatccacaaatgcaaattgtctatttatgttgccaacaagccagatgacattcagagcttcctcaatacccatgaaacacctgcttgctccaattattagattttcaaatgctatttaatatctcatatattacataaattttatggataaacctagatatatatacatatattaaaaccattattttcttcattatattctttataatcgtattaatataaagtaacaaataaatattaagtaacaaattcagaagcagatcactttttttctaaaggaatcagagagaaattttgtcacacctacatatgcctgcatagtgtttaacttggaatgatacaaaagtctttaattcatcaattacactattaattttacatattctaaaattacatactcatatctccctcaagattttcaaggttccttatcttctttttcataaagatgttaaaacataattaatggcttggtgaataattttcatccatacagatataagaagcttaggagatatcaaaaaatatgtttaaaaataagctatttatggatctacagagtccttcccatatgttttaagttactttaagcttttaattcttgaaatgtgattagattaatctaaataaagataaaaagaaagcaagcacatgcgacggatgccatgttatccatgtagttctgtgcatattaattctaaaattgactatgttcctaggcctacagacctggtttgaagattcattctgcctgtttctttgtttctggttttttttttttttttttttgcatcattagcttaaaaaacattgcattaataactcctggtgagttgaactcattgtctccagtccaagtggaggagatccttagtctccttccttccataactctcttcccacttgaactggagatgatgattattgcataaatgctcaggatatttttgcatttgaacccacataattaccccagcctaagtaaagtagtcataatagacttttcattctactcccacatttaatcaatagcagaatattttatttttaccttccaaattctctggatcctaccctgtcttctcccattatactgctttagctggactcacattcccctcaccttgatcattgcagtacttggcactttgtctctttaaccagataaacctctcccaaaaattatttttctaaaatacaaatttgaccatttaactccctcacttacaaacttggaaagttacaaacttcaaaaggaccctctctcattgtttatagaatcagtttcatcagttcagtaagcattttttacaagtctccatcctaccccacaaatactattttgttttacctctactacttttttttaatttaaatgatggttccttgtaatccatcaaatctcatctttctttacttccatttttttcttatgctttgataccaaatatatcaatgtgataagctcatcctttgagattgaggacaaagcatacctcctgttgaagccttacacaatctctcaaaatatagtaggtttaatctttattttttcactgaaactttatgtacttgtagtgtgttgttcttatatactctattccatttgtttacaagtttcactaaaatattgtaagcttattcatttaagacatttatctaatttattcatatgcctttagcatatgttaggttgaaagcatctaacaaatattcattaagtaaatagttaatttaaaaaattgatctatgtagagtgactaggccatatctgatgcaatctatacctgtgctattctgaatatatgatatatattatatctatctataatatatataagtacatatataattaatacatttatacctatgtctgtatctctctatctcaaataaaaaatgttacaggagccaaaagaaaacatttatagttttaaaatttttcacatatttaagtatctgaatatctacataaataaagtagaattggacagtttaatctgcagtttctttagagtaagcaaagtgaatgtctatttctacagaaatggaaaatactaataacattctctgactgtctttctttgtctctctataatatacatgcccacacacaaatatacaaatacattgatctttcaagttaaaaaactcacaatataatccttttatcttccaatatatcactatcaggtttatagttctgctgaactgaaaaattttgggagaagcttagaaaacttttatggataaagagaaatcaaaatcatgcttttaaaattggaaggcaagaagaattttcagctgtataaattggcctacaaaaggtattgctaaagaaataaagtatgctgcaaatgtacagatgccctgacctgtggagatacagtaattccactgacaataagcatcatgagcaattatttttatttccttactgcccaatgtctttgatgaaaaagtactatcaacctagactacagaatgtggcattaaagtttaattctcttcaatcaggtaggcagagatcaaattctgacactggcttttattgtggaagagttagaactttctgaaaatctcttttaaaccactgaagcaaaccaaaaatgttataagagccaaaagaaaacatatgcagttttttttcacatattcaaatatctccacacctacataaggaaagtataaccagagagtttaatctaatttttttttccaaaggaagctttttttttttttaaagtttagtcttgctgcttatttaactctttagattcctgtcttgtttttgcattatcacagttgtataagcaggctttcctataaattaaaacattaacagcagaaaagtaaaataccatataattccatacactgacattagcttttttacgtttttacttaaaaaataaaaataatcatattgatagtttttttgttttcaatgtgaatatgacttatgaagtgtagctaaaatttgaaaatgtagctgcaagcatgggatatatttttgaaaataatgaacaaaaggacctgaattttgaacattttttcacaattgcacgtcagattaatctgctataatagaagcacacattaagcacaataaagtatttatcagtgttcaaaattactattttttacgcccctctcatctgaatgaactgtctttctaaataatgagaagtttatctcattgtttcttttaactaattctacttcaatttttataactttatagttctgggaaatacatccttactttcaaaagggcatcacttccagaaaacatctgaatgtttaaaaaaaaatcatcattttagggccagtcataagtttaaaagactgaaaagtagcacatgtaaatttgtaaaagtcaaatgtaatttttttatataggacaagcattaagcactaaaattgatttaacgaagatacacttttgaagaaaacataagtgtttatatttttctcaccactgataactcaaatacagattaaaaaccatatcattctaagaattgctaaactatatacacagaaaaactgtatttttatcaattcattcaaataatatactatacagattataaaaggtgtggaatgtttcacatccaaagttacttacatataatttaacattttttttgtatccactttttaaaagaagaaaaagctgctgaaattgttatatactctgggttgatgataactgactctgtaaatttctacctttgttgatgaattgaacattctatagctatttagccattatgtgtttttgaatcctttttaatgtattttattaaaattcttttatttaaaatgaaaaggctaatagatgtgtcagaattatatcaaagaaagaaaaaagtacaaagaaaagacaaaatcataccataattttattctaattatttcataatcacctatgacataaattggcaagccaggcttcatgaggagaaagaaggaagtggacatggtagaaagaaatgtaccatacccgtcttaactagtcgctgaggagagattctccaaacaagtttatctttgccaatctatctttgcctatctcatgaagtcccctgccacactctgattaggttggctgtagaccatgctatttaataaatggggatactaatttgttataagagagttataacaaatttctttttctttttttttcttttttttttttttttttgagacggagtctcactctgtcgcccagcctggagtgcagtagcgcgatcttggctcactgcaagctcctcctcccaggttcacgccattctcctgcctcagcctcctgagtagctgggactacaggcgcccaccaccatgcccggctaatattttttatttttagtagagatgagatttcacctctgtggctaacacctctgtgttagccaggatggtctctaactcctgacctcatgatccatccgcctcggcttccctaaagtgctgggattacaggagtgagccaccacgtccggccgagttataacaaatttctgagtttcataaacagtaactaaacaaggtttttgagcgtgtaattctttatgttccagtacctttgctctttcttgttaaccttctcttatcaaatgaagcagacctataaataaatactgtaagatggctaacaaactgccaccaaaataaaaacaaaataaacttaattttatattatcctaatttataaaattcttttaaattgatacttcttcattcatacttcatattttcacactactaatttacctaaagtgttagtgcaaaattaaaatatgcagataagttatttttaacatcatcccttctctgttattctccattaattaataacaaactatctcaagatgaagtttaccagtgagttccctggttaaaatcagttatttgccaatttgcttcatgtaaaaagattttatgtatcatctatctatgtgtctaatcatctatcatttatcatctatctctttgtgaacatctgctgagactagactgatttgccacaattatttggctaaactgatggcagccacaagccctctggagtggctactgtgaagacaccagctgctgtggtgaggcgggcagctccaggtgctggcacaggtgctggctccatgcaaggttacaactggaccagaggtactgcacgtagctcccactgcaggcacccacatctggacgaggggaatgcagtggttcccagaagcttggagatgccatgtggtcctcagaagcttggagaggagcttcattgatcagcagaacagctcttaggaggcccgaagtgggtagttgctttctgtaggcaggttatcccaggagacccagagtgggtagctcctttccagctctctgcagagagcaaatctggagtgggtacctccttttcataggcaggttgaccctacaagtcaaggagactcaaattgggtagctcctttccacagctggtcatccagatgtctctctgagtctggctgagtagggggactgaaggtgtgtgtgtgggggggttggtttatgggctttagaagggaggaagtctgtgctgattggccatggttgggtctggaaaaagcaccatgagttctaaatcccaaagtagactccacctggaactgacagcctggccccatgcttcacgccttccctggcttgaaggtggggcatcaatggggactcacccctttctgcccaggagcctgtctgcctcccaccatcatcaatcatgttgtccaaggcgctcaggctgttcttgtggaggggcgtctgcaggtccatagggagctaccctcagcatccccttggcctccctcttgtgtttgtcagtgcccaaaatctggagggggccagggcggcagagggctggcatgtcagcatcacccaaagcatgggcacacctggccggtcctgacagtgcctgggcttggcctcaaccttgctccaaaattggagcaggtgccaggagtggggaagagtccaggcagcaagagcaggcacttccaagactgtggggccatggggtaggctctccagggcccccagagcacagggatgcctgggttcacagccatggctgggtggctgcagctgcgcccgggagggtagggctctcacccaaccgacttggaagggggcgtggttcctgcctgctccttggagtgtaaccctggctgtgcctcacctactgcagccagtgtctttgcagtggctggtccagatgggccacacctacaatcaaaattatctggaggtatgtaatttattacaataaaattgttatttattaaaggcatcaaattttgctttgagacagccatttgatatttatcagttaaaatagtttgaactctttctctagaaaattcagtatacttggtataacttgtttagtattattaaagattaactttgataggaattaacagtaaagatagtagaactggacatcaatatttacttcttttcacactctagtaaattaaaagaagtgtgacatataacaattcacttttattcttaccaaaatttaaatggtgaaccattttttactatttatcttgccacagaaaaccaccaaactcattaaccatctggtaattatgccaaacaaactatcataaatccataattattagtgccacaactctctttaatatggttaaattgtctacttttttttccttcatttttccttttggtttcaagaaatacagaattgtaattaattagtcatgtttgatcctatggatcgtatatgcgcctctttggcttttggaatctgatgacatactaaagcaacctatgtttgataaaggtgttttaaaccgtagaaaattatttctgcttcatcaaaggaaaggaatttgaatatatctgtgtatttatattttctgtgaaatagtcacaaatatattttaatatacataaaaaattcacatatttgtgattggagactaaaactaatttgtaatttttgaatggacacaatcatcctattaaaatgtatcacatacatattttcttctgctaaaatctatttataagaacttctgaaggaaatacaggtacagctatgatttctcaattttcaaattccaactgcaattttttttgtacatagtagttttccaaaaaatatttgctgaattaagttatataataattagatgaaccatgaaattaactttttaaaattttaatcttattttgaaatcaattagttgcctaaaaaatacagcaattgccaattttcagtgtaagtattatgtgtaaatcagatactctttaatgtaaattcacttggtgaattaaacgagtagtctcattttattttctacatatggcaataaagtaaccttaattgtatccccaaatggaataaacagatgtatttttaaaattgaacttgatgctgttgagcaaacactatttgtgtttgatagaatgaaatctattatattgaatgcataggctttttctgttactcgtttaaatttttgattgaacatgtgatcactaactgtggtttaccatcacatttagtatagctgacattgattttatctagaaaataatctagatttacctttcaaaaataatttgatcataaattattgctaggtattttgaaaggcaaactataataaattctcactactcaaaatatatttttatttatttatctatggaatgacacagaaaagtagaaatcataacaggactaaacagaaaaaggtgtgtaaggtattacattcaaaatcagttccaaaagttatgcaaaagctggaactatgaaaattttaatgaattctaatttattatttaataatatttatttagtaaaattatattttagattgattcaatttgttaataatatttgaaatatctgtaagtatttcaaaaattctgatttggagaactaaagtacaaaaatacataatttttaaaaatcccaaggaaatttgaaattctagtaattttatttaaaacatgaacaaagaaaaatatttagtaagcaattataagggttgtgatagttcaggaggtcatcagaaaaagatttcattattatgagatgaaattgtaaaaaaaatcttacatgtgaatataggaaaaggcctactaatttgatggataaaatataattttaaaattatgacataattactaataagaatacattaaaaaatcaaaataggttgatgttttaaatttgaatctctccatgttgtgaagtaatagtcataaatttagagtattacatgttccatcttttatttttgaaaatataatctctatttaataaaatgtcacctaaactacagctgttaaaataccaacatcattttccaagctgtaaaactaattaacttaaagctaagttgattaatgatagttgaaaatggttattgtacaatcaatatcactaccctgtaaccatcataagttacctaacttctcttagtctttattttggagttttttatctaagcatataagaaaatagcttctgtccttcctcaatatgataccagtatggattacttatctcaaatattttttttaacaatattataggatatcgtggtccctaagaatatataatttaaaataattcacttttactgattttcctgcaatctttttaaaaagaaacttgaaaatgtcaggaatcaaacattaaagcttactaatcttttaacaaataattagtgtgaattaattatgctcagttcaaggtagaaagagtaataaagtttaagtaaatagtaagggcaagaatatgaaacacttcaaaaatatggagataacgaccaaggagaatcaagtctgggaaaaaaaaatcatataagattaaagggaaatttggagctggagggtgggaaagttgtggggatggatgaggactcggtaaggcaaaggcagagagcactatggaaaaaaaaaatgcctggaacagggtttcacatattaaaaacaaaccatctttgtgtctcagtgctttgttttataaatcatttcctaaattctgtgtaatctacagattaaaaaagttatgtataatgtctttgcttatttctgtagtcctctgctgtgtgagtctaatttgaattttagtgtaatttcaacatagcttttacaggttaataaaacttacatgcattaaaatgctattaaagtgttacacatggttaataatacttatggatttctgaaagcagtcattattacactgaacaaagtcattaatgtctttaaactttgcatcaggaaataaaatacaaaatagatgtctaactgcaagaatagtcatgatatctgactataaatatttcttctctttttaccatatatttttttcttttgtatttgatatttcaaataaaatatactgtaataaaaataaatgagcaatgcattggattctggtattgaccttcccactgattgtgacttcagctttgatgactgacagagtacaaacctccttaggcctttgccttgtcacctatataataactaggacactaaaggtaatctctgtaatttccctcagccctaaaactcaattgagtttacagctagaaatgaaatcatcaggtattatattttctgaacaaaaatattttcaattattttaaataacatatatagtttgggaatggcaaagactttgaaaatcttatctattatttgtcatgtaacttttctctacttcagatgtgcatattattaaattggcatttcttcattacgtaatataaagtcaatcacttaaatgtttggattgcctaaaacatacattactaaaaataagtttaggtgtttaaaatgtccattcacttctctataaatcacctgaagtatggttatagaatgatatgttactacacacctaacatctaagtaactgtttatctaaaagaaatactaacttattttgcttgaaatagttaacttttattttatttcagtatgcaaaacatactgcctatgtatttgtccacagtaataaggagactatatgtcagtggttcattcattttactatccagagtcacattccaaacaggcttaagtccttccttcccttccttctccctccgtccttcccttacttccttcctccctccctccttccttcctccctccttccttcctcctttcccttcttcccttcttccctttctttcccttcccttcctcccttcccttcttcccttcccttcttccctttccttcccttcccttcccttcctgtttaaataatctacctatgatcacgatatagcacactaaggatttacagtataaaacatgctttggaagaattatattttcaactggcacactggagcaaggggacactgatgtagacaatgtcatatggtagcaacatcagagtttatcacattaaattagcattttatggtaacaattcaattaggcttatagttttcattgaactttaaaacatttttatagttatataacagcaataaacataatgggtttataactagctttatatttgtatatatcaaatatataatttaactgagacaacatgagatttattttgctttgaaaggagtccatatataaatcaacttataaatttacaaatctgttgcatagaaaataaattcctaacaggttcagtgtctctaaatgtgcctgagaacgttagacaagaccactgaactcaaagtgtaaaaaattatatctaatctgggtttcttggtaattttttttttctttcttcatcaaaatacaactcttctgtgttgatatctgtgctaactaccacagcaaatttatccttgccagaaaacaaagaatctacctatctttcaaaatttagttactgcatcagcaagatttttttaaatgaatactagctatcttaattatgtaccattgtcttagttctaaaataatttaaaataataaaatgttttcatgagaaaaatcagcaatgaacaaagtataaatctgatatgactctgacctggagaggtccaatactcaaaatttaatagtagaggaagatatttaaatagactcatacttgtgtagtaatttgacccttagaccctggcaaccacaacacatgtagtaaaaataggctttcatggatgttcctgtgcattaatgcttgcctctgcccagacatttaatggtgcagccttatttaaaatagtcttaaagacacagaaataattcaataaacaagagtctggcaaatagagttaggatatgaaagtggtcttcggctatatctgggtaacaaccacgaagatcaataaagccgggatataaaatgctagaaactgacacactgagtcaacttaattctgtaacaataaaaagatgagttcagctatatgaactttgaaaaaaatcaaactcttggaataaactaactactctgtaaacagaatataataatatggctttttaagtgggcgttacatttacgatgaaagaaaataatgaaaaactaaggcacattgaaaagtaaaagagattaaaatacacaaatttcagaaaaactagataaaagtttgagaagtaaataaaaatgtgagaaggaacaaaaatataaaaactgaaaaaagtgaaatacatgaaggacagagttttaagtagtgttactcacaatagcaaggatatagaatcaacctacatgcccatcaacagcagatcgataaaagaaaatgtggtacatatacaccacaccatagagtactatgcagccacaaaaaataatgaaattatgccctttgcagaaacatgagtggagctggaagccatgatcctaaatgaccaaacacaagaacagaaaaccaaacaccatacgttctccatataagtgggagctaaacattgaatacacatgatcataaaggtgggaacaacagacaatggggatcactagatgcagaatggagaaaaggagctgaagaacctcttattgggtgctgtacttacagcctgggtgatgggatttttgggatcccaagcctcagcatcaagtaatttacccctataacatacctgtgtatgtgtcctttaatctataataaatgttgaaaatgttgaaatttttaaaaaaggaagcaaaaaaattcatcaaagaaaattttttaagaagtgtgatatacaatatgtaagcaatattgctacccaaggtagactgcagaatgagtgaatcagtatcaatcatctgcataagacaaatagaataattttaaaaattcccctgacttgaagaaataaataacagaaacgtatgacaccacatattttgaataaacacttaaaactccagaaataaaaacagaagggaattaaattataagttctctatatgtcagtcattggaataaatcttttctacatggtttttaattaaataaaagtcattttaacttctgtgaaagaaatgaatcaactgaatttataacatatagcattcatgaaaaaagaccattccttggtttaattttggcaatgacggagatgaaagcaaacttgacagcacttactatatcatcctcagtcaaagataagatctaagaaatttacacttcaccaagttaaaattaatatgtgaatcttacaacacaacaaaatattttaggttggcaattaaaaaaattacaggcaattttaaagggtagcacagtctttaccttttttgtttatttgtgtaatgtcattcagcattaaatttcaattggaaaaaataattctaaaataattataagagcaagcctatggaatattctgcaggtcattaaaggctgaaatatttaataaaatagttttccttgcaagtaagacctcaggataaatacccttaaggtgcaaagttataaagttgagtaattttcccaattaaagtcaaacagaccttagcaaaatcattaacaaaccagcaacaagaatgaagacattaacttttactatgattggcataaactttgaagcaaaaatagtataaagataataacaacaaaatattttaccaggtttttaagagtgacatgattctttttgattaaatttagagaacacaaaatagaactcagaacaataagttcaattttcttctttaaatatcaaataataattttattatgattttacataaacatactatggattaacccttaacccatgaacaaatctcataatttgacttgaaaagcactaccttctatcctagaatatgagttttctttggtaagtaaactatctaaggactgtgttgatttggcaccagctctgacttctcatagtgtagcgtggagtcccagtagaaactgcacctcccaaggcattaccattgacagatcttcaggggcttttaaacacattgaatcagcaatgataattttggagatagatgactcctatttaaatacagtttgaataactttatagcagtaatgaatgcctatgcttatccctgggaaatatgccaggaaaagaagcaggcatcttcagcctgaattctactggcttcatgctgtaaaaaaaaaaaaaatcagccaagctagcctgtggataacttttccctaaaaggaatatttatacaggagcttgctatggtttaggtgtccataccaaaactcatgttggaaccttagtgcagcaatgttgggaggtggtgcctgtacacagtgaatagacctttaaaatagattaaagtctttctcatgagacgggatttgttctctcgagaaaagattagttctgggtacagtggttgtcagaaagcaagcttgcctctcctgtctggtccttcttgcattccagcttccacattcacatctctgccatcctatggtgcagcatgaaaccctcatcagaagccaaacagatgcctatgccatgctcttgggcttttcagccacttgaagcataagccaaataaacctcttttctagtctctgttattctgttatagcaacactaaatggactaagagctcttacagtgcttgatttaacaaatactaacagattgtaaaaatacacattttaggtttatgtttacttattttgataatcaatttttttattgaacaaaatgtatttccatgaattgaatcctgatttttaacactgtatccatcagaaatatacgttcaatttatgattaatgacttagtccaggcaattattaggttataaccctgagaatccttgtagcagtcattttaataattttgttttatataatttccatttgtataaaaaacatgtttactatattttatcaatctacaaaagtacgataaacagaaagtatgttcaaaacacaagatacgagaaagaaggatttaaaatacacacacacacacacacacacacacacaggtacacacacatgtctgatgcatgtgtatatcaaacaaaaatggcatgttaggcaatgtgtaataactaatatctatgtcgtaataataaataaacattgtttgcctatgctaaatgtaagttaatattcttgaacttatatgaaattagcttttatgtatgtcttactagagatacacaccaaataaaaaatacagtagataccaaaatatataagtaggcaaaacatgccctagatattgaacacagaaaatacggaagtgacagtattgtatagaaggcagaatatattagtgtcttaaaaagaaataataaaatatagaaatgataagtatactttactagtaaataactatatatcaagatatacatgataaacctgtcagtaatttaagatatatgacagaaatacagctcacaaattttaacttaacatcatcctagcacaaatgagactgaaaggaggtcaagtatgtgtgtatattttttaatacctgggttcggttattattttaaagttgaacagatagtgactaaattctcaaatgaccaatccattggatatattatataatcagaaataacaaaggaaaaaaattcatctcctaaaatgtttaaaactatacctttaaaaagtggttcaaaaatatagtgattgatagaataatttgcttttataactcaaataaaatttttataacctattaagatctcaggagataggcatagtagtaacagaaatgaatctctggctaggaattattctataaatgtgaaatattagcaaatcattcatttggtataaaatatttgagaaaaagaataaaaacccactttgagaaaggagaagagataaaaaaacaatgataaaatgagggatgatttaactgggaaagcaaaacatgggagtgatatgaatatatgatatttggaaaatataaacaatgacattttgtaattgttattttctaagttgtgcttatatatatataaggtaaaatcttacttcaaaacttagtatttacattgcagagtgcattactagtgggatgtttataagctctcctaaatatatatttacttacttgtgggtaaataaatactgacctgcagtcaaaagtatgtccaggcccatcaacacagatccctccattaagacagatgactgaattaagttcaggctcagcacaattatcaatgcttttttcacagtatgcaccagtgtatccacgtgggcaaatgcaagtaaatccatgtgctgacttctgacagaagccttcattcatacaagggattgatgtgcagtcctagattaagaaatagagaatcaaatttgattattagtataaggttgaccattttaatataattatatttttatttaaacataatctaaaaaactgatgtgcaaacttgtttgacatttccttcctctgttaattgaaatatatgtttatgacagtaagcggttttttaccttttattaccagaaagactgtcaaatattttattgctgatttaccaagaaataaaatcattattaatctttataaaaagatgtatcatgtcagagaactgcccctgcccccaataatggtgctaaagcaaatttcctctgcagataacagaattcactggcccttagtgtctaccatacctctcagttttcccaaaacagccccagttcaactctgctctcctacggtaatgattaatagtacttccattaaatttcaaaggatttctgggtttgatcacatacttagaacaaacatttcacaatgcatttatatccatgtaaaatagctaaaacatctgtaatagctgaagtttgaatccaatcataatcttttaattacctacttttccccatgcatttgtccaaatgtatgtccagcatttctgacacctgtagctgcagaagtgcaaatgtcttgtagagttagaggaatctggataatacctgttactttttaagcttaaaaatattttaaaatttctcatagttttacttacttattcaacaaatggtattttatttattgtaactacatggatgcacaaaatggtgataatatcacccacctcatatggtgtgctatgagagttaaataaaataatggcactgtgtcttaaacgtcatatgtgatcagtaaatattatctttctttcttctccactctgaaggccaagggctcagtcagcctctatttcaatcttttggcacttaatttgaacaagaaatatgtttctctgtatatttagcttctaccatatcataccatatgcttttaagtttacagtttagggtttatatatatacttacagtgtggaaaacacatgtcatagtaccacaaacatggtatgacattatttttcataatgtaaactgaaaagatttgcacccataattctgagaactaatttatggaaagttatgacatcattagtaaaactgtttattttcaagagttttacctaaagataatatcttaatgaacctaaaccaacttgaatcattttgcactctaggtcttgagttcttacattctcaaggataattccatatgcaaacataaaatacttcttcagcgttttaccttgaaaagtgacaattttctagaattattgttcattaattgacacctatgcttacaaatatttagtgactttttaaaaaagtattaacgacaaaaactcataccgacaagactattatggaagccattgcattaatatcatgtatccactggaaaattagatgatgttaaaaatcatcagagagattaattagcgtcatccacaattagaaatgaattgtgcacttcagtataatattccagtcatgcctggaacttagatagtgatcttgtacacccccaccccctacaagtgatagaactaagtatgtttttataaacaaatcctttgatatttgttccacttttgctgaaaacgtgaacttgttaagaaaaaccaagagcacatagtagactatcctgtaggtattgcagttttatttatggaatagaaatgcagaattccacagggagtggcatggaaacatgtttctcccctaactctgtttctagatatgtatagaatgatttattagaaaacattacataaactaattgaattgtatctcccatgggaaaatagggatagtttttagactgccaaaagttctgtctccagggtttcaagaatcttttactaaattaattagaaagcttaatgggaaatacaaaggcaatttctttttagaggaaatcaaattgtcatttaaagttcttgatctttcctggtttaaaaatttaaaaggatgcctttcgttttgttcatcatttatattgctttgctatattctatttaatataataaagtgctttcccaaagagttcactaaagtaatttcagaaaataaaagatataaaaggttgagtatttagagaaagagatggaagctgggaggaatcctgcagaccagggcaatctagacaacagagcttgaccccagtgatatattcattcaacgtgtactgaaaatattatgccaggaaatgtacaggagcatgaaaggaacagggcagtgatatattcattgtgaaattcttagacagggcaaagtacatactgggctagtaaatgtgacagttatctcactgactcagttagttgtgttctctctgagggatgtggtttagatccacagggttgtcctgtgatctcttaactgcctagaaaaggaaattacccaatgtcatctttatcataacatttctctcatggcatcacgttttattttttagcattggtgttttgggtagtggaatactttcctcaattaagatcttggagaaagggaaacagatacagagagaactactatttgaagagtgggaacagaacacggtacctactaagtccctaccattccctctgcaaaggcctattaaccttcacagaattccgtgaactttgtccagttctgaataaaaactgctagtgtagtccagtgtttttaaatgcgtatattcaaaatctcattaattatatgggcttttactttgcaagctgcaggattgggcaatccaaaagactgagaactttgattagacgtaactacggaatctgtagcattgtaagtgatgtggttgctgttggtagtaaaaagagtctggaaaaggaaatgcaacttctcttacccccacttgttttgctcttctgatctaggtttgggctcacttttgcatgagtcgtgataggctttccctaacttagggattcaagatttatgcaggagggcaaataatggaatagctagagaacaaatacctagagaacataatggcatttatttaaacaaaagatacatataccaataagtaataatcacattttgtcagaacaaatacgtaggaaaatatttctaataaacacacaagtatggtagggcacacacaaacaaatgagcaagagggggtcttaaaagtagtgctaattattttatgctagaaatagctagaatgaactcaaacttctgtacctaaaacacagaaagaatttttaagagcaatagacttaaaatatcttaaatatccaaaaaaggatactaattaaataaatatggtgtttccacacaatagaatattaataagaagaaagtagaacaatatatggtagtatagaatatatatataattatatataaagtagaataattttctatgattgattaagtggaaaagcaaggtactctgtgtgtgtgtaatgaatgttcccattttgcaagatcttgtttattttaaagatttgtttctaattaaaggatatcgatattctctaaaataatttgtaggaaaaagctgaccatttgttgagggagatggactccaactcaaaccctctcctggaaagcattctgatggttcaatcatttaatttcaaataaaaagaatgagaagaacttgttaaataagtcccttttaaacctgtcaaaaatcacagaacctttagagtctgtgttcaaataaatctggatacttgaaaataattttctgaatgccagaatccactatgtactaatgaaagaataacaaaaaatagaaaaatatacatgatatacatggcagacaaaatgtaaattatattaaataaaaagctcataaattacagtccacactcagagaaacacaaatacatgcactcatgtgtgcgtactcagttttttacatgcaggggatacatgtgcagccttgttacacgggtgtattgcacttgggtagtgagcatagcataaaataggtcattttttcgaaccattctcctctccctccaccctcttctagtccacagtgcctattagtcccatgtttatctccataggtgttgaatgtttagctgtcacttataagtgagaacatatggtatttgtttttctgttcctgcattaattaccttagttttatggcctccagctgcatccatgttgctgtgaaggacatgactcatttttatcactctgtagttttccatggtgtatatgtaccatattttctttatccaatccaccactgatggtcacctgtgttgattccatgtctttgctatttatacacagttttttaattctttcctttttatttagagaacttacatgagtccttgctttatgttaagtctgctcatagcaatatattcactacgagttaaagcacgaattctcttatttctacttcatctgagaaagtcacgatttttaaattctgtaattagttttttccatttcagtacataacatatatttataatttgatatcttaaaaataatactgcttccatgtaaatatacatggtgcatgagaaagatacatgccatcctcctaagtcttatcaaacttgaaagaaaaatatctgctttctatgctgccctactcactttccttttctgtttgtgtgtgcatatccagaacttaaattacatttttttcactagtcatggcatatgttctctccccaggcatgcatttgctcttctccagcattaattctaatttttaaagcttccttctaattgtcacttggacaaaaaacaaaacaaagtgtattaggtttctctagagaaacaggacgaataggatagaagtatatgtgaaagggagtttattaaggagtactgactcacactatcacaaggtgaagtcctacaataggccgtctgcaaggtgaggagcaaggaagccagtccgagtcccaaaacctcaaaagtagggaagccgacagtgcagccttccgtctgtggctgaaggcccgaaagcccctgacaaaccactggtggaaggtccaagagtccaaaagctgaagaatttggagtcaaatgtttgagggcaggaagcacccggcatgggagaaaaatggaggccggaagactcagccagtctagttcttccacgttcttctggctgctttattctagctgagctggcagctgattagattgtacccactcaaacccactcaaattgagagtgggtctgtctttcccagttcactgactcaaatattaatctcctttggcaatactctcacagacacacccaggaataatattttgcatccttcagtccaatgaagttgacactcaatattaaccatcacagcaattttgcttgtcttgctgcccatccagccctaacataaactatattatttccactcctaaggaggttcacatgtaacaccttgccctatattgacccgagtgctcttttcagttagtactgcctatctttctccatttttcttgcctctttagccttgaaaaacagttcatgaatctcctgcagagtgtgttatctaagcattgcaccatagagaaagctaaaataaatagggcagctagtaagtaagatagagagagatgtagatcactttccatgtggagctggtcaggtaggaaatatatctaatgattattatatctcaatttcttatagacattcaatatctaagatttacagaatgaatgagcaaaattacatatagagtacacttaatgtattagtgaaacatgacaaaattttaaaaaatgtattaaactataacaattattctagatagtactggtgcaaatgaaataaaaagtaaagaaacagaatcgtccaaaaactaacccatatatagaaatctattatatgaaaagtggagcattccaaatcaagaaagaattaacagaccctttgataaaatttcttggaaaaaatgattatacttaaaagaaaccattaagttagattcctagcttttatcaatcataatatattcactatgagttaaagcactaaaagtatcacgaattctataattgtagatgagaatataataatatatttaaaatattacagtgggaaggatttctttggagagcagcaaagcccagttaggaagaaaaaggtaaagaaaaatatgaaaatctcacaattcataagctgtataaagtaagagtgtccagactttataaaagatttgcattttttcagaacctagtagattttatctataatttaaaataagacatacaaatcaaaaagtaaagggcaagtaatcaaaaagtaaaagaactataagtaggcaaggcacaaagaactacaaatggcaaataatagcatggaaaggtgttcaatcttgatagtaacctaggaaaatataaattaaaataatgacaaattacattctcctcatgaaattagtcaacactttgcaaagagtgatttcatttaataggatctaggtaagcggtgtgctcatactctcatcaggtaagtgtggtcttcagtgtttatttggaatactttatagctattaaaaagaatgaatcaggactctttgcattttaatggaatgattcctaagatatacttctaagacaaaaaagtcactgagtataatgagtttgctcttatgttaaaataaaaatattaggaaaaaatctagaatcacataggtagaattttaagaattgctctcataatattggccatgtatgtatatatgtacgcatgcatatatacatacatatgtcaaaaatgtctatttactgatattttaatacaaaactaagaatatgatatttgtactattaagaaatatggttttagacattacttcaggcaatatttgcagtaatgcaaacaagatgtatggttcattcattctctactagggaatttatttattacatttccctttccacatcaagaataactttcactatccagaacaaaataaacacaatatcaacagataattatgctttttaaaactgtgtgtcagaaaatgtgctaattgttttacatgcattatctcatttaattcttgcaataacctgaggtagttactgtgattatttttattgaatagtcaaaacataatttcaaaataaatgtaaattgagaacacacagtaggtaagtagcaatatagagtttccatcttggttctccgtgaatgcatttaactactccatcacccctctctggaagggccacttactgaatagttactgtgtttcatgtacattctcacacatgaccctgtgatgtcagaactagtatagctatgttttactgacgagggagagagacacaaagaatgtaataaaatacccatggtttcacaatgacaaaggcttttagtttgtatgcttcctccctttaccatgttattgtcaatcaaaaatgatttggaagaactccccagtattccaaaaggctcacaagattctcatccaccaagaacggtcacaattctcagtcgaccaacatttttcaacaaatgaggcatcctatataaaataccatatgtcaatcacaccacatgagactcctgaagattgaaagacatatcctgagaatattaaaggtgttgcccacgtcttgatatatgcatccagtatttatattctccttgtgatatctgaattaattgaatcctatgtcatccctacagatccacagatacctctgtctcctaagaccagggaggacgaggcagatggtaaaatttaagccatctgagcaactgttgataatggatacttctaggatttagtttggtggggcggtcggcgggagggaggagaatcgtggaattttctaacaacaagagacaaagaaagaaaaggtgggggaaaaaaagccatgatttgtagttttgtttggagcagccaaagaattacacagaggaaagatgagagaacagttaaatcatcaacaactgtggaagaaatgactctgaaacctacagcaagcaatttgatttttcttttaaattaaatttttgtcatataacttgaataaaattataagacttacattaattttgatcttacattgtgtgctagtcccatctgcatcacatgaacatggatattcattaataagttctgtgcacctgaaacacagaattagaattacattttcaaataagtagatgttaaagcataacttcaagggagtttcaccatttaaacttttctttcctagttcaggtgaaaaaagcactcccatgagcaatacaaagcagagtttattcctgggtttcttatccttgaaggtgactggactgaaaaaacggatcaattttcatttttgccattttccccatggcaatgaaaagaatgaacagttttaaaagataaaaagtatgtctagggcttatgtgagaaactgaagttagctatggccagcctgcattgcaatgagctgccaaccttctttctctcttccctgcttacaaagtaggtggcaggattataaaagaaaactaacgtggaagcaagcagcatgatgcatctgtgatgcattcttctttgccacctgcatcttctagaaataccttcactctagatgtgtattaaccaatattttatccatgatcagagcagttattatacagattcatagagtcataaaatacttttcatacacatagggctgaaagaaccagtttacttaggaacattttaaatactgtgtggtattatctctccatagagcaaataatagaatgtctcatcatcttacctgctagttctattaccatgagcagttacctttaagtatattaaagtctaattaatccacatttatagaaaattactttatgctaatgaacagaaataaaagaagggcagagataatgtatcagtacattgcattagctaaaactggcagcatctgtcatcttaaatgtacttagctcttgttttatgaaagagcataattaaaattatctttatcaactttcccttgatgttaagtcttaaatattgtgagttaaatatactttcataaagctaataataaaaaaaatagctaccttccatgtagacaaggatttgaaaggcaatcattggcgtttgtttcacagtgtgttccaaaaaacccactcttgcagtcacaggtataatgattgatgccatcgatacaaactccatcatggagacagggctctgataggcattcatctagatttatttcacagttgatgcctgtgttggaacagacaaggcaaaacatgaaaccatttaaatacaaaactcttaaaagtttgttcattatggtaaacatcaccaagaaatgaagacctctctctataatgataacttggtatttggtagcaaaagaaaatatatttcaaggttaaatatatttaggtctatgaatgttcagattactaatttaatgtgaatgacaaaaacaaagcacaagcttaatctactgaggagattgtttttagtgtgatgtttgttgagaatattagtgaagtaatgaattatatcaagttgtcactgtgaatactaattcataattttttttgtaatggtctttgagagtcaaacgtttattacctacaagaattaagaatgagtttgaagttttctaaatttggctttagtgagtctattaatgggctccctgagatttctaaatgaaatctaactttggctaaatacctgggattttcaaaggccaagtagcgaatattttttaagcacctaccaagaaccacctctatgctcaactagaggtaccaagccaaaaaataaacttcctgttcacacaaaaacgtttttagggaggtaatcatttacagatagaaaacaccgagatgataacataagcagagcttaatggaaagcaagattgtgtttcgtatgtttgaaatatctggaaagagcacagaaccattgtagaattgttagaataatttctttgcccattacatccattactagcaagcatctactaataaaaactagcattgactgagcacttataggtgtgccctgcccttaaggcttcctgcacattatcttagctaatgctcatcaaaccgataggcagatctcattaaccttaactcactggtgagtattcagagtgtaagtgaaacttccaggtcacacaggccataacagcaaacaagaatttaaatcatgtttcctctgacttgtgcttctgatcattactttaaattacctaccttgcagctactctaatatgtgcataagttgctatgctgagtaataccgtggataccaattggaaaacatggttcttgtagccaatacataatacctagttgtgaataaagataagtaataagcttattacagtgaagaagacaataatgaaaatagctgacatgtgaggctcttactatgtgccaggtacactcaatttcagaggttcatgacatagttttatttcccactcactctccatgactagagtgagttacagatcctctttacattatcttcactctgagaccaatgttaatgaagcatactctacctgggatattgacatctgtgtttaagaggaaaaaagacacttccctttcatgctgggcttggtcatatgacataaaatacaggtggctcttaagtctttcacctacaaatcaagttatacgactaagtccaacagaaatggaatgggaaagaatgtttctcccacaggaaagggcacatatttgtaacaataaaattgagtacaagcataatcaatcaagcttctcacttgtaaatgagtgttacttattggtacatcatacgtttattgggatgatagagtataggcatgcatcaaaaacaacctagccaaggtctgatacatgtttaacattttattactttcaggttcttgataaaaatatcacaaacacattatatttgattagtgatttgggtggttccaaagacaccaccattctaactaggaagataagtgaaaagtctccgtatcactatgtagaatgctggcagagtcagtgctgaaattttcagttaaaaaaagatagatggtcaatttataacaaaagtgtgggggcagggacagaaagtgttaaaagagtttgggacaggatgcatccagcaatgttgggagatgaggagatttgacaaaagacacttcactctgtttttgaaatgttctctccataaaaggcaaacatgtctcagtttagctagagacagcatcatcaagattatcttaggatctttttttcctaatgttttattcattaattaaaattgtggttataatttgactttctaagtagcctccaaagaggataagaatggaataactagccaatgtgagcattttggtctctataaaccattctcatttttaacattatagtccttcagattcacacatatcaaagtcccttttacctttctaacttcatcttattttaatctcacccttgactagtctactttacttacattgacctccttatattttctcaaaagttttaggcatgctgttcctaaaagacctttgtacttttattccctttctaaaaaatctcttccaaatatttcacagtttacatcttcttcaggtttttactcaaatgtcactatctcaatgaggactattcaaccacacaatacaaaattgcattctcgtcttaatccgcaattgccattatcctgttttatgtttccctcctgtaacaagtaatctccttgtagcattccataagatgtattcatcttttttttctttttctctctatttctccatgacaagcttagcttcataaaggcatagattttgtctgtctcattcaaactgcatacattcaaatatttgttaaaaaataaatccttgtcatatacgtgtgtgtgggtttatgtgtgcatgtttttgtattttgttttacagatatctgttattttctcagaaatcccagcctcttcccaaccacgaacaaaacagttcttgagaatctggggaaactgttagtccttgcgaaggtgagagtcagaatccaatgaggcgatggtgatgcctctgaggtgcataactaaaagagttgtctgtgcagccaaggggaaatatttaatgggacctctgctttttcccaccttcaaacaaagacatgttcatgtgtgaaaaaagacacacagttgtggagggtcttggactttggttcacaatgatctcccacaaataattaccaacctattcaaactctaagttattcatctgtaaactatgaatcaaaatttctctactgtagcatagtagagagatattcataaagtgcacatatatatatatatatataaatacatatgctccctgattattataacaacaagattgtttatcttcataggataacaatgctttgacatagcacatctaaaagaaataatagtatttattagacatgatcaaagccttggctaaagtctcagtctcagttttttgcctacattgccttatataccaggtatttcctactggtcattaatttatctaatgcatatttatgtgtcaatcagagttctagactccttgcatagttcccttgacctggcatgcatcactgccacctcaatcacagcatagcagatgattttcacaaaatctaatgatttcattatggacttcatttgacaaaagaagaaccatgttctttctttttgttatgtctaacatattgttctttccacctaccctcctgcctgctttggagctacagcaatagtttatgtttgaaataattttcagcttgtggttctaaagttttttatttcattcataatgcaggcaattccttttttaagcagattggaaggttacctgtgatatttgagtttttttcctatgatcccacttatttaaaaatcctctttactagtccgcctcaacatctgcctccagattgaatattttcacataggaaattacacaatccttttagaatcaagccattaaagttcataaactgataggtttgatcagcaaaacattttcgtgcatcaacaatattataatagaaattatatatattcctattatataaatacatgattttatgtatatatatatatatatatatctgtcaatcagctgtcttttttcagactgtgtttttttttcttactttctcttcattccctttttacccaacttcttcccatttgtcagcgttacatgttttgacaagtttttcaaaatcactttcctgattcttaatttttttcatttcacatatgagaacctcaaaacatactttatgaactctccattgtccccagaaataaatgtagtctccctagcctaaaaccaaattctctgttccaatctttcctttcttgtcgctgctctgatattatcaaatactctcatctcctggtttataaacctgattgaataatacaatcaaccgtggagtttttaaaaatacaaaatcccaaatctgaatctctgagaaataggactgacaagctatatttttaaaaatctctctagatgatggtaaatcatagctaaggaccgctgctttttatcaaactggcttaaaattaaacattctcaatattttctcatatccatgttagctcctgatagttctgcctgaaatgtcatttccacatctctgtttgcagcctgtttttttatttgaggtcttacaaaattctagttaattttaaatattccttttgatatctcccattgcatatcagctaatatcatttatcagagtctctttagggtttatttatttgaattactgtcttatcttccaaactttatcactacttatttgagctcagggatcatacctatttacttttacttcatgaaaatgccaaatacaaaattttcatgtagtaaatgatcaaaatagtcagcttaactactactgaacacatctaaattgtgataacattttgaaaatgactaaaatttacataatagcatgatatttacaaaggacataatcaagttaatacaggcatacaataatttatggacttaagaatcagtgattttaaaaattcaaattcatatttctaaccattttgaattacaaaattaaaaaagtcataagagctccaaaagcaaaatgagagttttgtaaacgtttcttattatgaacaatatttaaattaaaaacaattttaactatcatgtaaaagatttccagataggcagtccagcaaatgctattctatgaggaataatctaggcaaacatgcagccatggtgtttaaaggtgtgtcaatcaaaaattatgaaatgtaaaaaaaatccagaaacaacaaaaaatggatggaataagaataaagttgacagaaaggttgaaattatcagagaaggaatttaaaataatgatttagaacatgactgatatgttaaaaaatatatcataaaaggtggatagatgactgaatctatgaggaatatcaaaagagatggaaactataaaaatattcaaatttcaatgctaggaaaataatacaagatgaagaattaatttaatgagcttatcagtggactggacataggaaagaaccaatgaacttgaagataagcaagtataaattaatcaaaaggaaacacctggaggtaaaaagagtaagaaaacagaaaagagcttctaagacatatagaataatatcaaagtttctaactgacttgcaactggaatccctaaagtaaaagggagagataatatgataggagaaatatgtaaagagataacggacatggatttgactaaattgatggaactctgtagcagtttcaggcagtatacaagctattttgctgtttggagcatatatcttagaagactctatggtattaaagatatatgtagtggaaaatatgatgcatagattttatagtagtgccagaggaagaatcatagactgaggctctggaccaaaactaaaatatatgtagcagagaattatcctgaaattgagaaatggcttctggcatgtctgggtagttgtagagatgaaacacctgaccatgggacatcaagtatccatgtggacagaactgccaatgcatttggcaagaccagtggcaatctacagtaggtagtatattgggaattgtgtatgagtatgccagagatcacagatagttgcactcctaagttatgtacttctttcgcaacagaagctcatcctaagttcatactgtttctgtctgggccctccctggtggccatctgaaggaaaaataaaaaaagtctgaggttggttcatggatgggttgacttggtatatgggtataaactggaaatggattgctgcttccttaaagccttattaagaggttacccaagaaggtaaagcaaaagggacatccttcggatgggcagatcttcagtcccatgatgtggtcataatctttgggtggaaatagcctaagagaagaatatgcatggagttataggtagtggcaaatgacatggctggactggaaggcaaaatataagactatctgggtcagggaaatatgagaaagaagcatatattggactgataggagtgggcatgaagtgtgaagttctctgcaatgcatgttaatgcagaagaggcattaaatagccataaagaaataactcagccagttaacatctgtccttctctggcatcagccaccacaatggtggtacaacaggcatgaatagagtagctagagtggcaaatatggaggcctgtgcatggacccaatgtatgggctcctctgtcccaagaattagttaggtactgcttccctcagatatccaatcttccaggaacagagaccatagccactacacacttaatggtcagcctttcttgcttctcctgccaatagatgtttggccagaataactactcaagggcttatgtagtgttgatccatcaatatgagagctctcataatatctcactggaccaaggaagccactttacaacaaagcatagtagcaatcagataacgatagatctgttggtttcatgatgtagcacaccatccaaaaactactaggtgtaactgaggtgccagttcggagatgaaagcttttggggatggaacactaaattatagaatgcggtatgcactctatatcaataatcattatatgatgctttgttcccaataggtataatatatggaattgggaaccagggggtaaaagtgagtgaaccgatgtgccatccttctttgtgaacaattgggaaatttgtgctttgcattcctgaaaatataggttccaggaatctagaggcactgattaccaggggagggacccttgcgctagagaataccactagaatccctttttgaaatgtatggttgttgtaggctctttgtgctaagaaactatcagtcaaggaaagaagttccttattgtgatatggactgaaatgtttgtgttccccgcaaattcacatgttgaaatcctaacccctaaagtgatgattaggtcataagggcagagccctcatcaatggaattagtgcccttataaaataggcccaagggaaccttccaccatgtgaggacatggctagaaggcacaatctaagtaccagaaaatgactttcactggacatcaaatctgctgccaccttgatcttggacttcttatcctctagacctataagaaataaatttctgttatttataagctacccagtctacgggattttgtgatagaagctcaaatggactaagatacaagggtaagtgatgctgataatggggaggggggaagtaggacactgttataaagtagggacaaggataaaaatatgtgacattaaggtgatctactgagcagagtcttcattgtcattcatgaacaaacaaaaaagtcatagccttactaggagattaactgtcaggcatgagtttctagattaattcaccaggtaatccagtaggccagcatattttctagccaaggatgagggtaatataatttgcacaggagaggaggaagagaagtatcagatgcagtaccaagatcaactttggtgacagaaattggagttcttcccagtaatccctgaaagtgatcttgtctatttacccaggaagagacaaattataattttgggtatctgtttccagattaggtgtacttattttagaaagcaggtagatctgagcagcacaaagggttgactataatagataaagtaatgagcattccaggtccccattcagaacagcaacactcaattccacaaatagaggagtttcctaccaagttctaagtgcaattcttccccaggaattgaattttgcttggccaaaggggtctgccttgcccaagtttgggcctcccctctgctgtgcaatgagtgaaggcgactcagtatgggtcaactatgaaggggccatccccacttcatagttcctggagggatcaactgaggcttctgttataactacatcttagctcaacatcttcctttcccagtcctacttctctttcccctcgcaggcattgctgttgaaagtagtcactgataactcacctacatgtaaattgcagtctctttcttgggaagcctaacctatgaaaaagtttcctggaaattaatcttttccataggaatgcttttaaatttttttgtcaaaaaacttaggaaaaaatgttgaaagtgtatgaagtagttactaggaaaatgtatatcattaataaaaatattggcggtatatatcaaatactggattaaaccagcatagatttagcatttgattaacaatcatttgctaatattttcattgtttggaaagaatttattagaatattatatctgttttcagaagctctccaaggaacttttactgatgctttattttcctgtctataaatatcccaggtttggacagatgcttttaaaattcattacagtagtccttagaggtttggaaaaggacaagtatcaataaatatttgatgatgaaaatgatgatgataatgatgttcatttaaatcttatttctccttatattttcctacctcttttatgaaaagaatgggggcaattcttcaatatcaggccacaattaaatgaagtcttctctctcttagactttgttaccacaagaatgcggccagttgttagaggacttcacagtttattgtaaaagttataaaaacaattactatgtcattgtaaaaaattttaaagaagacattcaaaatatccttcacaaaattgctaagacaagcaaaaacaatattctgattcatattagttactcattgtttttagatcattctaaatgagtgagtcaagaaaggtatgtgaaatgaggcgtgtgtttaattaggcaactatgttgagagctttggaaagtgagaagttgttcaaggtgaagagatgcagaatatctctaagtacaaacaggcatatgaggattgattaaaaatgaaagatattagacaatagaagtaacagtttatagatgagtcggacttctgttctaattaatacataattacttattatttgagggccctgtgtattaactctgattaacatgttaaaatattgtcaaaacttataaacttcacacattcatacgcatgtacatggctataatttatcaactaacattaatactaatacaatcaggaaattttatttcaaacaaatgattctaatccttgctaatataatgcagaaaatagctcattatttaaagtactgtttagttcctaggttctgttatgattaaaataaacactgcatgattctatctgtatgaggtatctagtcaccaaacttatagacacagatagtagaatggtggtttctagaggctaggagtgggagaaaatgcgtagttgttcaatggcataaaatttcacttatgcaagatgaataatttctagagataagctattaactatagtacctatagttaccaatatagtattgttcactttagagtattaggataggttgcatgttaaatattcttaccacaaaaaagataaataaataacacatacacacaaaaaagaatatgagaaaatttttggaggtgatgaatatgtttgttatcttgattttggtgacagtatcatggatatatgcatatgtcaaaattagtcaagatgcacatattaaatgtatgtagtgtttttggatatccattgtatctcacgaagctacaaatgaagtcttattaatcacatatacaataatgatttctacctcatagggctaatgtgagtattaaatgtgtctacacaaagttactgcaatctaagtatttcaaaggacattctttagttcaaaggacattctttagaaatgattgctctaagcttgtctaaatgagtgcctcaaatattcttatgtgcatcattgagctccaaccattagaccctgccacattccccattccaactcataagaatgagaattgagatcattaggactaattttatggcttattacatataaacattaatgcacacaactctgtttctgattatgcataccttatttcttgtacttcaataccacaatactatttcacttatatgtacatcacaatctttacatggtaaagtatttcagtaggactacactgaataggattgaaaaccagcttgccatcaaaacaattctttaaatgaataatgattttgtgaaaacattcggttttaggtaacctgtgtgtagctaggaaaacattttaattatgcttaaaatgtgaattataggacaattttgcttcagataaacaaggctgataatcagtgggatgtaccggcatgactagtgtaaaaatattgaaatgttaagtaactagccattgggtgttgctgttgctcacccttcttagcagccccaacatttcttctgtgactatgcagacttcatgagctatcaagtgaggcatagaaacatgaggttatacataggtcaaaacaatcattacataattttattattacctctgaagatacatataacaacaaaaatgtgtctcatatcagtgagctcatgtgtaaattttttgaatcaaagtagcttgtaattttttgtattttgtaacaattagaaatgaatgagtcaggctttaattgccattattagttaaaattatatttccacataaggaaagtacatgataagcactgaaatctttcttttataattaaaaaaatgtaagattgaatggcctaaaattatgttattagaagatgacaaatggaatcacttttacagaatcctggggctttgaacaaaatttgtgacattttacaatgtatgtttctcttatttctgacaactctaccaagtaactggagatcaatgaaaaattctaattttaattcttcatttgaatgggccccaaaccagggccttgatgaaatttaaggattttgtttatcctctccaggttaggcacagacacattctgacataaagactgatttaggtccaatgagtcaatcgaatgcattcaagagaaaccctttgggaaaacaaagcagacccagcagtcactaagatcaagctgtgagccagaacactcagagtggaaaataaatgttctttatcggaaccaaaaagcgatctgaaacttacaaaattttggaggtattctttaatttaaaaaaagctcatgattacaaatataaaataaggcacaatatgttagcacaaccccttctgtgtaaagaggttaaagtttaaacatattagcttcatagtaaattcatttctagttgctactatttttaatacagagctgcatgaaaaaatggaaaaaattgaaattaatataatgtctactgttctccatatggctaattccatagtttacttaagtaggaagcacactttaaagactaagtcaattttgtcatagaagtaaaaatccataattaaaaaatccagtgacctagttaatttgagatttaattttccaaaattaagaaaacatcttattggaggtgcttgctttaatccttaaatcaatagcataacattttatttattcaaagttataggcaaaggcaatggcttataagctgcacctaattcatagtttgataaaagagtattgtttctagagtggcattttaaaaatactaagtctctataatgtttaattttaaagaccaggtgaaataaaatgttaagtgataatcacaggactttctatgttgtatgttttgattaacaaacacaattcttagttgttaatttgatttatgcataaaccaacctgttaagttgatgttaaccacaggaaatagataaggctaactgatggttgtactattgagagacagtccaatatcaaataatagcaaaaataagctttgaagtaacatcttctgatttaaaatgagtggcccaatgtgtgttatgcagaaataaaaggagtttaaagatgtaaagttatagttttgtactagtaaatgtttaactggctcttggaagaaaaaaaatcaggaagcaagggcttatttataacatagtttaattcccctgatgcagtactcccatcttttttatttcaatgtcctgaaattatgtctacaaaccaacaaagtttataaaaattaatattcagctctcatgagcactattagctttctccatcacaccactggaaaggtactttcctaagtattaatttggggttgagcagagtgttagagaactagaaacatgtgcataataaggatgaggagaggcaatagagattgttgttgagggagctgttgaaatgatagaagaaagtatgtggtgtgtgtctgcatatgtgtgtgtagcagacaattcctcacaatgttatagactaacacagtcactaattagcataatgtggctgagaatttaaaaaaaacttgtggcaatattttaataccaagatgacaatacaattatttcattatcaacactcactgaatcttatgtactaggtaagcactggtgataaaagcatgacaccagacttaggtaccagttgtgtccttattttacatagcaaacatagccacaggataatatacaacctcttgaagatcaggctgttgtaaactgggttaatagatctgggtttcaacacatagagtcaattatgagaatattcactgctaaacatttgaatcaactgtgtacatattataacaaatttaaactttattctataaaaatagaatgaaacaacattgaaaactatgtgccaaggctcgagacaatgagtgcagtaacgtggtagtattatcagttcagttgtgaatcagtaagacctaaattaagatgatgatattagcaataaaaataaacgatgtataaaagacatctctacttcttttgggctaatggtcaaatgcctccctttcctccatttttattgtaaaaacatattaaaatgttttaagttgagtaaatacaagcaaatgaaaataatcgctcaaatctcataatcgtaatttttatatattacttatgttttaattttttccacatgcctccatacatacatacattggcactttctcaatgtaaaaaataattacttaaacaattataacatgtcatgttttttttcatttggtgacatggtcttcagtcatatcattttaatgattgcaaaatatatacattcttctatgaggaatacatatcatgaatatattatgatttattttatatatatatatacacactataaatatatggcaatgtattcttccatgaataatatatacagtaatctaatttcaaaataatggttatttcaacatttcaccaataaaaataactaatgaagatctttatgcatacacacacatatatttttgggggttatctctgtagacaatttatgcagggaaatatttttctaggcaaaattttcatgtcaaatgagtattttagctcactactgtttacctcactagcaggcagtaacatgcatattaaaatagtgaagcataattttaccaaaatttttttcataaaaaagataaaaattttctattgaaaatagcaatatccagtagcgatgaacatgcagtcaaatgagcacatggttacaatctcgattggtctgcaatttgtgaaaacttgccaaaatgtagaaaacggcataatttagagagcaattttagtgaaatgctgtaaataatctcttcaaatgtgataaaagacaaatataataaaaatttcacacatttctgtgaaattccacttttgaaatgtgcctaggaagatgattatttcagtggtttgaaaaaagtgagacattggaaaatatataaatgtataaactagagacacattaattatagtatagcctcatgatgaaaagtttgacagttattataaaaatgctgtggaaatttaatgaatggcatgggggatttccagaatatactgttactaaataagaattcatgtgatcaaatcctatgaactgcataaaactaataataaatccatctttaataggttatagcaataaaaaattgttattgttcactttttgtggtaggcattttgtaatctttactttttatgttttatctgcaatttccattttttatcttgtacatgtattgtttttaatgagaaaattatgttttaatgggttagactctagatgcttaaaaagcacttgatatttgacatctcttcataataaaaatcctcaataagctaggcatagaagaaacacacttcagcaaaataaaggtcatatatgacaaagccatagctaacaacatacgaaaggggggaaaattgaaatcttttcccctaagaactgaaacaagatgagaatgtccactttcaccacttctattcaaaatagtactgacagttctggtcagagcaatttggtaagagaaagaaataaaaaacatcaaaatgaaaaaagagtaagtcaaattgtcccattgtccctgttttcagatgacatatatatataatgatatgtatatgatagatatatgatatatatgatatatgatatgtatatgatagatatatgatatatatgatatatgatatgtatatgatatatatatatataggatatatatatatatgtatatcctaaagagtccaccaaaaaacttttggaatcaacatatgagtttagtatactgcaggatacaaaatcaacttaccaaaaatcagtggcatttctatatgctaatagcaaactatctgaaaaagaatagacattgaagactaggaagggtgggagagtgagaggagattgagtgataagaaattatgcaatgagaacaatatacaccattcaagtgatgactacactaaaagtctagacttcaccaccttgcaatatatgcatataacaaaactgcacttatatctcttaaatttatacaaactttaaaaaaacgaatatttttgtgtgctttatatataaccaatttgttttaaaataatcacagtgattcttacagtaatgttactatttctgcttcttttgttcaaacacattgatgtattattgcttagtcttttatttttagtgtttctgtgccatttagttttacatgtatttcataaatatagcatagtttgggatttgactgtgaatctgttcccctttctcatccactttctttttaaaataacatttaaactgatgagcctaaagattgagaactgacttatcagatcaagaaaataagatatatttgccaaacttaatgctgatgtacatttttacattaattctttgtgtctgaagatccaggaccagaagtttctaaggccagcatttcaagtggtatctggttctctatctattcttttgcctagggatgctggttaaatgagagtaaaacagtgcacacagcatttgcaggcttgctgatctgattgaaatttctgtcattaaacattttcatttggaaatttaatgttttgttagactaaatgatatgtaacaatatggctataatatagtgagtcttcctctctttctgtttctctacacacacacacacacacacacacacgcatgcacgcacacacagagctgttatttgataatgcataacaaattactgcttatgtgattttatttcattaaataaatgctatcagaattggtagacattatctttccataaatttcctgtggagttgtagaactgaaattcattcactttgtttccttatgctccacttacaacatttttgtttaatgcctgacttggttagtgttgactcaatacctatgatacaattttttgcattttaaatatgagccctaagcaactaggaggagctgcagctccatggtaaattgtaatctgtattgggagttcaatattaagaaacagtttagaaaaatatgtgacatatagaatttaaggtgcaggcttaattttacctacttctcaagtcttaccaattatatattttattcataacagaaattctgtcattattcttgatgattaacatcttgtaattaaaaacattttgctatacttttgagatctgcccttatttctgctgcattgatccaaagcaatcatactgaattaatttttgcttgagcagttcactataaatacaatgaaaatcgatcacttcattttgaaaagctagattggatacataaatttcattagtcattagataattatcaattccacatataatttttatagatcctaccagttacataataattttattaaaaatttactataacaaaaatacccaaaatttcattacatggtctttcagattttgtgtactgtgactctaatacattttacttctatataacagtgttcctttatagtacaaatttacagggaaaataagcttattaaaaagttgccggcagtaagacactgatacaaaatagtttttaacatagagagttgtatttaatttgtttaaaagtttagactaggaggcaagttttccctttttttctcctaatatgtactgtcttagcctgtttgtattgctataattatatacttgagcctagttgatttttacataaagtaaatttatttatcccaattatggaggctataaagcccaagatcaaggtgctgacaggtttggtgcctggtaaatgctgctctgttttcaagacgatgccttgttgctggatcctagaggggaggaaccctgtgttctcacataatagaagggatggaaggacaaataggaagggtctaccttccagccttttcataaggcactaatccattcatgagggaagagccctcatgatttaatcacttccccccaaatccccacctcttaatatcaccaaaatggagattaagttttaacacatgaattttgggggacattcagactatagcatatgcatatggacatatgcatacatgtaagatcattctaagtagggcactttaattttactcacgtgatgtgtagcactacatagttgtggttatgaactcaaatatggagtcaaataaacctgattaagaactttgcttttgctacttattagttcaggtgaacttaattttgctacaacacatccgtaaagcagtcataatatctactttacatattattgctataagattatcatggtgtttaaaatggtcacatactattattattatctaggaatggggtaagtaaagataactggtgcctcaatttgtaacatgtgcaataaaattaatccataaaaagtgaaataataaaaatgtaacttgcagtctatgatttctgagtgctctgcagttctaatagaggatgttatgaaaatcaataataaaagataggatttgagaatttcttcttctctacatttgaattaatgggttgattcccagctaacaggccaagtgatgggagaacattttagattccttcatatccacatgttttcaaattccaagggaaagatggcagaggacttcgaaactaatggatagcccttaaatttatgattcatttgttgtggataacactgaaccctcattgctcgttgagaactaaaggtaaatccatggggtatagaatcataaagccactggtatcaaatattttactataagaaaaaagaatgtagatggtaacaagtgttaactgattgcttaaatgatttcttttttataattgaccttaccccattaaatatgatctttatcactagaatgtaaaactgtgttgtccaatactacagttttcagcacacacatacttaaatttaattaaaagtaaattgaatgcaaaattcagttatttagtcagactagccatttcaaatgctaaatagacaaagaactacacagcacacagcagaatatacccatcataacagaaagttgtattagacagcattgattaagaccattgctcttcaaactttatttttttcttattgcccctgtacaaagctttttaaatatttttttctaatcactcttcatcatcaaattttacagccaaagatacatgttttatgtacctgtgtctaatacataaaaatagtaagatcccagaaaccttttgagaatgcatgatgtagacctatagaaagagaaaagaatcagtccatagataaacactatgaaaggcagaacaacacttaatcatgtgttcatgttcaaaacatctatgaaccacttattaaattttaccttcctaaatatgcaaataaatgtaattacaataaatgttaaggtaaatttaagagaatatttaactctattactgtattattttattaatatgcaagtgaaattaccatgaaatatttttcatgccaaatataaaataagaagattagatctgtgttatttatatttctaccatcttcttgtgaatatctcaggtgccaggaaatgtagttgatgctgggaaggctaaaggagatagaatagttcttggtcaacaaattttaaaaggctgatgtaaagataatgtaagtatctaaatttcccaatccgaaatccagaacattgtctactaaattatattgctttgatacatcaacaggaagtgatatgctgggtccagttaacactcactctcaatggccaactgtaaaatgttcaaaggttttgggagacaattggcactatcacattggtagtttaatatcagctatagtcaaaatatgtgcaccttggacatgagaaagaaaactgtgaatcagggattttagtttgctgtcagataaatgattgctaatcattcgccaacacatcactgtcaaacaccttttacaaaagaacaagattaacttctcatacccaattatcctaattccacagtcctttattaaaaccatggaaatcaagcaagtgatggaaatgtcaataagcccaatttcttcataaattccaggattagatggctttgtctactagaaaacctgctgaaaactcaccttaagtgagattttaatgatgtttggcaccaaatatcatcagtgtttgcactatctgttactctctatcagtaaaactaacatacagggcattaatgctaatagtgttggttttacaattaacagtgaactacacgaagataaatttgtcaggagcgcagaatttacataaggtctggaacaacttttcctggtctgggccagcaaagtgacagaaaaacaaaagagattgatctggtatgccattattttcttttttctgctaaaccaaatttccaataaggttactgctgataatactggttgatatggtttgtctgtgagtccccacccgaatctcatcttgaattgtactcccataattccgtgttgtgggaggtaccagtagagtggggcactgctgaaaagatacccaaaattgtggaagcgactttggaactgactttcaggcagaggttggaacaatttggagagctcaggagaagacagaaaaatgtgggaaagtttggaatcttctagagacttgttgaatggctttgacaaaaatggtgatagcaatatgaatgctaaggtccaggctgaggtggtctcggatggagatgaggaacttgttggcaactggagcaaaggtgactcttgctacattttagcaaagagactggtggtactttggacctgccctagagatttgtggaactttgaacttgagagagatgattaagagtatctgatggaagaaaattctaagcagcaaagcgttcaagcagtgacttgggtgctgttaaaagcactctgttttaaaagggaaacagtgcataaaagttcaggaaatttgcagcctgatgatgcagagagaaaaccccattttttgaggagaaattcaagctggctgcaaaaaatttgcataagtaacaaggagcagaatgttagtccccaagacaatggggaaattgtctccagggcatgtcataggtctcatggccacccctctcatcacagacccagaatgctagaaggaaaaaatggtttcatgggctgggcccagggtctccatgctgtgtgaagcctagggacttggtaccctctgttccatctggtccagcagatgtatggaaatgcctggatgcccagggaaaagcttgttgcagtgacagcgccctcagagagaacctctgctagggcattgtgggagggaaatgtggggttggaccccccacacagaacccatactgcggcaccacctagtagagctgtgagaagagggccactgtcctccagaccccagaatggtagatccactgacagcttgcacagtagacctggaaaagcctcagacactcaatgccagcctgtgaaagcagcccggaggtgggctataccctgaaaagccacaggggcagaactgcccaagactaagggaacctatctcttgcatccacatgacctggatgtgagacatggagtcaaaggagattattttgtagctttagaattttactgccccgctggattttggacatgcatggtccatataactcctttgctttggccaatttctcccatttggaatagctgtctttacccaatgcctgtaacctcattgtatctaggaagtaactagcttcctattgattttacagactcataggcagaagggacttgccttgtttcagatgagactttggactgtggacttctgggttaatgctgaaatgagttaagactttgggagactgttgggaaggcatgattgattttgaaatgtgaggacatgagatttggaggggcccagggtggaatgatatggtttggctatgtgtccccacccaaatctcatcttgaattgaattcccataattccacgtgttgtgggagggacccggtgggagataattgaatcatggggatggtttctgccatactattcttgtggtagtgaatacatctcacaagatttgatggttttctcaggggtttctgctttttcatctttctcattttctcttgctgctgccatgtaagaggtgcctttcacctcccaccatgattctgaggccttcccaaccatgtggaactgtaagtccaattaaacctctctttcttccaagtcgctggtatgtctttatcagcagcatgaaaatggactaatacactggtattacttcatctctccatattaagtgagtattttagattagtataaagcaattttgtgtatatcgtcgttcttaaatttctttttttctcaaaatagcctttctcacccagcactatgataaatgagtgagactaaaaccatgtaatttagagtttttatgctgttgggtttttttttttttgagtagaagcatagtttcagtgcttgatactcaataatgaattctttctcaaaatattttccaaatataccaatcatgagatattgcttccagaaacatttttctggtaatattatattttaaagattttctgagcaagtaaatctgtctcttatccatgggtaacatctttcttcaatatttaaatttttgtagacccttctttcacctactagttctaagtgaattataaggtttcttggttttctcctgatgataccaagctttttgaaaccctctttaggggaagctgatacttatttcatttggacaaactcaaattaatagtggaaatggatgagtagagttcctgttccaactttggacttttatactaacaaaatcatttaacattattttcactttggaaattaatgcattcaaatatatttccttctctcaactttatttcatggtaatttcaaaaaccattattttgctgtgatgttcagatcaaagtttcagcctcatccacctcaattaatttttagatgactgatattatagccatctactcattagctattagacacagacacataccctatgcaactcagcattgtaaattgttctttataaaacacctaatcaaataaattttagtgtggtggctcacacctataatcccagcactttgggaggcagaggcgggaggattgcctgagcccatgagttggagaccagcctgggcaatatagtaagacctggtccctataaaacaaatttaaaaattagacgattatggtggtatgcacctgtggttccagctactcaggaagctgaggtgtgaggatcatttgagcctgggaggcaaaggttgtaatgagccaacatagtgccactacactcctgcctgggtgacagagaaagtgcttatctaaaaaaaaaattaaaaataaaatttaaaatatataattagaatccattcttggctcttcccctttgtgtatcctaaacatactaagtttccttgattctaatatacacatcttggtcttagaatctttattcatcttccatggtgcataaaataatggtgaatcctatcattgatagcacattagatttgttgaaatataattgattttattcaagtttcttccaacaaaaaataatctctctctctctctctctctgtcattttagcctactcctaggccttttctctctccctgttttgctcccaacttcgggaatttcttgactccacatcctgtctatacaggtaactcacgaaaattcatttgaagtcatttctttcttctaagcgtcagatcctctttttgatgacttacttgaaatcccatatgattttattacttttaagtttaaaattaagtttttctccatcattccttctaacaaacatctcattctcctgactcaaaaagtaaaattctctcttccttttctaaactttcctccctatgtaaattacccaggctcaaaattgtagaggtaaattcaatttctaatacttttataagtctgctgctttaactaacttttttcctttctgttttcactggcataggtccagaccaggccttcatttttatttaaaatcatctaagaaactcttcttttgttttcttcaacttaacatatgtttccaaatttttcaaatcaatcatcttatagaggcagttcctgtaaatcgatttccttgctcagagactttcaataactctctgtttatccaaagtaaagtagaatccacatttcttatttctgattaatactggaaaagtaagtcaaaacttgtcctaccaataatgggctttgtggaaggaaaacataaaacaaaataattatgtcaagcctttcattaaaacattgcaatgtgaaagaacagctttaaaatgtgtgttctgcagggagaatacagattggtgaaggtcaatcatagttctggttattcctagaattgaatactgttcacgttctcaagactaatgggaaactgaggctctattagttacataatagaaataagaggcagccagattgaggttgcacattagtagcttttggttagataatttgagtttagaaagaggggtggagaaaaacaaatgggatctaaattatctcaagtataagaagaaaaaatttagttttattggagctgtgatagtttgaaatcatagttgatatagaatagacaatataatattattctcaaaagacatacaaagccatttcttagctttactttcagctatctgttatatattctcaaagcaattgttaattaacatttcagtgagaataattttcccaatataaaatctcattgattttaatattaaggtaaatacattatattaagaattgcttgatgtggtaatgcagtgaatttaggggaagtatttcattatctatatgcaactattatgaaataaattattgttttttattagtttactcaaaaagtaaaataaggccacataattaatcattgcatgtgttcacttgactggacctcagggtgtttaaatacctggttaacaactatttctgggtgtgtatgtgaaggtgtttccaggtgagactatcattcaaatctgtaaactgagtaaagcatattatcctccccagtgtgaatgaatgcccatcatccaatatattgaaagcctgaacagaacaaaaaggcaaagtgaattctacctgcctgtctgaaagctggaacattgattttctcctgccttgagacttggacttggattgcaacttatgccactggctgttctggtctaggcttctcatcctctgtaattgcaggagataattccttgcaatacaaaattcccctctctctcttctctctcctgccattctctccatctctgtgtgtatgtatatgtatattatgtgtgtgtgtgtgtgtgtatcctattggttctatttctctgaagaacgctaatacagattaaatgttaatgccaatcaaaaatgatttacaaaaatcctagtgaatatagttactacacttaaatgactataatggtaagcaaatattctcttaagtagttaataataattattttatatctcatatcctcatctttaattatcttttcagcagcacagtttagaaaagtctgagtaatctatgaattcttacatgctatatccaattttcctaaaataatgtcttgtaagtccatctccgtttccctggcaactgcctgagctcaccatttcactacaacccaacagtgtttttaaaagactcatcatgtcagcaatatcctttttggatttacactaacccctaccatgtctatttattttctaaaacaaacaaacaaaaaaaccatactttttttgccaaagaaattccagttattttcccttttcccaggggaaaaatgaatcttcatcacagacaaaaccctttgattcttgtttaccttcttaccctcactgtgaacaatttgtagagtggaaccctaattacatctatcaatgctgattggaaatgccacacttgaaatattttgggcgcttccttcctaccttctccaattgtgacaatgtattttcctttgaatctgaatatgtgtgccattctgtttttgcatattttcctaatacagtagtatagatagtttatttgtctataaatatgttcttatagctaccacattgggtcgaattatttatgtataagattctgagctcattacaaccctctgtctactgccccagttcctgaacacatgctgatctctttctctttaatacatgtggagaaaatgattttgattacgacagctttcaatagataattgagtgattggctcatgtaacttttcctctttccttcacattttttcttttattttttcagtctttaagaataatattatgtttttttataatttctaataacaagattatgctttgatcatttaaaaatcaaatgtttatatatatttcaatggttcctcttgaattgcagaataggtaaacagcaatcatgcagaaatttgaaaaaatgcatatgagttaagactgcttttatagtaaagctagtgaaaagcaagaggcacttctggggaagttttcagttaactgcattgctaggagattgaacagagagactgataacgaatgcgtgatgttttcaaacaatcaactcacacaggagacaaaattatgacatatagtttgtttccaatgagaatgggaggggcagtatagcagatcaggtggatgagctgaaggataaatgtcttagttgtactgaacaagcgaatgcagctggtgtaaatagcgtggtctgagtaatagtacacagaacaagtataggagagaatgataaatttagagattgccaccatggatcagaatatgagtccatctaatgttaaattcttcctatggcaataactaatatttagtgttccaaaggaagatgaaaactcaacagactgtgcctaggcaatttattcaatgttatttatcagatgagaaatttctgttatcagtcccatataaaatctttgaacaacttgaattatgcagtttgaataccctaatatttttatgctggcagaactgcaaatcatattgatgagcataaaggtagtgaagcttttaaaataatccctaaataatccctccacactattctattttcatttaccatcaaaaaacaatggttattcacatctagtgcaatatatatacaatttgaatgcattttgacatcaagcttgggtcacaatacatttaaaaacatgttaaagagaaaatgtattagcattcatgtagccaatacaatactagcctgctttacagaatgttcatgtttactgactttatatttttatatttataatttaattaatataatttttaaaatctctgagattcttagaaatatccagttggttatataagacaattctactaaaataaataaaagtaggttttattagaattatagtcagaggtaatggagtgaaaaaaatatttgaaactagaaatgtcttgggctttagtctttctgttgtcacattttagatcaaaaatatttggggagtcacttatccttcagtagatttctatttctgcatatttaagcagacttagcagcttaaacaccatcagtttattagctcacagttttatatattagaaatataagtgggcttgactctttttctccttagggtcttaccagactaaaattagttgttggccagacagatcttttctggaggctctggggaggaattttttataagctcattcaagttgtgcttagaatccagttccttacaggtagattgaacatgcacatttccttgttgagtgttaatcacaggccaccctttgttgctagaggcaacctgtgtaccttctcatgtagtgccccccatctttaatatcaccaaagaaagacttccccttatgttcaccagctggacaaaattttctactaaaaaaagaaaggtatgtgattagattaggcccagccataggagccccttttttatataataatttaatataatcatgggagttatatctcatcatattagtaggtttcactcacactcacagggagaagattacaggaaggcagtatttatggaagtcattcctacaattttgcttattacaggagccgatattttatctgaaaaaattgagattaattatatcttccatgaacaattgttggtagtagtagaagagctaatgtttagactcacttgccacatcataaacagcgaaattactaattgttctgataaacatttgaccctcatggatgcatattttatttataaacaagaatgtatgttagcacattctttctatattaactataaatctatctccttataatttcccccagcctttgaagtcaaacagataatatgtaatctctcatccatgtttattcactctgtggcattggtccagcatttgtagaaactccatttcatgtaaggcactcagtgctggggatcagtgaacaaaaatacatgacccccataatctcagagggtcctccctgaagaagtaacttgaaatgagatatggtagaagttaattaggtgaatagggaaagaatgagcctttcagaaataagcataggcatattagaaagggaaataagacagcaggaggaattaaacagctagaagactgaaaattattcaaaaagtgttacagtattagatagaaaaggtaggcagaacttgttacaggtagctgagagggagaaaagacagtaattgaaagccactaaagttttttaaaagttttttaagcatgaaggtaacataatagacattaattgtgagaataaaattattctatttactatgcagatgaaggtaaattagttcaaaagtaattaagaagaccgatcagatagaatattagactagttttgtggtaatagagatagacatgatttattttgaaatagctagatgacaaccaacataattttattgtaaatttaatatagtagggaagatgcaagggatattaggaatttcttcaagattcctagttggcatatgttgataatttgtgtatcattaactgttttaagttcaaagcccagcagtttaaacttgtgtacattgtggtggtttggcagtatttaaaatgagatatcaattagcatatttaacaaggtctggcatttagagtggagcagaaacttgagaaaataacatggaagcgactgcacatggatgaaatggagctgccaccatgcatggagaaggtggagaacctgattcagaagtcaccaaagagggttcagagttctgaacatcaagccagaaagaattattcctatgacttgaggcaatagagttttccttgatgacatctggacttgttgaaggccagtggctcctttgtttcgtgattttttttaaaaaaataaggacatccatgcctatcccaccataaaatgtcagaagcaaataatttatgttctagagtcaaagattcacatatggagagaaattttgcccaagatgaaatactcagagcttcattcatacctgatttagatgacttaggtaatacttgggacttattgatttgatgttatttagattaaattgtagacttagagttggtgctaaaatggattaaacttcagcctaaatgtccatgaataataaactggataaaggatacaccatggaatactatgcagccataaaaaagaatgagatcgtgtccttttctgggacatggatagaagtggaggtcattaactttagaaaagtaacacagaaacagaaaccaaatattgcatgttcttacttgtaagtgggagctaaatgatgagaacacatggacatatacaggggaaaaatacacagtgtggcttttcagagggtggagggtgggagaagggaaaggatcaggaaaaataactaatgactactaggcttaatacctgggtggtctgtacaagaaacccccatgacataatggtgatctgtacaagaaacccccatgaataagtttacaggtgtaacaaacctgcaaatttacccccgaacataaattgaaagtttaaaaaaagatttgaggattgttgggataaagtacatttatattgcttgtggaaagatcatgattttggggtagccacaatgtagacagtagtgggttgaatagtgtcctccaaaatctgtccatcaagagcctgtgattgttcatttcacagttttatgctgtgatggttagtactgagtgtcaacttgattggattgaaggatgcaaagtattgattctgggtctgtctgtgagggtgttggcaaaggagattaacatttgggtcagtgttctgggaaaagcagacccacccttaatctgggtggggaccatgtaatcagctgccagcatggccaggatacaaagcaggcagaaaaatgtaaaaaggcttgactgtcttagcctcccagcctacatctttctcacatgctggatgtttcctgccctcaaacatcagactccaggttcttcagctttgggactcagactgacttccttgctcctcagcttgcagacagcctattgtgggacattgtgatcttgtgagttgatactacttaataaactcccctttacatatatatgactaatacacgtctaccataaacccatgaatgtaaacttatttgaaaactgaatgtttgtagatgtaataaagttaagatgaggttatactgaaataagatcactcataagtccattgactgatgtctttataagattgggtgaagacatggagacatagatacagggagaaatggcatgtgcacatgggagcaacaattaaagtaacatgtgaaaaccaaggaacaccaaggtttgctggcacccaccagaagcaaggagagagtcatggaacagagtcttctctagacccttcagagggagcatggtccttctgaaaccttgtttttacacttgtacctaccagaactgtaagaaaacacatttccattgttttaaatcacccagtttctggtacatggttacaacagccttaggacactaacccagaaaatataggaaaagataaggcagacctacagtgataaatgagaatatttttgtttctttcttgccttttgttcacactatgaaattagagagacccaaggtattgtatgataaatgtgtagagttcagttgattaaatatagatatctctcctaaagatcctttcatataaataacaacatattataagttttaaaacttacatagaaataaaacttatgacaattatagaacaaaaatgggagagaagaaagagaagtatactcttgtaaagtccttatcttatgtgacatggtatactaatgacagtacactgtgtaactgtcatttatttgacataaatatcaaatatttgtagtatgttaaacaaaagggaaggtggaaagtctatgtgccattagataattttgtgtccagggctttctttttccatgcagaataccaggtttccaaacttcacagccgactatgagaagcttctgttatactttttttgttcaaatttgcctcaaccaattgagattattttgcaagtacaaactttaataattactaccaggattaatttgggtcttttgaaaagggaggacaattaagcaagaaaaatgctaagggttcaaacttatctcagtggagaagtaaagcagcttggtattggtaacgccgttgttaatataaagtagaaacctaggcaataccattcaggacataggcatgggcaaggacctcatgtctaaaacaccaaaagcaatggcaacaaaagccaaaattgacaaatgggatctaattaaactaaagagcttctgcacagcaaaagaacatcagagtgaacaggcaacctacagaatgggagaaaatttttgcaatctactcatctgacaaagggctaatatccagaatctacaaagaactcaaacaaatttacaagaaaaaaacaaacaaccccatcaaaaagtgggtgaaggatatgaacagacacttctcaaaataagacatttatgcagccaacagacacatgaaaaaatgctcatcatcactggccatcagagaaatgcaaatcaaaaccacagtgagataccatctcacaccagttagaatggctatcattataaagtcaggaaacaacaggtgctggagaggatgtggagaaataggaacacttttacactgttgctgggactgtaaactagttcaaccattgtggaagtcagtgtggtgattcctcaatgatctacaactagaaataccatttgactcagcaatcgcattactgggtatatacccaaatgattataaatcatgctgctataaagacacatgcacatgtatgtttattgcggcactattcacaatagaaaagacttggaaccaacccaaatgtccaacaacgatagactggattaagaaaatgtggcatcatggaatactatgcagccataaaaaaggatgagttcatgttctttgtagggacatggatgaagctggaaaccattattctcagcaaactatcacaaggacaaaaaataaaacactgcatgttctcactcataggtgggaattgaacaatgagaacacatggacacaggaaggggaacatcacacacgggggcctgttgtggggtggggggaggggggagggatagcatttggggatatacctaatgttaaatgacgagttactgggtgcagcacaccaacatggcacatgtatacatatgtaactaacctgcacattgtgcacatgtaccctaacagttaaaatataataataaaaaaaagaaattgtatttctctttcacttaccttcaattttttttttatatctgacagtctatttcaagatacaggtttctgttggggatcatactgtttctggaggaaaaatattaattaatttgttgtgaagtgatagtctgatgataatgaatcctttcggcctatttttcttttgaaagatattttcatttagacttttgtgttgacagtttttttaaatatcattacttttaaggtgtcactattgtcttctggtttacatagtttctgacaaaagtcaactgtttttattttagtttttattataatgttttcatattctctgtctgccttcaagattatctacggtttgcatcagttttactatttttatttagcactctgtctctcccccatcccccaccgcgtttgtgtgtgtgtatctgtatgtgtgtgtgtgttgtactcatcctgattgaggttctctgagctttgtggattggtgtatgttttttaccgtttttgtagaaatcttggcctttatcttttcaaaatttcttcttccttgttttctatttttgctctggaactccattcatatttatgattgactgttttatgtcttttcatagctcttcagtgttctgttcagttttccttttctctagtttttttcttatttttcgcttttattccaaaagaatttttcatctctgatattgttattttgtattgagtatactatttttagaacagttttgtattagttttagaacagtttaggggtttacagaaaaattgagagataccttatttcccctatacatattttctcctattatgaatgtctaatattagtgtggtacattaaccacaatgatgatccaatattgatacattattaagagttcatagattatattagggttctctctatgggttgtatagttgtttgggttttcacaattgcatgatgtcatgtatccaccattctagtatcatagaaaatagtttcactactctcaaaatcccatgtgctttaccactttcctcccctcccacatttattcctgatccttttacagtatttataatttgccctttttcataatgacataaagttagaatcatacattatgtactctttccagattggccttcttcacttagcaatatgcatttaatgtagctccagttcttttcatggtttgatagcttaatttttaaatcattgagtaaatttccattttactgatgtactggtttgtttatccatgcacctattataggatgtgttgggcttccagctttcaacaattatgaataaacctgctatgaacaattatatacacaattttatgtgatacacatttccaactcatttgggtaaatactagagaacattattgttggactgtatggtaaaattatgtagagctccataagaaagtgccaaactgtcttccaaaatggttgtgccattttgcatctccaccagaaataaatgagagttcctgttgcttcacattttcgccagcatttggtatcatttggtatcaaaaaaatatcattggtatttttttttcccagaaagggtctcactctcatcacccaggatggagttcagtggcacaatctcagttcactgcatgctcaacttcccaggctaaggtgatcttcccatctcagcctcccaagtagctgggactacaggcgcttgccaccatgcctgggtaatttttgcatttttagaagatggcgttttgtcatgttgaccaggctggtcttgaactcctggactcaagcaatccacctgccttgacttcccaaagtgctgggattacagctgtgagccatggtgcctggcctgcccatttttaaaggactttttttcttattctttcatttaagagttatttgtgtattttgaatataagtttcttaacatatgcacgtttcacaaacattttatctcattttgtgcttgtctttttagtccttcacaatctcaaacaacagaagctttaaacttataagtttccaacttatgtttttttttcttctctcatggatcaagctctagttgctatatttaaaaacttcatgccaaccctaggtaacttaggttaataaacactaagattaatatttctcctatgttaattttcagaagttttatatttttgtgttttacatttagatctataattctttatgagttaatctttagaaaatatgtaaagtttatatctagattaattattccttgtggatgtctagttattcctgcatcatttgcttaaaaaactattttattgagttgcctttgctctttgtaaatgatcagttgactatatttttatgggtctatttcttggttctctagtctgttccattgatttgtctatacttccaacaataccataataaagtatagtaagtaagcttagattgttggttttagatccttttatctaatacatgcactgaatgccatacatttccctataggtactgttttcactgaatcttacaattttttaaatccctctctccttttgcccaacctctggtaaccactatgagttcaacactttagattccatatgtaagtgaaataatgtggcatttgtctttctgtgcctggcctatttcgtttagttctccagtttcatccattttattgcaaacgacagaattctctttttaaaaaaaggttgaatagtattccattgtgtatgtacagcacattttctttatccattgatgaaattcattcatgaagacttaggttgagtccatattttgtctatcatgaataatgctgaaatgaaaatggagatgcagatatacttttaacatattgatttccattctttcggatatgtattcagaagtagatatgctggatcatatggcatttctatttttagtttttagaggaacctccataccattttccatatggatttactaagttacattcccaccagcaatttacatgagttcccttttttctccatgtccatgccaacattggttctctttcttttttgttttaaataaaagccattctaatgagagagaattaattgtggttttaatttgcatttccctagttattagtgatgttgagcattttttcatatacctatcgaccatttgcatgtcttcttttgaaaaatgtctgattttatttcccatttttaaattaggttgttttcttttgtttgagttgtttcagtttcttaaatattttggatattaactccttatcagatgtatgattcacaaatattttctcccattctttgggttgcctcttcactttattaattagttcctttgatatgcagaaatttttagtttgatgctatctcatttgtttatatttgcttttgttatctgtgctttcagagttatattaaaaaaattattggccaaaccaatgtaatggagattgttggctatgttttcttttagtaggtttacagtttcaggttttatattaattttcaaaatttgttttgagttaatttttgtatatggtatgagacagggatccaatatcattcgtgtgtctggatagccagtttttccagcatcactgattggggagactatcctttctctattgtgtagtcttggcacctgtgtaaaaaatcgcttaagcataaatatgtgggcttttttttgggttttctatcctgttccattggttgatgtgtctctctttttatgctagtaccatgctgtttttattataattgctttataatgtgctttgtaataagaaaacgtaatggtgtcagttttgttattgccacttaggatttttttcctattcagggtattttgtagttccatccaaatttaagataatttttttattttcatgaaaaacaacatgactaattggtatttatgctgtttcaagtatggttcaatgtacacaaacaataaatgcaggataccaattaaataaaattaagaaaaattatatgaaatcatctcaatagatgccaaaaaacctcatgttaaaattcaactgcccataatgatcaaaagaaaactttcaaaagattaagcataaagggaatgtacctcaacacagttaaggtcaaatataacaaacatatagctaacatcattctcaatgatgaaatgttgaaagctttttctctaagatcaaggataagcatgtccatcctcaccacttctttttaacattgtattggaagatgtagccagagcaattaggcaaaagaaagaaatgaaaagtattctaatagaaaatgaagaattgaactgtctctatttgctggcctggtaatctcatatatagaaaatgctaaagattccaccaaaaaactattagaactgataaatgcacttagcaaatttacaggatatactttcaacacaaaaaatcaataacatttctatatgctaataactacccaaaataatatttaaaaatatttatatctaatatatttatatttattaaatatattaatatatttatatttagttttataaatagatttatatttataagaatatttaaatattcttttggatagttactataaatcccatttacagtagcatcaataaaaatattacaacatgtatatttaaccaaggaggtaaaagacctgtatattgaaaactttaaaacactcatgaaggaattgaataaaacaaaaataatggaaatatatgccattttgatatggtttggctgagtctctacccaaatctcatcttgaattcctacatgttgtgggagggacctgatgggaagtaattgaatcatggggacaggtctttcctgtgttgctctcattatactgaataagtttcacaagatctgatcattttaaagaggagagtttccctgcacaacctctcttctcttgtctgctgccatgtgagatgtgcctttcactttcccctgtgattgtgaggcctccccagccacgtggaactgtaagtctgttaaaactctttcttttgtaatttgcccagtcttggttatgtctttatcagcagcatgaaaacagactaatacaaatgttattgatagaaataattaatattgtgaaaatgttcatgtgactcaaagccatctacagattcagtgcaagccctataaaaatttcagctttcttttgattagtcttagcatggtatatctttttatatctcttctatcattcacttttgaaaacattaatctctctcattgaaacaataactgccaaatttgtagcagttttctatttgtggcagtttttctttgtttcttacttttaaaaaacatattgtcccttttttctgtgtcttctggatccagtggtgcatcttatataactccatttgatctctctttgtgtatactatccttcctttttgaaaaatattgattgctctagagtttgcagtatgtatttacactaatccaagtgctatggaatccttgggctgtcactttgccagccagaaaactctgtggccagtggtgccattgcccaagtcttggtcagggccactgggcccacttggcatggcaggctgtgctcagctcatgctactggcctagatcccatgcctgccaaggttgagcagagtggcaagggttttgtcagcaagcgagtgtggggtcgggccactgcacacagccaggcacactggctgtggcagggctggaagctccaggcaccagcactggtgtcagctccctgtgtggttgtgactgggccagaagtactgcaagcagcttccatggctggtaccagggaatgcagtagcacctggaagttggatacaccaggacctgcagagccccaaagagggtgttgcagccctagcttggggagctcctaggtccgggctccctgaagggccacagctgttttctctttcttgttgcctgcaacatggtgagcaaggggtgtttttcagccctgtttgtgttacagctctttcagctctgccactcagtgggtcctgagttcttgtcccatgcccaggaagaaagaggtaggtagacaagtggaggatgagcaaggtgaagaagagctttattgagcaatagaacagctcagaggagaccaacagtggatagctcctcttagcaggcaggtcgtcccatcatgtcctggagtctgattgagttctgggtttccgcctgcctcagaggaaaggaagtgtgtgctgattggactatgggtggctatgggcaggcccagaaaaagcaccatgagttcctgctccggtctacagtactgacaacccagaccccaggcttcaggccttcctggcttaaaggtggggcttcactgggtacctgcccctttccacccaggaacttgtctgccttctgccactgttcatggtgtccaggctgttcatgcccaggggttctggcaggccagtgcggaactgcccttagcccctgcctcagattccctcccatgctcgttggtgcccaaagtccagagggggctgaggcggcaggggactggcatgtcagtgctcccctgagcatgcccacacacagctgggttgcaacagcacacgggcttggcctcaactcaactctgctcactggagggggcacaaggaacaggaagaagccaggcagcaggagcaggcacctctgagccagtgaggtcaggggtgcttcccagtcccgagagtgcagagatgcccgggtccacagccatggcttgggtggctgcaggtgtacctgggaaggtgtggctcctgactgctcccagcccccaagagctcagggatgcctgggttaacagccatggctggacagcctcagctgcagctgaggaaggcaaggcttccaccctgccatctcagaaaagggcagggcttccacctggtcctaactcctatcacaagtccacttttaaataaattttttcaaagggattttctgaaccttataatataacattcccacttcctccctctcatcacttattacattgctgtcattcatttcacttatccacaatgtacataatacatctttgctattattaacaattttaagactttgaacacttttaagaagatattttgttttaccttcatttactcctctaatgcttctttctttacatagattttggtttctgaccatgcttctttctttacgtagatttcaatttctgaccaatatcattttttcttctctccgaataattttttaacattgtttgcaaaatagtttactggtgacaaattatctgctttattatttaaagaaagtctttatttctctttaatttttgaaagataattttgctagacagtgacttctaggctggtgatatttttctctcaacactttaaatatttcatctcactctctttctacttctctgatttcgcatgtgaagtcaggtgcaatgcctattcttgttttcctataggtgaggtggtctttcatttccccctctgggtctttttaagagtttatctatgtttttctgtaatgaattctgcttctgttcagctgcaattctctgaattcattggtttctctagttttgtgtatgaaggtttgtcttgtcacctcaattatctggtggacttcagttgtttttcagctattcattttgttgttgtttcaatgattatgggagtgatgacctcagctttttgtgtaagagcagaaaacaatttttgatattgctcaatatttctaaattttccatttgactctttcttattcctacatttctgctataattgttcatcttttcactcatattatcttttgtttccccaaggtcttttaatatattaattatagttattcttaacttcctattaaatagttccaacatatggagtaatcattcagtcttgttctgtggattactcctcctctgtgcaatggctgaggtttttaaaaattattattatttttttgcaacttctatttttactgaatgccaggcattcgtatgtaatggcacagactgaggtgaatactcttcataactgaataagaaaatatattattcaattttctgctaatttacattgtttctgataagaaatcaaagttaattctaagtgtttatatgtatatattcaaatataatttggctacttttaagatagtttccttatcattgatttccatgagacttcgtgatacgttctctgtatttattccatttaaagttgtgttgggattttggaattctggatatgttgttttcagcaaatttagaaaaaggattggccaatagtttttaaagtacttcttctgctctaatattttaatcctctcaaatgttaattccattattcttttattagctcatgtaatattgtcccataggttactgggtctatacatatttttaactttttcttctctgtctgctttaatttgaaatttgactattcaaattcccacatattttcttcgccatgcattgtactattactttcatccattttagttttagaaagcatattatattttcattatcaagaaattcttctgagttctttccctttctctgttgagacttttacctatttattcattattcccactagtttctttacatttttaaacatttttgcaatatctgttttaagtagcacatggcaattcaaatgtctatattctctgaatctgtttctattatctgttttacttcccagatatagatcacactttttttcttcacatactttttaaaaaaatttatgctgaatagtaaagatatcacagtatataaggtttgcatattttattcctttaaaaatcgttcagtttgagctggtgggctgttaattgctagtggcctgacttgttgcttatcaagcctcctttgggtgcacttagaatagctctcattatatagcaatagtagctttatttttaagtcatgatcatctttcaactctggctggtcagatattcatctttcaacactctgtggactctaaacctgccatttatctcatagttttccaggaattttctgaaaacccttatagaatgttgtctatgaaagtgcaggtttgcattcaaccaaaaatctagggctcgtgcatattttaaattattatttttttcctgagaagctgcctcctttctaataccttccctgtaagtccaactttccaaaatttccaaatcaaccctgcaatctgatctctattatctgtatggattctaattccctatgctacattttggaaactagcttagaaagcaaattggtttcaatgtgacagtcatctcatgtgtttctcttgtgtcacacatcagtttgtaggtccattgaaaagcctttaaaatatattttatccaggttttatttgtatacagcagaagagtaagtccaatgactgattatcaattggatccaaaagtctggttactaatcataagtcatacatagatctattaaatgggattttgctaaatggaaggatatgtttttgtgacctcatccactgtcccccttggtactggctaaattatatttttagatttatattaaaagagagtttcataggccaaatcagagctaagttggcacaagtgctattgagaaggcaaaaataattttgagaaatacagaggtgctataccttctttttttttttttttttttttgacagaatcttgctctgtcaccaggctggagtgcagtggtgcaatctcggctcactgcaacctccaactccctggttcaagtgattctcctgcctcagcctcctgagtagctgggattacaggcacacgccaccatgcccagctaatttttgtatttttagtagagatggggattcaccatgttggctacgatagtctcgatctcctgaccctgtgatccacctgccgcggcctttcaaagtgctgggattacaagcgtgagccactgtgtctggcccagaagtgctatgactaatggactcatctgagattgagaattttaagttgacttagaaaggttaataatggggcaggcgcagtggctcacgtctgtaatcccagcactttgggaggctgaggcagttggatcacctgaggtcaggagtttgagaccagcctggccaacatggtgaaaccccgtctctactaaaaatacaaaaattagctaggcacagtggtgggcatctgtaatcccagctattcaggaggctgaggcgaattgcttgcacctgagaggcagaggttgcagtgagcctagatagcgccattgcactccagcctgggcaacaagaaggaaatcctgtctcaaaaaaagaaattaataatgttatttgcagatatcaagattctctatagacccaacttttctgtcttaggatattggttgctttataacaatctatatatttattcaaaagccaattatctagggatatttctgggctgtgaacaaaaatatctttctactttcaagtaactcaaataaataccaaggtgtggaaataaaaaattgcatatatatacacacataaagtctaagaaatttgagattatggtaagtactgttaagaaaataaaagagatcatataatagatattaaatcagtttataaagaggaaggactataggaggtgatttctaagaaggcaatatatgagctgatgtctaaagaagccaagtatgtgaacgccattagaaatgcaccccaggcatagaggagaaaaaacgaagtgttttctaaagagtgagtgatttttagatatgttacaggaaacaaacaaaataaagtttaatataggtgtgcattggaatgcatatattgaaaaagttgtcagtgtccaagtcttataagccttttcagtcatgttaagaaattaacttttattttaagcacagcaggaaaatcactgaagggtttataggggtaaagttatttattaaatgtatatttaaaattatgttcatttttttctgctatctggaaaagggaaggtaagaatgtagaaacacagatatctgttgggaatctagattttaggactcaatgaaggataatgataccctagactgatgtagctgcaataaagggaagaagtaaactaattaagattatttcattgtgtaaactaatagaactttgtgatggattggatgtgggaatgaagtagagatcagaatcacatatggttccaagatttatggtgtggtatttatggaagcttttactgaagtggaacagaaatcagaaattttaaaaaattaattacagacagtttggagattctttaaattgaaagtgttaagtaaaagattatgatttattaccagaaactacttcttgtctattttttgattctcataatcttatttttattaccatattacatttagcaatctgcttaaactgtatcatccattctttgcatgttcatgaaaatacatgcaatctgtctggagagatgataaaagttaaatctttatcatgattatttggaatttactgatactggatttctttcactttaaagaaaattgcctctttctattttagggaaatatttaatacagtcctactacagttgattaattgcatcctataggcaacaacaaatttgaatgtctctcttagaccttgagatctgtttcaatcaccaaaattatttggttgtcattttataaagtagagatataagaatgaatagcttctcaggttttttctttaaatttgccaatataggtcacgcttccctatggtttattatttattcaacagcctttaaaatatttaaagcaatagaatttttctgcctgtattgaaggaacattaaatgtgctcaaaaggcctctagttagatataatttttatgattcccaaactgttttttattttttagttatcattcctgctattagagttctaccattgaattgttattagataatatttgtagttctactttatattaataaaatatatttttgtccaaatatatctttaaagatgaaatttgtgatttttttcaatgacaagttctgctatgaaacaaatactttaaagttgctccactgtcctgagaatattaattttccaatttcaataaaaagagcagatggttaacattaagagtgatgaaacaggagatttaaatggttttacaataaaaaatgaaaacaaactcagttcatcattagttaaaagttacacaattgatctatcaccttcatattccaaaaatgtatacatatgcctggtaagaaggtaaatttattttctgggtgtggaatacagaagaacttttaaagggagaaaatattttagaaaggagaactcactatgcataaataaatttagaacatagctatcattcaataaatgttaattaaatccagatatttaatttgaggcataaaaatatcaaaaagaccatgtgtcttattttatttccagctttagatgaccgatttcctacaaacttattaaaagtttatagagaatttgttcatttgtttttattttagttttctacagatgaattatgtttcagaaaatgccaaacctgaatttcagtctcaaatcctctaccatctttttcacctaatacaacttatttaaatttgtcctgtcttctcaagtgtaaggtggaaatatgcttaattcagaatgttgagatatcaaatgacaaatgccttcaaattggtccacagtaggaactcacaaacattctatctttttcctattgcttttcttgactaacctatcaggcaggtgatcctatgacacatagagcaaaaatctgtccatgtcctcaaaaaccattatcaatattccattgtcaatgaaatctgagttctctatagatgcttatcttcttagcctgtttatcttatctttgatggcaggagttatgttctagatgttacttgtattattatagtatgtggtccaatattcatttactaaaccaagctgtttttatctctgaattttctgtaatattgataaaaacttcctttgcttgaacttccagaaaattccaagtctatgttagaaagccatacaaaattaaattctacttttgaaaataagccttcagactaagtgaattgtaattatttgtgtatatttcctggtcttttatcttcaatcaacacttgttataaaatgaactttcattagacaactgacattagacaagcttcactaaaagtatcattaattttgattttatttcttaaataaaaagcctgtggataattaaaacccttgtatatcatttagaagaagctctaataccatggattgttcgaatactcataaaatatataaagaaaagatggcatatttcaaaatcttgaaaacattgtctttattaattcatttacatatcattttaatcttatttaaattatatttttattttaaaaaatcacttcaagtcttctgatgttagtatttgtttgtttatttttaaatacttattgaaccctttgaatgtgacaagtgtggtttataatcctggaaattcacttgtgaataaacacaaatatttctgtactcatgtagaattggatatttttttctcattttcatagtgacaattttttctaacttattaaaacataaatgcatgttacaaaatattaatggagaaagcatgtaaaatgccactaaatgtaaattttctgttacagcttcgttatacctaaatacaaagccaatgtttccaatgattatgtaatcttatataactccatcatattcaattaactatgaattataccctaatctatgacttatgtggctagactattacgcaaaacatttaggtattattcttagaattaataaatttttgtattggttacttgataaaattcttgctgtatcaactaagtgggttggattgattatacataataaaccagagaaggtctccatatggaaggaggatattcagaaaagttcaaagatgggggagaatactattttctaggaagattaaacattttgtcatttcattacaggaacatatttttctgaaggtgttgattaaattatacaaacaggccatcaggttaaaaagaattacaatttgagtactacctttggaatttttctatcattctttacatgattactacaaacggacttgcacgagactttttaagctcagtgttctttcccttttgattttccccagtaaataataatatttcactgtctaaagacttccgactaaatatacttaattgaataagtaagagccttttaatcctttaaactgtaatttattaattaggtaatatgctagaaattgagttttcttagatctcagttgtgacttctcagttatcattttatcataccttacacttcattttatattttatatgaaaggattctcttatctacttatcactcagatacatcaagggagtggctctatgtcttgtgagcttaacagaaataactaccatgttccataaacatgaacatttgttcagactattataatccatgctcagttgtttttatttattctgaattaactaaaaatacaagttcctcaatctcatctaattcttttttgttttcaacaaacatgttttcagcatctcttttatatctggaccaggggatacagggaaagtccctgccctcatggaactttgttctcaagggaagaactaacaatcaaaataataaatgagataattacaaactaaggtaatgaatgagaagaaaatttaaaaaaaagatgacatagtgaagtaatttggggttatttcatcataaagagttcccttttaagagaaaaaaaatcttagttgagacctgaatagaaggaaatggccatgtgcacatctgaggaaaggatatttctgtagaagaaacatgatgaacaaaatctccaaaggaaaatagtgtagcatgtttgagaaataagcagcagctcgtgaacttgcatgattaaagagataatgttttgatataatgttgagagacaagccagagataaagcagattataaaagatcttgagaattaggttaagttttgactttattctaacaaaaatgagagggcattcaattattttaagtggggagttataagatctttttttttcttttttatgtaagacaagtctgtaaagaatttattggagaaaggtaagactagaagtaaggaggttgactgagaatatcactgcagtcatacaaaaaagagatggctattatttcaactgaagtgattaacagtggagaaaaaaaagacatctaagatggtcttttaagttagaactgaaaggatcaggcactaaatacgagggtgagagtaagaaaacaatcaatcatagtttccatgttgttttcttagatcaccggatggataatggtttctttacacaagatgagtaggaacatataacactgaaattccacttttaggtatataccaaagagaattgaaagcctgcatacaccccaaatcttacacataaatattcataaaagtgctattcataacagctgaaaatgtgcatattagaaagtgattgtgaatactcaaaagtcacaggcttagaaattacttgagaagaagtttacaacttagggtgatccttgatacagagtcagcttacaacaattaaaaaactaaaaataaacaaaaacaattacccccctcctcccccctccaaaaaaaaaaaaacaaaaagctgggaagtgggagaatctgatttgcagatttacaacattataagatcaaaatatccacttttcaacaaacatcacaaggcatagtgaaagaaggaaacaggaaaagatggcccattgaaatggaaacaaaaaacataaccaacagaaccttcctgaataatacctcgtggcagatctaccagacaacaattttaaaataattttcttaaagatgcttaagaagtaatagaggatgtggagaatgtaaagaaactatatgaacaaattggaaatatgagtaaagagatagcctaaataggaactaagagaaattctggagctgtaaactacaataacagaaatatgaaattcactggagggacttaaaggcatatttgagcagaccgaaggaaaaaaatagtgaatgtaaagataagacaatagaatttatgaattcagagaaacagaaataaataaagtttgaagaaaagtgaccaaagcctaagggacttgtgggataccatcaagtggaccaacatacacactgtggaagtctcagaagaagatgaaaaggaagggacacagagaatgcttgaagaaataatggcttaaattatcttacattcaactgagtaaagtcaaaaatatgaacatccaagaagctggcttatttcgctcaaaattaagtttctacgatttttctgctgttgtgtgaattacaattattgtgattatacaattatatagacatctaataaatatcttttacataatattatttgcataacatgccatttgcataatattcaatgttcccattaagaccctaatggatattttaaggaacaggccatcattaaactttttttctgctaggttttctcacagttgcttctcaaaaaaaaaaaaaaatcttgttttggtcacagagtggaaagtacctgtagatctacttaatatcccttttgaaaagattaggagggcattgtggtattggagttaaatgtctctaactgactacaggtaacacatgttttcttttaggcctgaaattaatgctatgtttatataacttcctaaatgaaatacaatacttttgggataaaaataaaagtcatctcttgctcttagagaggacaacagagtaaaagaaatgttctgagctgataaataaaggtaggtaactatgtctgctctcttggagtcaaaattttctctaaaggtcaacaccatactaaacacaatgctaaaaacacaattactaaaatgctagtcagctcctcccaaactctgtacaaattttgcagatgcagctttgatttgttttattcctcttgagagaaggtaggtttcaccagagtatttttgtaaatagtaattttccttagaaaattaaatctcagatgtttaaaggttaacagggtctttctgttatggctctaaaggataagccaaccaaggattgacaacaaagaatttgaaaaagaaggcaaccattcatttgccaatgaaaagagcagaaggctgagaggtgattataaaagtctttatccagaaatagataactctggacaaaagtagcaaatgaagggagtggatatattaaagatggagaatcttgtttctactgtcctctgaagttatggtggtagcaaattcaaatttatatagtagccaggtaaatagcctaaataagtacagttgacaactcatatgaaagggagagtgtatgtcccatctcaaggaggtaatgactcctcatagccagcctgttgttaccaaagtgaaatgtatgcccaatgtttacaggtcttctacattgtaataagaagcaaaaattaagggtatcatgtaatgatctaacttataaatattatctcacctttataaattatcttgcccaacaaaacagatccagactatattcaacctgtgggccacatttagcaagctgcctaataattaattaaatgttgaaaaccaatggtgcagtaagtcaaaactcctatcttctgatgatagaaaatctggctggctggcgatttcttgctgaggacataggatccagcccaaagtttctgaccacaacacatggaagtggaagtcaagatgcagaagaaggagaccatctcttatagcccctctgcttccagggagtggtagttgactcccctgtgtttagagatgagaaaatgtaaatcaatatctcacctttccttaatcctcacccactttaaagcctcagttgaaatctagagttccagcatcatcaaaattatgatagtgagagtaaacacaggaaagctagattatcttagagtctcaaaggaacataaacagcatgagtcaggaagtctaacatgttctttgcaattcccccagtacctagacaagttggcatgttgtaggagctccataaatggaccaggaagtataacaggaacttcaggagtgcagtcacacttagtaaagtgtgacttgatcaatatgctcacatgattaaatttgtttcagccagataacagtgggaactgttatgaaaaagactaagagatgaaatgctaaagagactaaaacaaggtaagatctgtaaggaaataacaaggaactaaaatagagcattgtattagactgtttttacactgctgataaagacacatctgagaatgaatgggcaatttacaaaggtaagaggtttataggacttactgttccacatggctggggaggcattacaattatggcagaaggtgaaaggcacatctcacatggatggcagcaagcaaagagcttgtgcagggaaactcccatttttaaaaccatcagatcttgtgagacttattcactatcatgagaactgcacgggaaagacccatccccatgattcaattacttctcaccgggtccctcccacaacatatgggaattcaagaagagatttgggaggggacacagccaaatcatatcaagcagtgaaattaattttccactacaacaccagaggaaagaatcctttcaaacatgggagacacttttatgtgaaatccaaagagttgatcccatagaaacagagagttaaaaggcagttgccagaggctggaggaaggagcaaggtggagaaagggatgatattgatcaaagggtacaaatttttaattagaatagaggaatatgttgtagtgacttatcacattttatgggtgccatagttaataataatgtattgcatatatcaaaattgcttaaaaatagatttttaacattctcattacaaaaaaaattatcagttagtggggagatggatatgttcattagcttgactgaatctttcaacaatgtttacataaataaaaaaacatcatattgtgcctcataaatatatacaattactatgtgtcaattaaaaataaataaatacataaattttacaaatgaaaaaataaatgtggcacatttttttctttttgcattagaaatattagggccaagatttcaaattgcaaatgtcttcaaagctctttgctttctaatggattatatttctatttattttccccattaaaagccacaattaaatggcctggtagtacttcaaaactttgatttttaagtgtctttaagatttctttaaatttgaccagtttgtatgaaaccacagcacatttcagctgaataatgacagtgcagaaaggcactttgttacagataaaaatcattgactttcggagatgccatcaatagtcatttagactagaatatttcagtctcaaaagtaaagatattttctcctttataggcagcacattgcattttacatggttgttaagatttatagattcattgtctagcttccataggtgaagtaatttcagactcacataaccaaaagaggtagaatttcattgtatcgaattctcttttcttccctttctactcaattagtgaaaaatctgtttttcaaattgtaatgtctcagatactgacagtaaggatttccatactttaaaaagtatgcagtatgctccatacctgggctttgggcaccttcactggattccttcctgttttgatttttaaactcattattttagtttggattctgctgaaatcagaacttaagatgggggcttgtgtgcagtaatgcatttggtagatgattttaggaagtaaaattgaggagctcgggacatgaaatcagagaataacgaagtcagtagaagaaatcttattatggttactatttgggcaatgactaaataattacataatgacctttagaaagttaataacatataatcaggattatccataagtaaagctggtgattagaatatttataaattaccttccatccctagttgtttgaagggtgtcttaggagcactgacttcttgtattttgagcctgaacgtgcctgtatgctaaggtagttcacatcgtgtatgaaaagatcctcaaagggagcaaagacttgatataaggaactgccatgatgaggcgagctgagatcactcagtacagctcattccaaatgcagtactgctcattccaaatgcaactgaaatcagaggctgaccaagaaagaggatgtagcctggagcaccagagtcatttgctatgtttactgcaggaagtatcaaggcctgctttctagaaatatacctgtaggtctgcctccctccatgtactctctgatcttccccattcaattgaccccaatcttccaagaagccagttgtgtatattttgcttggaatgtgctttgtacactcaattcttacctcaatttgcaccaatttgtgtgtgtgtgtgtgctgaggaagttggagaattaaaatgttcatgctttgggacataggtattaggtgtgctcttcataataactttgccagaaagccctgcactttgggaattattgagcttttgtgattacatatggcaatgtaatcttgtattttgagttctcacttatggttagaacttcagttgggtgctccgggctatatcttcttccttgtccagcctctgatatcagttgcatttgaaatgagcagttctgagtggtctcaactcacctcataatgaaagttccctatgtaaagtgctcgctgagtctttgctccctcttgagggtctttttctatacataggagccatccatgtatagaaagaaactatgaacaactgaagaagaagaaacactgaacaactaggaataacaaccacatcagagcctaacacattaaatcatccaataactataatttttggtaccactggtctttaattaggtcattctaattaaaatgttcttacataatttgttctgtaatgttaaaagtgtattttaatgttctatctattatatataatttatctgaggccaattactctaaaatatgtgatgccctagaaaactaaatataggtggataatgacctataaatatatgataattgatgtgtttttaatagacattacttaatctcaaatcattatcttattttgtagagtataaaaattaactgcttcaagattattttatattatataaagaatcaccaatgataaagttacttgtcttaatttgctattggtttcaatttagaaagatttattatgagttagtgaataatataaaaagtctaaattttgtgttttacttcacctctagatttactataaagaacaattttactttgtaatattacatcaaattatatcctatctgaatttaaaattaatgttatatactcacatatattgtattttaatttagaatgaacctgattcacagggttgtaaaaaattatctagattgtttgccacagtttcaaaaagtcagcattttaaaagtcagaattttatttcttattggttactaattttttaaatgttttttattggcagcatgagaagaaaattaaaagagaaaacactttatgaaaaactataatcactaagcagttacatgtgttaacattcaaaaagtttaaattgtatacaattaaaaaattaacttacttgaagtgaaatatgattttattttaaaaatttttgtgtgcctttaatgtcctaggcactcttgtaggtactgcaataaaataatgaacaaaagagagaaattcctgtgttcaaggagatttaattcaagtagtaagagagaaaataaacagttaagtgacagacttattaggaagtgctaattgctaggaagggaataaaaggtaattgaatagagtgacatagtgttatttttatataatgtaggtaggcttgtaagagaaacttctatacaaagcctgataaaataatacagaaaagcatgctatcagagggaagtgatacacacccagatagaatagcagaggccaacactgtggaattgagggagaaattagattagagaggtagctaggggccatattatacaggatttagcagaccaatgtaaggagtatgtgctttgttcaagtattttgggaagctacggaagattttgaacatgggagtgaagtgatatgctttaattttaaaatgatcactctgggtgctagatagtgaatatattttaacatcagaagagggaagatggagacaaattaagatgtcatatttcaggcaagagatgatgggggcttagactaggatcattgcaatataggttgtgaaagtggttgaattaaaatgtattttgaagatgcagccaatgggatttgctgatggactgcatggagatgtgtgagcaaagagttaagaataactccacagttttggcctgagaaactgggtaataatgatgccatccactgaggtggacaacactaggcagaacacagttggaataaatcctcagtactaatcagtctgaggtattatatggatacctgaatgaacatgttagtagttatttgggtatatgagttgagagttcaggggagacacaaagattcatagaacatatttgggaattattagtatatttatggtattttttaaatggttgaaattcctcaatcagtgaacatatctaaaaatagaaataatgatgatctaaacaattatgcgatccactaatagtaagagaaaacaatgatgaaattgataattgcggaaacatggagtgcaagtttacaaggtattttacataaacaaaataggtaaaatgctactgataatatgaccacaatgtggaaagaaaatggcaatggagaataattagtgacctccaacaagaagaataccattttaatcttgggattaaagcatgattggaagtgggattgaaagagaataggtagtgaggaaatggatattcaatagacagcaggtttcaaaattcttttttttaaacaaatcgagtagtagtttaacactttttacacattgtagaaagattcaaaaacaaaatgaggaaaaggtaaatatttattcatatgctgatagcaagtgatatagtatggagagaataatttatgctggagaaaataaatgcaggataaactttccttaacaataaatgaggctgggtgcagtggctcatgcctgtaatcccagcactttgataggctgaggcaggcagatgacttgaggtcaggagttcaagaacagccttgccaacatggtgaaaccccatctttactaaaaatacaaaaattagctgggtgtggtggcgagcacccgtaatcccagctacttgggaggctgaggcaggagaattgcttgaggtggaggttgcagtgagcagagattgcaccactgcactccagcctaggcgacaacagcgagactccatcggaaaaaagaaaatatgataataataatggagagaatccatacagcagtagggcagtagggttgacaatagacaggaatgtggaaaaacagaaaatgtagtctatgaatgcagatgcgtatagtttggtagttgttagtgcgaagataaagaagctttcttctgatggcttttattttctcagggatataagaaacaaagacaattgaaacttcaatagagaaaggattgataatggtgtaaaaagataaagctagaatagtaggctaggatactcggaaattcaattgattcagaagaagcaggattgtcaggcagcaccaagggctttcttgagatttgtggtcaagaaatcaaggtaagaacattcattctcattctctctctctctctctccctccccccactcataatttttctctgtgtgtgtttgcgtgtgtgtgtttctttaagcacatgcattttttttctgacaagtaagagtgattttaataatgagtcctataatgtaggctgggaacatgggaaataaggatttttttttttaacaagagtcaaaattggcagcctgaaaatagcattaatgagcaattcttggaagacttgtattttcctactcacctcttcagctaatgtcatgccagcctcttggtcattgctctgtgcttctttcctgctgcaacttctatcctcctggtgtttattttgccctgtgctagaaactgcattgatattttactctctgaagttccattaacacgcatttttgtttgcattatagaatttcactaagggtttgaagaaataatttagagcacggtagaaaaaataagttgaattttatgtgttgcccttttagcaatttgttggcttttttgaacagaactatctaactggcccttaggttctggctcaccaaatcttgtcaaatctattttctcactgtgtatgtcctcacctctatctccacctatcatttcctatgaaggggaaaagacccaccaataatgacatttcagctttctaaaatacaatagctggctttgatgctcactcacaaatagtatcaaaatcaccagtcaggcattcccattcattcagatttttcagttagcattttgatggttctctcttagacattaaccgatattcaaggattttctcatattaaagggatatctctaaataaatagatacataaacaagaaaatagcacatacacgcagaaaaaagaaattctgaaacactgaggcaaggcaggaaaaaaacatacaaaaagcttcataaatattattttagagaaaatataagatattttgtttgtgaacattgcagaatgcgctaaaaatattaggtaagatagacagttttggggaactgaaatgaaagctaaatattaacaatgtaatagaggcactggaaaagaagatgtaagtaaatcctcaaatgagcaaaaaataaaattagagaggaatattgatatatttacaatattattgacaatgacttctgactaataacatttttgatataactatgtggggaggaaagagtaagaaaacatatttggttagggggatagggataagctaagttttaattatccatagaaacaattagatatgtgaaacacagaagagaaaagttcaagaaatggtagtataattgtgccatttagaaatatagaggtaaatatcagaagtattaagagtgttgaaagaagttgcttctggaagcaggtctgctgtgttttatattattctcccacctcctcactcctgctttatacaggcaaatcataccttttccagagctgtcgctggtataacacctctttcttcctagtgtcattatagaattagttacctgattctgtaactgttaagcatagtcattgctaaacacagggccctcattacacacaggcggaaaaagcaaagcattttgaggaatctgtgaatttgtaagtcctttaaaatcagattagtctttgtacattgtatattttttcctaatacctcaagactgcaagactgctaactatagctaaaattctgaggtgcttcccctatttaatttatgatatgatggtgcttttttatataattgtatatacatgctatgaagattctaatgtcccatagacatatcaaagcttcttttttgctttactctcttcttctaattattcaattacataaaaatgtaaatatcagttagtaaggaactatttcatctttatatgtaattaagtgtaattttggttcttgatctctctctacctctccctctctatacacatttgtatatctgtgtttgtaccaatatattataggcatcttgaacccaaacctaatcaactttttccgtagctttcccttaatgttccatttaaattcacttccccaactccttaccttcatcctggtccccataatcatttgtttttaatttctttttagaatttttcctgtggaaagttaataccatataaggcaattaagctattatatctcatatatatctatatatacatatttatatatatttatttataggtttgtgtttatattttacacacatacttatgtataagagattttatatatatatatacacacacacatatatttctatacacacgctctagtatgtatattatactggccttattttatatattatgtgtgtgtataatatataaaataaatgtgaataaattttttttttgatcatagctttctgtcagaactttgagagttaaatcctccaacccttctaggaagtagtattgccattctctgacacacctggcctgaattgatgcctgaatcaattcagaatttactacatctattgagacactttgtccatcctgattactgcataacaagttcacctcatgtctcatgctagtgcattaatccaggtgcaaaaactaccccctaacaattgtatgtgagctgggtttttgtacccttatcatcatttttttgacattaaaaagaaagctcatttctttcaatatgagaagcctaaaatagagttaactgaaagtcatacacatgagaacaagttattgattgtagtggcaggagactaagtgccgaatgatgttgtataacagattcactgtgccaagtctaaatgtctggaatatcatctgtgggaaaattcaacttcttattttagccactgtattttaatattttagcatttttttgttagcaaaggtaatcttatctggatgaatatattcagttatacatttttttcatatctttggaaatatctccgattactttacatatttagttggattttgttcaatatctctctttaccgtaacataagctcctttagggtagggaaccttctctgttatgttcaccagactttactgagagttttcaacaaggcttgggatgtaagaggcacgtacacatttgtgacattagcaaatagaaaatgcaattgcattctgcgtccattcatggttataactcaataaaataagatattggctattaaaatttgcatctggatagtaaatctagaatataaatcttcaatgtaaactctgtaagttttattccttctttgcaattgttcctcttgccatttaagctgatttaagggcttacttaaataaacattgttttaagaaaagccaaggacagtctataaaataagttaattaaaagtactattaatgtttgtaattcaatgatataaacatcatttttcaaagtgcaatttcaatgtgtaagatccagcttttgataaaagagaaatggatttgcgagttctaagtgataaaggcaattttataatgaggttttggatttcaaatgaggatgagacagcttggacatagtaagcaaagcccatggaagagaacatggacatcaagagtctataccagtacacagtacccaaataccagggacaatgtctttctccattgcgtccagattaaacagagcaaaagagtgacggatctctgaataaaaaagatattcaactccaaaactgatataactgaattttgtcttgaaaaagtcacacatcgacttggcacattgacattttcttctgttagatgaaattttacccatacattatatggaattcattatgacacaaataacatatatgtttgcacatttgagttgtgaaagtgaattttaaatcttgtcacataagggaaaagtggttgagcacaattcagttgcctgtttaatgtagctcctgcctacattaacagaaaaaggaaatggtaaatgctatgttaataatgttgctgtcgttgacaaaaaaaaatgattactattaatctaaagctaaatataatcaaataccaaatattttcctaaatgtttatatctatagacttatagttatcaatcaaacaaaaaataaacactaaaccctttgtgtttaaattattacagatgcataatgtgtaattagaaatttgaagttgcttttacatcttttatttcccattcaattaattatctttatattctattttaatatatcttgttaaactaggaactcagctgacatattgtaccagagtagactaaactttgatggagagaagagataaaatggtgagcaagtagatttggggagtctcctcagacgaactgataattaaatcagaatttcacaaaactataagttcagtggataaaatgggtgatatagaagaaaataacagaagccaagagtctaagaaaagattcctatagaaagttgcatctgagttatggtatgaggatcagtacttgcaataggataaatggggtattttaggcagcagaaacaatataataataatatctttacaataaccaaaaatgtacaattgatcaattgtccatattttcccaaactatgcttctttatacatgtactcaaggcagattgttttacttcttatgtagattgggcatttggcaaaaaatgtattcagaagacagcttagttatctcaagcagaaaatattataactgaatatagtcatacgtttgcatgtgtatatgaaacatatccaagaaaaaatgtgcatcgctttgaagcaaacataattatattttattattctgaactattgaattgtatatgttttctacatggcattattatcaaagttattatttctgagataggacttaggcattttaaaaatatttatacttttctagtagatatataaatattaatatagatataaacacaaatgtagacatgactacatgtaatcacatttaaagtccttaagcacaagttcataaacttttatctacagattaataatatataatcgtgtctagttaagaggagacttcttgctaaatgagtgaatattttagaaagcaatataaatttatttatattcatctttcctatatttaaatcactaataattaaaactcaaattcgtaagccaatattctttaggaaagacaaagttagacaacactgcaaatctactgataaactgatttatatcttttgcaagataaaatgcaagcctttgatcatatgccatcacttgtgtacttcctgttcattaaattcagtcaactcactaccactacgtgtgtaaatttggactctgtgatagtgtttaattaaaaatactctagataaattaattatagaatggctttaaatagtcaactttgtaaatgtttattatcttcttccaattctagataccacaagtcttcataagaataagaaccatgtcagccttgatcatcacaaaacctcaacagctaatagaatacaaatcataaaatgaagaagtatcgagttaatcactgatagcctgtgtacatattatttaatgtgttcttcaaagaatgctctgatttagataattaagaatcataaactttcctggtcagagtcttgaaaaatttatatccttaataacttggttaaatgtattcataggtgtaggcaaagctaaatttttctgaataatatatttggttaccaaattttaacacatttaatattgtatttaatgttattttaactttcctctctatcactaataccattacattcaaattttgtttttttctgatggagcaaagctagagtagaaataaaactggaattagagagggatgtgtattttggttccggctctgtcactaccagatgtatgatcttgaaaaatatacaaaagtataacatccttgtgttttaaagtttaagattctttaagtaaaaccttgcagtgtcatgactctcttgaaatggaacaacctaaaaatgaatagatttgaacatctcacaaaacagtaatgctttaggagccttgaaaaaaagatttccagagaaggctaagaaaaataaatgctattaagtgtctgagaataagaaaaagctttatctgtccatgtatgaaagagaaggtcaatttgaatgtcaaaagagtatgtacagaaaaacaaatacatgtaactttcttgagggggaaaacttctttttgaatgtccagtcatgtatctttcttggtttgaaaccaaactgtaacacatatttcataatattttttctatattcaactgtaaattctgaaagtggtacacttttaatttcttatcttccactgaacctaaaaatggacatgtgagcagttttgctcagtgacatattagcaggttttgattgttattctaaaaaggttctccttatagaaagactcaatacagttagcaccactcttttcctttgactcaagtgtagaaataatgacttaagtcattgcagtagcaattctgaatgcatgaacctataatcatgaattaaaaactaagaaaaccattaccccatcctggtactgtcaagtcactggaccaacaaccattagctgtctacctacagaattcttattatgtaagaaaaaatgaaccctatctattaaggataacaattaattgagttttcttttacttgtagctgtaccaatatgcaaacatatattaaaacatcttaaatcatgtgccactggtaacatcttagataatatcattttaaaacaatgctaagtaccatattttgaaatgaaattaaagaggttatcaaaagaaaaataaagaacatgttaatctttcaaatgttgatacatttaaaatatcagagcaaggtgttataacaaataattttacaaaatgtgtttcttagtcatgttgagctcagtgtgttgtttcttattttaatacttctagcagcagtaacaacaacaaggtgaatggcattgctgagtggatatatatggttctacattgatagctcaataattttgaagataatgggcaatgtgaaacttagaaagtaaactgttttatagttgaaatttaatgtttcttgtatattatatgtaatgaactttgcagaaaatgatactttttgggaaatattaacttaatctgatagtttttgtgtatatgagatttgttaccaagattacctctgaagccatcaagatttctcaggaaagacaccttcatatttctttttaaggtcacgtaactttctctcaccttttgattacttattctctggaaatacttctagttcctttccatttttgcttgccaatataatttccatgtgtctagtattattttatccctgctggcagagaacctaatattagatgtatttaactactcatccctcaggatagaaatccatatgattttagtgctgcacaaatcagatgttaataaactgagatttgagatgtaaatacattattgtaatctctgtgggaattgtctgaaaaaatacatatgaaacaaaataacacaaaaactatattattgttagtcccatatcattaatactagtatgccaaaactaaaacaatatagctatttgtattttgtaaatgcaatttctcaccagaaatttagagggctaatgcctctaccttctataagctccctgatgacttttgcctttatgtttggataaaatttatgctgtgaaataattgatactgacagctaatgccaatcttcttttgctttacatttaaattcacaatggctgtctttttatgtaaatatttttaatgctaagcatattctagaaatgacagttttgtaacagatataataatgttatttctgttagattacccatacagaaatacttttttgtatattatagccatgcaaacttactaaagatacatttactgtaaaagataaaaatgtaagataacttaaaatctaatcttaggatttaataaattgaagataaaacacataattttacttcttattaatttcttttataagagacaaattatctcttgacatttttgccctgtttgcatctggcagattatttcaggttttggagtataaatatgaggtttctatttgcttgcagacagaaatatgttgctgcacatgggacagatatggatttacctgtataaccaggggcacagaggcagttgtatccatcagtcctgtagacacaattttcttcatctagacaaggtgagattttacatttatttacatcaagttcacagaagggcccatggtactcaggttcacaattacaaaaaaatctggagaaaagtggagaaatgaggaatagccatgtaacaatgataatcatttattatatatgattcatatttatattttaaattcaagacattcaacttaattgaaataaataatatatgtatttcatttttttctttgaaaaaatatagcaattctccttgcaaaattttgttctgctcaaatgttctttatgtgtgaaattttgaaaaacaatgtgttgggtaaataattactgtaacctgataaatactagtatcaaaatatagatgaggtcatgtcctttgtagggacatggatgaagctggaaaccatcattctcagcaaactatcacaaggacaaaaaaccaaacaccgcatgttctcactcataggtgggaagtgaacaatgagaacacatggacacaggaaggggaacatcacacaccggggactgttgtggggtggggggaggggggagggatagcattgggagagatacctaatattaaatgatgagttgatgggtgcagcacaccaacatggcacatgtatacatatgtaacaaatctgcacgttgtgcacatgtaccctgaaacttaaagtataataataataaacaaacaaaaaaaaagaaataatttccaaaggagatattaaactgatcgaaactgtatacttagcaaaaatatctcttcatagtttttccttttagaagtctagataaagaagctttagcaactttccataaaatgtttttgagctagatttctatttagattttttaggaaactcttcctaattaacttcactcatcattttataaccacagaagtctaacattccccatgctcctccttttacttcttcaacctacattaattaattgagcgccagacattagtcatgtacccatattcaagtgtaaattaaactagagcttgcttttgaaagtctcaggaacaggacaggaatacagatatgtaaacattacagtaaatacatgtcaattgagacaggtcctgttaaagcatggctagctgctagacaagaggtgacagaaaaggtcttactcagtattaataaagaaggagcaggatcagtgttttaaaattctgaatatgaatgaaaacatgcagtatttttctttctgtgcctggcatatttcatttacaataatgtcctccaggatcatgtatgttgttacaaataacaggacttcattctttttcatggctgaagagtatttcattgtttatgtatactacatattttttattcattcatctcttaagtaaagtaagccagacagtaggggagaggggataggaaagattgattgatgggtgcaaaattacatgtagaaaggaagaataaatttggtgtcctattgcacagtacggtgactgtagtaaacagtaaggtattgtatattcaaaagagctagaggagaaaattttgaatgtttgcaccacaaagaaatgatgaatgtttgaggtgatctctatgctaattatccttattcgttcattacaaacgaatgaacaaatgtgctgtaatacaatgtattatgtagtataatgatacaatgtattcatgtatcaaaacaacacaacaaaacaacacataaatatatcaattatgtgtaaatgaaaaataaaattaatagaaaaagaaagagtaaggaatctttgtatcagttggacagaaggcattaaaatgtcatgtgcaatgggatactgggtgaaagagtagagtatttcccaagagctcttcatgtgactagggaattgactataatcacctttttggagtaacactaatccaaatactaacttcttgaatttttgttcaaatagtcaaactgtttttctccattgtattcattttgcgaatatctccccatctagtgagaagtaatgtaatgaatctgctaaatgtcttactaaaatcaagatatgtttgttaataatactgtctttgctactttgtgttctcactgaattaatgatgatcccaaggaatcacagaatagagagaaattggacacagaattctcagaaatagcagtgaaaggtatctcaagaaatgatttgtttcatactgacaaatttaaaaatgttatattactataaaaacaatgactttcatttcaatttatgtatttctttcatgtacttctgacagttctattatatttttagaagtttcaaaatctactttgtattttgaaatattgaatactagaaaattatttggtgatatcttgctttttcagtgatttatgataatcaccaccaattgtttcaattttttttaaacagtagtttactacttaatttatagaattttctctctctctcattttgaaaatcagaaaatcataacatcccttgtcttttgctccccaaattttgttttcggtgattttcattatcttaaatatacttacttacttgttgcataagttaatgggaaatttttgtgaaatgtctttttgtcatgatgaagatgtgggttttgctgagtattaatttttttttgtctgtatagttatcttgaagatacatgaaaggattcagattctgacacctacccataattcttgttttttcaattatgatttccttctgaattttgccttttgaaccctttgttagtttttactaaatgttattgttgcgggaagtcagggaccccaaatggagggaccgactgaagccatgacagaagaacgtggattgtgaagatttcatggacgtttactagttccccaaattaatacttttataatttcttatgcctgtctttactgcaatctctaaacataaattgtgaagatttcatggacacttatcacttccccagtcaatacccttgtgatttcctatgcccgtctttactttaatcttttaatcctgtcagctgaggaagatgtatgtcgcctcaggaccttgtgataattgcattaactgcacaaattgtagagcatgtgtgtttaaacaatatgaaatctgggcaccttaataaaagaacaggataacagcaactgttcagggaataagagagataaccttaaactctgaccgccggtgagctgggtggaacggagccatatttctcttctttcaaaagcaactgggagaaatatcactgaattctttttctcagcaaggaacatccctgggaaagagaatatgcacctggaggtataggcctataaatgccccccccccccaaggtgtgcccatctcttatggttgagactgcaggggtaaaatagaccccagtctcccatagcgctcccaggcttattaggaagaggaaattcctgcctgataaattttggtcagaccagttgctctcaaaaccctgtctcctgataagatgttatcaatgacaatggtgcccaaaacttcattagcaattttaatttcgtcctggtcctgtgatctcgccctgcctccatttgccttgtgatattctattaccttgtaaagtacttgatgtctgtaacccacacctattcgcacacttcctcccctttgaaaatccctaataaaaacttgctggtttttgcggcttgtgaggcatcacggaacctacagacatgtgatgtctcccctggacgcccagctttaaaatttccctcttttgtacgctgtccctttatttctcaagccagctgacgcttaaggaaaatagaaaagaacctacgtgaatatcagggcaggttccccgatatgttatattcatttttttgcttccatgcccatccttcaaatgtatttactctaatttaagatgaacttctcaaaaagttctgcttttttgtttgctctttaacatttatcatgtaacttattttatgaatctcaaatatgtaccttacgcttctgattttgaaagtgatatcacacagtaaataaacatacatgtattatctcaagacttatggaagtttatttttctaaagtttttggcatacagacaactatgtgaagaattgtttttaataatatgaatcataatgatcctttcttctaagaatgctttgcttctacttcaataacctctctttcctttttgctttcaatcaagaccattattttttcttactttctacactactcctgaaatctgaacttttcaacattgcaaaaatatgctttacttttacataaattccaaacattattaaatttcaagaatctgttaaaccacagatgcctgttcaactggaatgttgggggtccctgctttgttaataatgatgcaaaaaggccctgggattctagagtccatttggacattttctgaatggcatctaaaatttcatagagattaaaaaaaaaaaaatcatcgacattaacagcagccctggtgaaacagtttacagaaaatattcaacttatatttcttactttccaccacactaaacaatatgagggcaaatttgtgcgaaaataacattttactctacaacagagcaactacctttaatccttgtctctgctttcccagaaaaatttaaatgtttttattttctcttcctcctttcctccctccacctgccctgccctgctctcttcccgctccctgtgtctaataggaagggcaagcacaatgctgagcacttgggacgtttttactttgcacttaacgttggcccttcaaaacgttaaaaaaataaaagtgcctagggtatgtctgaaaagatcctcatcaaatttttcccctcctggcctctggctatagtgtgcaattctttcagctttggtattttcctttcgctattacctgctgagggtccctttatgctaaccacctctaataaggctagagaaaaattaaatgtaaacctgatttttattaatgtcctaagtgatccagtcaaatgtacagtcagtactgcattttatattaaaggtccctaaagtataccttcctttgataaaactcaatattcatagcttttaaaatatacatatataataatatcttctatcttgagagaacaattaagaccatgaaatatgtatttttgatgaaataaaaatttctcatttaaataaaaagcttttacttcaaaagttttagaattaaacttaaatatattgtcaaagtattgaaataattcatatttttaatttgacattgccctaaaatttttcaaataggtgttcaagatactttttcaatcactaagatgcattttaacagtgacttctgaagaaaattcaacatattaaaatagagataaggaagagtaactataatttgcataaaatgatatctccaaactataaaaagatggaaaaatacaagataatcacatgaatttatagcccccaaattagccacgattacatttcatttacattattcttatatactttttcttgtattccagatgagagaggaattaataagtagatgtattatttgtatgcttctgaagttattttaaaatataattattaaatagattgaatagtattacaaaatccaaacataacacagaatgttttaatgagagttttgattttaaaatgtgtttgcaataaaattaaatcatacttgtttcagtagatattttttaaaagcttacattcaaaataagaaaatgaaaccactggtgaaactttctgataaggacttttaagcctatgttaaagtaattcaaattttgaaagaatttataatgtattttaaagcatttctacttttttcttgtgatattataactgcattcatgaaccacacttctttacaatgaatgacaatttttacttagaatatgaataatctattttatatttgcaacatgtctttattatgttatatataaatatatgtctacattatttatcatactcacaacatgtctttatatgtttttattataattgcatgtgggtgtgaatctgatttgaaacagtgatgttatcgtaaattctctagtagaataaacatcattcggattgatgactgtttctaggcaaacaattacagaagagtaaacagatttttgtcttttggttaaatgcatattaaccaatcacttttaaatttgtaacagtgaagaattgctaaacccgtgaacatcacaaactgaatggtcacaatatgcttgttggtaatgatctcgctatgataatcacatcagccaggcacttggaacattttcttctattttttctttaaatgcactagccactgttattgtaattgttcttgcaaattctatttagttgtaaattttcagtagatggatactattgtgagtgacctaaatgaactagtagcaatgacttgaaaagacattagttgcatgggataacatatgctatcaagtgtcagaaaaatgtaaattccagtgttcacttttgcagtggatttgtatattaattggggctgtcattcatgtgccattatatctcagcaaattcatctttaaatcatgttactagaggtaagtcttaattgttgcaggccacagtttcaataaccataagagagaatagaatagattaaaaacatgaatctaaccatgaggcatgtatgtagtaactactgtttttaatacgttttttgtttatgtgtctacagtttaatttactttgaagtaactataaaattattgcttttaaatgagttggtagattacttgaaatatttttagtgagtactttatcaataggttaagtttttcaaaaaaataaaaattactttaagaagagataagacaatcaaatgtgactacttcattttcagctgctaattgatttttaatctgtgaaagattttaattcattgaaaatggcttttattataataatttacaccaggtaattttctaagaatagaataatcaacacctgtatgcccatcacccatatttaactcatcttagtattgtttcatgttgctgaaatatttttaaggaaaacacacaaaacatatttgatctgtcatatatatatatgagatgtcataaatatgtatgcacacacatatatgtacacacatttcatacacatatatgtacacatatttacacatatatgtacacacatttcatacacatatatatgtatgaaactcctatgcatgcattcaattaattatcctccattcctctctaccaggagaaaattactactcttaagatgctatgtatttttcaaaatatgttttaatacttcactaaatatgagttacatatcacattattctgagacttattttttcagtcaatcatacattttaataaatatttaagtgatatacttttatataatttattcacagtaagtaatgtatagatgcttatgattaagttgcattgcatttgttttgttttctaatgtttaccaatataaagatattggaaaggcatcaccttgttcatatatccttgctgacagtgctggatgttgccatggaattgggtttcgtgatgttaattacaatagatctaagaatgcatagactattggatatgcttgacaattagatgcaaaatgagcaaataaacatataaatcagagaaacagagtggacatcagtggactgattcacagatatctatggcagaggctaactgatgacggggttttagaaatgaaatatataaacagtctacttacggtgctgcctcatgtatatagaatgaaatgtatagttctggaggacagagacataattcagtttggctttgtagggattctctgcctctttcacaattccaaaacctaagttatgtcacagactcagtcactcgaaggtcaggttttgcctccttaagaggaatctttaatagagtcacaggtattttgtgtatctttttgaagacttcctcagaggtatctgaggctatttaccagtatgactgttctatggtgaaagaaagatattcagacattttaggagttgctgaatactggttctgaaagtatacttatctctgcaatgctactgatccaccagtagaaatataagattattgaggtcagttcaggtgaggccacaaatacatcttctctttgattttgtttttttttacccacaattcttgaatatacagtgtagttgatatatttagtaataggacaatttttacattggggtaagagctattatggaggaaaatccaattggaagatcttgtcatgcccctttagaccaatggagattttaaagtgacagcaattctctattcctgtggtacttgtagtgattggtgtccccttgaaaggactgaaagttgcaggggtggtgattccaaacatccctacttacctcaccagattggacaatgcaaaagctagaaagggcacagaaaataagatgaatgatagaatattgttggaaaattaaacaggatctgatgcaaatttcaccaattctaaaggttggatctctatgaagatagataaacagagctcctggtacctgagtccagctatgacatagaaaattaattattttgtgttctaattagtgaagctccacttgaatttgtcagaatgtctttttaaagatattttgaaagacctaaataaatagatatcaatttttcttaaattggcctacccattcaatgaaattccaatcaaaattgcttgtttgaatgtatatttatatagaataaagttgattttaacagaagaaattgccaaaatatctaaagctgcctgaagattaaatagccctactagtattgagatatttcaaagggaagtaattaagatgtatgacactagcacatggatgagtaactgaactaaagcaacagaacagcaatagagaaatagacatatccatatgtggaaacgtgatctgcaaccaagaaggcactacagatcagtgagtgaaagatgaacttaatatgtagcagacatggcttatttatataaaaaaataagaatctgagtttattttttaagtgtgcaaagaatgagataagaatactttacacccatactcatacttatacatacaatatacctgatgcatctacatataaagaacataatcttaattattttaaaaggaaatatagggaaaaaatcctttcatcctagtgtaaagaaaagttaaataagatgaaacttgcaaaccatatactaaataataaattaattcaagtatattaaaattaagttttagtacatataacttataaaggtgaagtgtctatttcaatcagaacttatattcaataaatacaactaacaaagatattttaaaaatcatatataaggattcttacaaagccataagaagaaaaaacattaaagagcagatgctgactcagcaagatggcagaataggaatagctcaggtctgcagctcccagagagacgaacgcagaaggcaggtgatttctgcatttccaactgaggtacccagttcatctccctggtactggttagacagtgggtacagcccacggagggcaagcagatgcagggtggggcactgcctcacctgggaagtgcaaggggtcaggggcctccctcccctaaccaagggaagcccagagggaccttgctgtgagggatggtgctatctggcacagatactatgcttttctcatggtcattgaaacccacagaccaggagtttccctcaggtgcctacaccacaagggcactgggtttcaagcaaaaaactgggtggccgtttgggcagacattgagctagctgcaggagttgttgttttttttttttttttttcgtatcccagtggcacctgaaacaccagcaagagagaacccttcactccgatggaaaggggtctgaagccagggagccaagtggtcttgctcagcagatcccacccccacagagcccagcaacctaagatccactggcttgaaattctcactgccaccacaacagtctgaagtccacctgggatgctggagtttagttgagggaggggcgtctgccattattgaggtttgagtagggagttttcccctcacagtgtgaacaaagccgccaggaagttcagactggtggaggggggggccaccacagtgcctcaaagctgccgtagacagaccgcctctctagatacctcctctctgggcagggcatctctgaaagaaaggcagcagccccactcaggggcttatagataaaactcccatctccctgggacagagcacctgagggaaggggcggctgttggcacagcttgagcagacttaaacattcctgcttgccagctctgaagagagcagtggatcacccagtacagtgctcaagctctgctaagggacagactgcctcaagtgggtccagggctcccatatctcctgactgggagacaactcccagcagcggtcgacagacacctcatacaggagagctctggttggcctctggcaggtgcttctctgggatgaagttccagaggaaggagcaggcaacaatatttgcctttctgcagcctccactggtgatacccaggcaaacagggtccgcagtggacctccagcaaactccagcagacctgcagaagagggcctgactgttagaaggatatctaacagacagaaagcaatagcatcaacatcaacagaaaagacgaacacgtgaaaactccctccgaaggttaccaacagcaaagaccaaaggtagacaaatccacaaagatgaggaaaaatcagtgcaaaaaggctgaaaattttaaaaaccagaatgcctcttcttctccaaaggatgaaaatttctcaccagcaagggaacaaaactggatggagaatgagtttgacgaattgacaaaagtaggctttagaaggtgggtaataacaaactcctctgagcgaaaaaagcatgttctaacccaatgcaaggaagctaagaaccttgataaaatgttagaggaattgctaactagaataaccagtttagagaagaacataaatgacctgatggagctgaaagccacagcacaagaactttgtgaagcacacacaagtatcaatagctgaatagattaagtggaagaaaggatatcagagattgaagatcaacttagtgaaataaagcaagaagacaagattagagaaaaaagaatgaaaaggaacaaacaaagtctccaagaaatatgggactatgtgaaaagactaaacctacatttgattggtgtacctgaaagtgacagggagaatggaaccaaattggaaaacacacttcaggatatcatctaggagaacttccccacctagcaagtcaggccaacattcaaattcaggaaatacagagaacaccacaaagatactcctcgagaaaagcaaccccaaggcacataatcgtcatgttcaccaaggctgaaatgaaggaaaaaatgttaagggcagccagagagaaaggttgggttatctacaaagggagcccatcagactaacagcggatctttctgcagaaaacccacaagccagaagacagtgtggaccaatattcacattcttaaagaaaagaattttcaacccagaatttcatatccagccaaactgagattcacaagtgaaggagaaataaaatccattacagccaagaaaatgctgggggattttgtcaccaccaagcctgccttacaacggctcctgaaggaggcattaaacatgaaaggaaaaatgggtaccagcctctgccaaaacaagccaaaatgtaaagaccattgacactacgaagaaactgcatcaactaatgggcaaaataaccagctagcatcataatgacaggatcaaattaaacacataacaaaattaactttaaatgtaaatgggctaaatgccccagttaaaaggcacagactggcaaattgtataaagagtcaagaaccatcagtgtgctgtattcaggagatgcatctcgtatgcaaagacacatataagctcaaaataaagggatggaagaatatttaccaacaaatggaaatcaaaaataaaagaaatcaggtgttacaatcctagtctctgacaaaacagacattaaccaacaaaaatcaaaaagacaaagaagggcattacataacggtaaagggatcaaggcaacaagaagagctaactatcccaaatatatatgcatacaatacaggagcacccagattaataaagcaagtacttagagatctacaaagagacttagactccaacacaataatagtgagagactttaacaccccactgtcaatattagacagatcgatgagacagaaaattaacaaggacattcaggacttgaacgcaactctggaccaagtggacctaatagacatctacagaactctcgaccccaaatcaacagaataaacattcttcttagcaccacatagcacttattctaaaatcgaccacataattgaaagtaaaacactcctcagcaaatgcaaaagaatggaaatcataacagtctctcagaccacagtgcaacaaactagaactcaggattaagaaactcactcaaaacgacacaactacatggaaactgaatgacctcctcctgaatgactactgggtaaataacaaaatcaggcaagagaaagaaataaagggtattcaaataggaagagagaaagtcaggttatctctgtttgcaaatgacaggattgtatatttagaaaacctcatcgtctcagcccaaaaactccttaagctgatgagcaacttcagcaaaatctcaggatactaaatccatgtgcaaaagtcacaagcattcctattataatagacattaatagacaaacattaatagacagagaaccaaatcatgagtaaactctcattcataattgctaaaaagagaataaaatacctaggaatacaacttacaagtgattgatgaacctcttcaaggggaactacaaatctctgctcaaggaaataagaaaggacacaaaaaaatgaaaaaaattccacgctcatggataggaagaatcaatattgtgaaaatggccacaccgcccaaagtaatttacagattcagtgctattcccatcaagctaccattgactctcttcacattattagaaaaaaaaactactttaaatttcgtatggaaccaaaaaagagcccatatacccaagacaatcctaagcaaaggatcaaagctggaggcacaatgctacctgacttcaaactatactataaggatacagtaaccaaaacagcatggtgctggtaccgaaacagatatatagaccaatggaacagaacagaagcctcagaaataacatcacacatctacaaccatctgatctttgacaaagctgacaaaaacaagcaatggggaaaggattccctatttaataaatagtgttgggaaaactggttagccatatgcagaactctgaaaatggaccccttccttacacattatacaaaaattaactcaagatggattaaagattaaaacgtaagatctaaactcataaaaactctagaagaaaacctaggcaatatcattcaggacataggcaggggcaaagacttcatgactaaaacaccaaaagcaatggcaacaaaagccaaaattggcaaatgggatcgaattaaactaaagagcttctgcacagcaaaagaaactatcatcagagtgagcaggcaacctgcagaatgggagaaaattttgcaatatatccatctgggaaatggctaatatacagaatccacaaggaacttaaacaaatttacaagaaaaaaacaaacaatcccatcaaaaagtgggcaaaggatatgaacacacacttttcaaaagaagacatttatgcaggcaacaaatatatgaaaaaaagctcatcatcactggtcattagagaaatacaaatcaaaaccacaatgagatgccatctcatgccagttagaatggcgatcattaaaaagtcaggaaacaacagatgctagagagatgcggagaaaatgtggagaaataggaatgcttttacactgttggtgggagtgtaaattagttcaaccattgtggaagacagtgtggtgattcctcaaggatctagaactagaaataccatttgagccagtaatataattactgggcatatacccaaaggattataaatcattctactataaagacacatgcacacgcatgtttattgcagcactattaacaatagctaagacttggaaccaaccaaaatgcccatcaatgttatactggaaaaaaaaaatgtgacacatatacaccatgaaatactatgagctataaaaaagaatgagttcctgttctttgcagggacatggatgaagctggaaaccatcattctttgcaaactaacacaagaacagaaaaccaaccactgcatgttctctcttataagtgggagttgcccaatgagaacacatggacacagggaggggaacatcacatactggggcctgtcaggggttggggggcaaggggagggatagcattaggagaaatacctatgtagttgagtatatatatatatatatatataggcagatgccataattaggcatttctaaaaaggcaaaattaatcatctcaaaatgtacataaaattgttaaacttcatattattataagaatgcagggagactacaataagatataactttacacacagcctaaaatggaacattctgaaaatgccaataaaaacatttattccctgctaataatacaaaaattgtatttttcaaaagaaatgagaaaaatataaatgtgatttagcaaatgtgaccatgtttacccaatggttcaacaattctacttctatgtatgtaacctcggacatactagtacttgtgtatttagagaaatatttgaaaactttaatatcattgtaggtaagacaaaagaagcaaatagtccaaatatctataaccagtagaatgataaatgttggtatatatttaatattaaatattgtataaaagttaaaaatgagcaacagatacatgcatcaacaggaattacaaaatattatgttcaacaacaatttcgggagactctacacaatattgttttgcttataataacatggaaactaaggagcattttgctcaggcacacatacaaatagcactataaactaacagtaagattggtaaataaaaatttgagatttttgacataagtgattggatgggacaaatgaggatgtgctggtacaagcacaaatgtatcagtggtgatcagctgccttagttacataatgagcacatgtgtgctcactttcttgttgaattacacacatcaaataattaatttaataaaaagtagcttctcacctgtttgtcagatccacacatgttccattatttttgcaaggttcagaggaacattcattaatttcaatttcacacagagatccagaaaacccaggtctgcaaatacaccttttaaacaaaaaatttagtaactccattagtatatatgtataaaatcaatgcttcaactaattgtagcatggcaagtttttaataattataattgttgcttaattcaccaattaaaattctatacctgtatacatctagacacataaacatgtatctagatactttttaagttttctgtacctgaaattgttgaccatatcttcacagtcaccataatcctggcaggaaaggaagaggcagtctttcacatcaatttcacagtttttaccttcaaattctgcaaagagtatgagatgagtatggatgagcaatccttgttatagagtaaaaaaatcagaatcagtggtagtctaaagaatacactcataatggaggttaaaaaaggaaaaagaaaataattactctcaagcttctcataaaactccatttcacataatgtgtgcataaaaacatgccagtttctagattaatgagtttaaatgaaatattcaagggaggaatactccactaaatcccctgagaaggtagagatgttgctaatgttgctgttgttttaaggtatttaaatgtttgaacaagaagaattgaaatgatctggaaagcaaatgaattaatgtgatgaccaatcttaaagtaaaattgagcttcaatgatcaaatttattcaaggcagttagcagatgaagcaaattatttaattgctttttatatccaagtgattcaaagaaaacaaattattttgattcacagctacataatcagtcatccatttaaacacatgccagttatattaaaaaaaatgaacatgaaagaaaattatacaggctgataaacaagacagttgcaattatttcaacacatttgtgtcagaaaaaacctgcatgatatcactttttaaaatacaatgaaatatattaatatttataataaacagttaaacaattctatggttatatattaactaagtataacaaaatatatgtgtaaaaccatttttcttgttaatattttttctgtactagttcaaacatgtaagaaacaagatttccctttattttgctttttcagtgatattaccaagcactaaataagtgcagccacattacacaatattctaaatgtcagtatgcaatcaggctaatttagtttgaggaacaaagagtcattcaggttactttaagaaaactgtattcattgtttgcatacacatagactggaattggaactaagaagcatttaaagggaagcatagtctagctacccaggaatagctgtcttccttttacagtacatgtcctttatccttctcatatcactttttcttctctttctatcacaaatatctcagcatgttcagtttcaaatcacttgtaatgttggcatgcgagtgatatagcacagctttcttggtctctatgtctatattatgacatttcagcttcagcacctactgttcaatgaaaaattccctcggtattttctcactcagattcccacgatagaacacggaattgactgacctatttcatcttttcatatcataccatgccacagtcaatgccattctctgtggtgtctaccattggatcaaactgcaaacctgcctcccgttgcaatttaacagggagcttggtgttacaccttataaaatctggctgcctcttcggtagtatataatatggaaaactaaaagttacttaatccaaaagaaaacagaaaaagaaacaaagtacagatacaacaaatagaaaacaaatagctagaaggtgtatttacagccacacatatcaaaagttatattaaatatgatttttaaaaacgccaatttaaaggtagaggcagactaaataacagaagaaactacaagatatctaaaagaaatttatttaaaacataacaacaatgataggttaacatttaaaagatggaatgatcacacactatgaaacactaattgtaagtaagctgccatacttatggggctagcagaccaggtagtcttcaggacaagcaatatttttaatttgccttatttttcttactcaattctcagagcctgcaaatgaatctctgaagttacatttttgtaattcgttcatacgctaggtgttgtatcctcagctttaggaacaaaattaaaatgaattacttccaagttattatggctctcctcattttaggtgagcaagttgtaattgttccaacatgcttcatcattcttcaatcgccattgctgttttctatatttaggttgtaaatgccatagtacagatataaacaacttagattctattttcaaaagatgtttaattctttaagtatttgattgaggttagatttttcacaagttaaaaattgagaaagttgagtgtatttcaccatttctactttaagtctggttagttttctctgggaggcagggcattttgacactaaaatgattcttagaaatgttcttttgaggcagtggaactcaggggcactgactggctataaagaagcaccagtgagcctccatgatttcagctgtgctgatgaatcagaacactcagggcccaggaccttgggtagctcacaggataaccttgtttcctgtgattttgtcatatttattaagtttgacatttctgagatggagttttgttaccagctagcaacatatgtcaatgggttgaggaaatgagattgccgaaatgcagcagacattgggagaaaacataacatgtggattgcattcaatataaagcaaagctttgctgagatagcctatgttttgggaattttaagagcgaagtatgcatacagtcacgtgctgcataacaacattttggtcaatgacagaccacatttctaataacaatgatctataaatattataatggacctataaatgcagtaggctatctcatctaggtttgtgttagggcactctatgttgttcacacaacaaaattgcctagtgatatatttcttaggatatatccccatttttaagcaatacatgactgtatacttaatcccaaactacatattctataatccttaatgttagaagttgatattcatttctgtgaaaggtacttgttttgaatatatgaagttacaggtaagaaactgcccaaacagaaagtttgttattactaattttatgctgttcccctgttctttattcctactcagaactattcggttggccgtactttgttaactgcagggaggatctttacatgcataaaagtgaagcttcttaaatggatactgtcttgatccttttcttacactgtctcgtctgtgtatggctataacaaatacacacgaatggtcagtaaatgatatttttatacttctgcactcgttcctccaaaatacacaaaattgatttttaaaacctactgctcaaatgtaagatctgcatcagtctggattgtaggtattattttttaaaatcacttagtattttctcttttctaacaaattcagcctttttgcactttattgctctagaaggtaatgtatggaacagagtacaataatgaaattttcataaaaatcattttacatagcattttatcattcaggactatattttaacaatctccacttcatatttggtattagttggaataatttgaaatgaatgtaaatagggaaaaaaactagtgtataccatagcatgaattcacacaaggtagttaaaaatcatatatttttaaataaaaactcaaacacttaaaaatgtttttctttcaaaagtattaaatgtattatttctatttattcttaattaaataatctaatttctctggatttaaaagcttgataaaaagaaaacaaaaaaacacctcagaagtttttcttagcaagtcagattttttaaaaaaatattattttatttaaaaatatttgtattcaaatattaacattttctaaaataattaaccaatataagaaattctttaaatttaactttaaaaactatgaaatatgaatatacagaattaatatttccaatagtctctaataagatttttaacatctatttttaaagtgaacttaaaaaaaagaagagctaatattttagaaagtaataaatatttaacatgttttatgtttaattatgtatgtattttctttaaggaattttctaaattcaaatttctacagctattaaccttaacaggtatgtgctacaacatgggtacatgtttttaattgtcaacaggagtaatttctaatttatacaaactattttgtcaaatgacacatttatttggtgtttgtacttgtataccttaggtaatgtggaattaacataatgatagtatatatactggagtaatagacacatttaaatgcaactacttgtctcccatgatactgcaattccatcaagcgtaggatcccaattgtaaatcaatagcacatgtaaatgatctgattctgctctcactgcagctccttgtgaggcatctttgccacattttaatcctgtcatttaaagaaacttctgttcctttcaccttgaagacatacaaagtagctattttagaaactaagctctttacattaaattaagaagtatttgatagggtaattttttgcctataaactgagaaagtggagtaattcaaagtagaaagataaagaaccattcataaaaagaacattagaaaagaaattatttaattcttgacatgtatttctaggctagacacacacatggtaacataataattctactctatgctacaaacacacacattctcatgcattttatttgaagtcgtctttaccttcttaatcttcatgtggttttgtggtatttattattattattttttattattagagacaaggtcctgctctgttgcctaagctgaaatgcagtggtgtgatcatagctcactgtaaccttaaactcctttgctctagtgatccctcctgctttagcctcctgaacagttaggactgcaggcatgaaccaccacgcactgctaattttttttaaatttttttgtagagatattatgttgaccaagctggtctggagctattggcctcaagcaatcctcctgccttagtctcccaaagtgctgtgattacaagtgtgagctattgtgcctggccctcaagtgatatattttatatttgatttctaccagcttgaagttgaaaccagtttattcaacctttcccacttaattaactctttgccttcactatatgttttagccattactctaatggccataaacatatgaataaaaacatgaacttagttaagaagtgagatatattggtaacccagctgagagggataccagacagttcacaaaattgaagaaagaactgtaagttctgccaggattccttccccaaacacttctatcctactatatacagatcatctccacatgaagagaacatggtagttgactgtactgattgaaaacatctggcagaaagagaaggcctcttctctcagcatcaactctaaagaaggggtctgaatgccaatattccactcacatgcatgcccagacataggtaaatcatagttaccatggggatggaatttactatgtgtcttagcttgggttgttccaaaaataaaataaaaaaaaaagtctgagataatgattttctcacaagtagtttatttgagaggtgatcccagatcccaggaattattgcaagggagtggaaaataaagcagggaagagagtggtttaatgagcacataattgtgggcaactgaggcttcatatgctggagactctcttataaatcatgcgaaacataactaaaagttgtcaacagaaatgagaaagcagtgctatgtatccacaacttgtcatcccttgtgcatatttctggcataaatgtggaagtgatgcaggatttttctcagcccgtttggcagactcgtgggagaggtgccccatctacttggtctattatgctcaagcttttgggggagagagcacatatgccagcaagtgcaggacctggctggccactccagatgccgaaacaggagcaagctccacacgggcccccagcctgaccaggtgtgttgccttggcgggaacatggtggaacccaggtgagggtgcctgtgacactgaagccccagaggggattttacagtgctcctttagttccaccattcacagacagcagtgtgttagcagctcagttggtgccttgcctcgtcacatggggtggctgccctttgccagggagggcaaagggctggttggacggcctttctgggtacccacactcagtgggtcccaagctcttgtccagtgtccaagaagaatgaggtcatgcagatgattgaagggtggtgaaggtggagaattttattgagtgatgaaaacaagtctcagaggagaggggagctggagagggtacaggaaggacaggtcgtcttcctgtacaacctgaagtcaggctgtctcttcccgaaagtcaggccatctcatcttctactgactgagtctggggtttctatagacacaggatggggagtgcttgctgattggtttgtgagtgtgcaaaagttaaagtgaagacaagactcaaaggtgggtacaacagtgtggaaaaccaattaggaaagggcaggtatatgtaaaataggtgaagggtggggatcaatcagaggaaagcgcaccaaacaggaagacaagttctcaatcctgtctgagaatttaacttatagcttggctttcaagctttaaactggcattggcttggaggtgatgtttcaccgggtacccacccttatctgtctaggcatttggctgcctcctgtcactatcaaaagcttttaccgcattgtactttaatggttaattaactggtatgtctctcccttaaactttcaattccttgagggcatatcttcaccatgtttaatttttccagaacctatctcaagacttgacacatcataggaaatcagtatgtttgttgaatcagttaatatttttaaaatttctagaacactaacaacaagcagttacaagatagatatgtatttgtgtatggagtacagtttatagaggcaaaaaaagttggttacaataaaataaatttctaggtgtgtaaattcattacatactaaataatcaaagctaacactattgaggtgtcaaaaataaaacccatttgtttatagaaatctcataaaatgtgccttcctatgtgttatttttctatttattaaagctaatttcttacagatattgtgcctattttcttacagatattgtgccaaactaataagattttatataaaataaccatattgaattattactgtcacatgctcttttgcctcctcattttcctgtagaaaatgttcattattcatagagacccaattaatcaccgcagttttagtcagaagacagaagctttgccctttatttatctcacaaagcaggatcacaatagttctggtgcttaactataccgataattttttaagtagcttactttgctaaaaggattagattatttttactatatatatattttttactatgtatatatttttactatatatttcaatcacactaaccaaaatagcttacctgctaagcatgcagtctgacgtaaacccaaaagtatcagttattctacttgctggtccttcagagtgaatttgaatgtcatttctaatatagttttctaacatacagtcgcattgttactctggctgaaattttacctatactcatatttatctagtgagagaccctacagactgactaaaaactgtgaaaacaagttcagaaatacatacgctgaatccttagcctaaagccttaaatttctactcttacgacctgtcctattttagtcaattgacaaacaccaacaacttacaaagagatccagtggagcttccaaatcatatctgtagatgttaagtcttggaattctttgtagttctaaatgttgatacttgtgagaattaaatttgataaaatgttttcttttaaaaacaatatactggctttgacatagaacctattttaaataaagctattaaagtaacccagtcaaagcttctaaaatgttgcatagtcaacttttgaattttctgaggtggtttttaaaagcaatgttacagcctttaatttttcatctgctacagaacttaaaactactaaagacacgttattacagtattcagatctgatttacagaaacatactccacaattaggtttagaaaaacatagatgcaaattagttaaaaaatgatgtgcatttcaagtatctctttgtactgaatcacaatcacaaaggaataaacacataattcactgtgtttacctgccactctagccaaagctctgatttggcttacgtacaataataaaatactaaggggaaataagattacatttatttaataatagtgaaatctaaattctccccatgacatctttgtcaatgttcaatgggacagcagatatcattactagttcaatatatgactagagggttttaaaatgtttccaaactttctttccctaaacccgtagcaggaaagaaatatcactatattttataaatttattaaatgcacttataaatagcaaaagaatttttaaaatattaaggtttgaaaacaatgcccactttgcagaaaattatctctggtgaaaacaaaggaagtttgtctaaagtgaataaatatactatggcctcctcaataaatatttatattctgagattttttttctattttacttagcctacttatactctcagaaataataatatgtttcttacattcttagacatgtaagtaggctaagtaaaatattctacgtagtagaatgtttagaattgttctagtaaataaattagcttcactgatattgaataattttcaacaagtttcactctcagtgcttgctaaaaggaaaactatttacttgtttgaattatgttcttcataattactaaatttttctgggcatcaaatgctccccttgtattttttcgtttttttcttctctatcttgtttttcctgtctcattcttgaaaatattctctcatatgctctataaagcccatgctatttttgcaaaatcaattactgatggctttctagcttttagttttaatccttcagaaggcccagaagtttctgtcacgtatacaggttcaagaacttgcttcaatatccttaaaaaacattaacatcttaaggaagttttaatgcaaaacaaatggaaatagctttgaataagatgtctgtttaactaatgtcatctaagctgacttttttgaacagaagagtaaataagtgatatccttattattaagagactcccttaagggccagtgagaggcaggaaaacatgaaaccacagtgagtattagaaaataaattgcagttttgggcctccaaacacaatgtgttttttatattatgcttatgacacatctagttattctgaaaaccggccatgtgttttggagcagaagcatttccactgaagatggtaattgcttatgagtagccattgatacatgaacagtgaacatgtacctaaaccactgtgcattaataagactttcttcgcttgcatatgaagagaccccaatcaagaaagtttaatgatataagcagagttattggctgatatgacccagaaagccagaaatatcctggcttcagatacggctggatccaggagctccaatagtattttttgaactgctcattctttcttgcataggatttctctcttgagacaaagtagccaccaaagttatgtgattgtaactaaacaatctaagtagaaagaagtaatattttgatagctccagaagaaaatgtacaatagggcatttcattacccccaattatacctatgcccatctctaactaactgctattgtcatgaacactacatgaacaggattgttcagaaaagagaaactgttattaaaggagagacaacttctgaaagaaaaaaaaagggccaaaaagctataaagcttcactcttttccctcttcccaatggttaattcttagattaactcctttggtgcatttctctaatacatttttataactggatttgaagttagatagtcccctacccacaatgtacataggatttttccaacccattttaggaggccatcatcccataggcacaataaatacacaaactaattaagtaattatttaaaaacaataaaatccatattagctcttaccttctctacaaatacaatgctgatttgcgtctaccaaagctaagcatgttgagttgtttctgcaagggttatgaagtaggtcacaaaggttatagcgttggtggcaaaattgtccagtataaaggggtgggcacagacatacaaattgtccagggatggtagattcatgacaaagacctccattcatgcatggatcagagtcgcattcatttatttcttcactacagttctgtccagtccatccagatgtacactcacatctgaaataaaatattaaaatttttagaagtgtgaactctttttcaagtttattttttgtatttttaattactcccttgaactaatagtatgtggtgcttttaaatttataacaggactaataaataatacatagttttaaaatattgtttgcctaatttcctgtgacagtataatatatattaccataaaacttaccaccttggctgaaataagattttaaaagcattaacaaatttctaacatagttaggcctctgagacatgtcagagaacaactattgacctaaatcaccaattgagcaaaattttcctatgaattatttaatataagttttacagatgagatcactatttataagccttaaatgctatttaattcagcgtccttagcaatatgtgaaattcttgtcatcaccagagtatataacaaggtgttactttatgttaagcatctgtttttggctttgtgtgtgtgttgaatcacttgaaatgcatttttaaaaatatattttcttttttaaaaattttagattcagggcttacatgtgcaggtttgtaacacagatacattgcataatgctgtagtttgggcttttgttgaacccattgcccaaatagtgaacacagaacccaataaatagattttcaacccctacctttctccttccctgctcacttttggagttctcagcctctattgtttccatctttatgtccatgtatacccattgtttagcttccacttgcaagtgagaaaatatgatattagattttctgtttctgcattaattcactaaggataatagcctctagctgcatccatattgctgcaaaggacatgatttaattcttttcatggttttgtaggattccacagtgtatatgcatcacatattctttatccagtccaccgttgatagacagctacgttggttccatgattttgctcttgtgaatagcactatgataaacatatgagtgaagttgtctttttggtagaatgacttctttttatttgggtggatgctcattagtgggatttttgggtcaaatggtagttctatttttagttctttgagaaatctccataatgctttctgtgggctgaactaaattcgtattaatatttgaataatgtgcgataattgaagggaaagcaaacaaataaaaaataaagcatttggaagttatctgtgtatcacaggcttctagctcagtctagtcctccatccagtatctgtcattatcttcaaataccactttggctagtcatcatccatgaaacgaggctagtctgccgtgaagagaaaaattctagcagacaggagggggaaagtgttttacacacaaaattctagcagacaggagggggaaagggttttacacacaaagtgtccatttgagggaaatggaaaggttatagtgaagcctgcagatagagagtaaatgcaaatagagagatagagaggtagtccatcagctgggtaagtggaaaacaatcacaaactgtaggtgtgttcaaggagagaacttgtgtcaatttgtgggcaaggtagatttccaaatcttgagcaactttactattatgcaagttatgaatcatgaaacaagcacaggaaatattagaacaattattttcaaaaagtgtatttactgatagattagatttttaagataacttgaaaaaagtcatagtgctgaaataatgtaacttactttgtgatacagaatatcttactaaaaggaggggagcaaagaggaaggaaagaaggaagaaacaaagaaaagagtcacctaatttgcagtttcaaagccccagatatatcaaggccctttataattataaatacataggataccaatatattggaggagataattgaacaaatgacttgcaacaacatctataattgaattctaaatcgatatagttaccattaaaataaaaaccaaaatgaataattggcaaaatggtattagacataattgactaataaagtgtttactagttcaataagtttaaatccaatgcattgtaagccagtggatttcacagctgtctaaatttttttttaattggctgtgggtagaaagtaattgctatcatgataattgcacatttctttgtgaagcatgctagcacaagacaaaatttatgactgaaacaattcataccttcacaatataaaaaatatatacctaagggtatgttatttacttaatattttattttcttctcaaaatcaaaatgctctaattattttggtgactttccatcctagtttgcctggagagacttggttcagtttgttgttctgatataattttcagggcatccttttacttataaaagtttctaaggtgctttttttaaaaatctttatctcctatatcccattactgaaattgagtatctaaaaaacaaaacaaaacaaacaactatacacttacctatttactaatcctacaaattatttcactttgctctaaaatttgcttgccatacactttaggaactcatcatatatactatcttgtgttaaaatcatttgcatggtttgcctccaccattaaacttctggttcctgaatgtctaagaatgatctgaatctccacattatcatgtcaacacaataaatgttgacaatactataagaattgatataaggtcctcagtgttgaaacagatcaacttatctgcactctttcatttaggaagttgaggatcagagagtttaatgaaattggtaatctcagagaattgttgtaaagattacatgacatgatgaataaaaagtatatatagtgcctggaatctgcattgcctggccacctacactgtttactagatgctgtcacagaagttttaagaatacattttctgacctatgagcctaaatacaatgtgtatctcagcaatgaatatttctttagcttttagtagtacttctttttaatgtttgatcatcacatcacattttaaaattgtcaaatatattatccaatttgatactttcaataaagctttgaaatatgtagaagagatattctttttctcactttacagatgagataggtggaagttcaaaggataacagtgatgtatcctaagtcatgtggttaagcaaatggaacttagaatccagatctcctcctctcaagttcctgtttttcttttcttttctttttttaaacatgctttaaatctagtatcatttctttaaacattttgtgaaataatgttaaaattgggtattacccagtcttaagagaacttcagtgtatttattttgcttgaaataacatcactgtaaatataactattcagtcatataatgggactcagttaatatactatggcaattttaagaggagaaaagctagagaattaatattttctaaaatcatggttacacaggtcctgagggtattgcacaagtatttatgtttttctctttattgtattctgagtacataatttcaacttggttaatttaaaagagtttcctaagaaaaaccgacaattcttgcctatttggcatatgtgctgaaggtttgttttatcttctcacataacaggtggcctaagacctcatgtggtgtcattccaaggatccaatcctcaggaaagaatgtggctgtatgtcaagaggactgataatgccaaggctgagttctatggagataacatggatgttttatagaaaataaagttccgaggaacaaagtcactactagtgactaacaatcatacctacaggtttacatatttgaatctgcttccgcacatgtcagagaagctagtgtttgatgggtgggaaaaggaaaacatatttgatgtgagggcttcaatcagattctaagtttgctccatgaaataatttcaggatttagtggaaccaggcagatattttcaaactcacagctagaagcagagtctttatggattaaaaaaaaaatgcaaagcacataccgtgtgactttttgagtgtacaatttctggtagtaaacacttgaaaacaagtaagtgcgtgcctaaagataggttaatacattctaatttgctcttttccctagtgtgagaaaatctaaattcattggtgtaaaatacattgaacacttctaaggacaacttttcaaatcttaaatgctgatttaaagtactaaagctgataatagaaaataaagtagttatcatcgttaaaaagtggaagaaatactactcattaaggtgcgttggctcacgcctgtaatcccagcactttgggagtccgaggcgggtggatcacgaggtcaggaaatcaagaccatcctggtcaatatggtgaaaccctgtctctactaaaaatacaaaaattacccaggcgtggcagcacgcgcctgtagccccagctacgcgggaggctgaagcaggagaattgcttgaacctgggtggcggaggctgcagtgagcagagatcgtgccactgcattccagcctgggtgacagagcgagacttagtctcaaaaaaaaaaaaaacaaaattcactagcttcaaaaatcttaataaatgtcaatttctaatgactaagcattctatatgtttaccttaccataaacatttatttgtaatgacaaaggatcgttcagcaatatgtatctgtgtttgaatatattttgtatattaaggcatataggcttttttggctctaaatttattaatacaaacctaagtgtatatgcagtttaaaagaatattttcttataaaaatcagttcacttctcttagaagcaaacagtaaaatgttgtttatcagctactgggaggtggaggagatcagtggagatgttggtcacaggatacagttagatggaaggaaaaagttcaacaaaccaattgtacatgatcatgactatcattaataacaagatattgtgcacttaaaattttttaagagagattttaagtgctttcttcatgaaaaagataactatgtgaagtaatgcatatgttaattagcttgatttacccatttcaaaatgtatgcatatatcaaaacattatgttatacaacataaatatacacaatttttatgtgttaattttaaaaattagttcattatttcctgcaatcattacatatttgaaacacaaaatttcaaccaaaactgctaggtgaaaaagaaataatgaccgttaataataaaatagtattgttatctttttagtgtcctacaaattggggacataggaaagggaagaattttttttaatgagctaccgaattaaataattcattcattattttattgttttgtctattaacctatttacacccttaggtgtacataccatcaacaaaattatattcataccgaattataacatgaacattactaaactcttaacctctgcaatcttcttcttggaaataaatgtggaaaatcacttagctcatttagacggaaaaatctattgtaaaaaatatttgtaaacattaaaaatagaatacaaaattaaggaccactttgaataacagcctgaaaatgttagtatgtaaaaacatatgagaagattgatatgggtaaaatgaaagtgaggaggtagcctaaaaacagtaatagcaaggcaaagttgctgaggattgtgaaaactactgcaacaacaagaaaagtaaaattaaggaattttgactttacccttgaagatatttaagggttttttgtttgtttgttcgtttgtttgtttctaagcctgggagtaacattgattgttatccagtagatggattaacatagggacagcttggaagcatgaagatcatttaggaagctattgtttcattactgataagagattatgagtactacacaaagggagtaataaagtacatcaaatttgagatatatttctgatgtaggacagagaagatttggataatggttagtaagcagatgaggcagagtgaggagtgaggactcagtgggcttcacattcactattggaaagataatgatgccatcaggtaggagacagatgacaacgatggaaatagaagaaaataagatggcactgatgcttaatatgtaacaacttaaatcaaataaattgcatgatttcagatgctgtcctgcatgtattgaaaattcaaatatggagctctagaaaaaccaaggcatgcaataaaaattcaagtaccattctaacaaataatactaggaataaataaatttaaatttggccttctctgctgaaatataaatttatgaaacatatagaatcctcttcattatgatattctgcagtattttatagaatcttaggtacatatgtagattctttgaaaagaaataggcaggaaagagttctactaggcagattagagtaagcatgtggtcggatagacagtaagcaagatagatagtaagcaaacctttctttctttaatttttatttatttattttgagatggagtctcactctgtcgcccaggctggagtgcagtggcgcgttctcggctcactgcaacttctgctgcccgggttcaagcgattctcctgcctcagcctctcaagtagctgggattacagccctgccatcgcacccggctattttttgtatttttagtagaaacagggtttcaccatgttggtcaggctgggcaaaccttccttttttatgtttttctttttttcttttttttttttttgtgaggctgaagtttatggagtatgtattctaaatgaactcaagaatttctgttttaatattaatagaaaaaggatttcttctatttaggccatcaagcatcatttcatatattttttcaaaaaaataaattcagacatataatttatttatacacataatttataagtcaattatttcaattggaagaattataatctatatttttcatacattttgatgtaaatgaactgtatggataattccttgatataattctcttcaaattatctgtttccaatattctatatgatttaatctcctgtgccatgtaaaaagacaactggtcaataatctttttcagagttatttaattcaagctgctttgtaggtcagtatttctaaaaaacaattcaaggctttttcaagattcagaatattcctcgtttcatagaagaaagctaaaatgccagacaagcagaggcagataatgcattgggtcacgcctccagtatattcatatttaaaatctgaggtaaatctgatggaactcatgctgtattttgaagaatacccaaagttaaatacatttgaatctgggactagaacagcaaagccaaacatatgccgtacagtgagatgccatatagtgagattagtttcattttttttttttgtcattgtggtcataatacagaaaccatgagaatggggtattttaccacttggatgatcagaatttagatttttttgtaagcctacaacaagccctaagacatttatgttgaaagatgaatctttcaacaacatcttgaataaagctgaaagacaacacttgctcaaaaaggctgactacataagatagttgaagctactattctgtaagtttacctgttgagtcaagaaaatgactagtgttataaacatgagtaacatgaacaattatgtgatttagctttgaacataaacctagtttaagttactgtctttaatttcttctattttatttttccttaatggtgtgtgtgtgtaagcggaaaattgatgatgaatcagtttctgagcaagtaagtattacttctggctcctgtttttttccaaaaaggatctttgtagcaagtccaagtaagtctgcttttaaatataatgctttatatattcagaagaattcatagttgcatctttttcaatgcttaaaaatgtatgtaagtatatgtctgcatgtgtatatgcaagtataatatccatacctatacccacacattgtattcaaattatacttgaaaatgcatatataatctttcaaatacagtttaaaatgtataaagatcctatatacctacacatatatttttattctttcaggtacaatttgagtaggaggcagaattttaaatacaaaagcaggatacagagtgttacataagcaaagtactaagatatagaacttaaacaaatttataaacattttacaaaataattcataaatcttcagcatgtcaggtgtttcatatggagaaacattttaaactcccagtttaataagcattacacttgaagtctcagaagaaaatcaactgagctagcaaaagccaaaggatttttatgcatatggaaatattacaagcaatgaggaaacaaaatagtctttgtttttttgttaggactggcattataataaatgctatatctgtttcatactccttaggggtaacatgtattaaaactatatactctaattactaatcacacatacttagttcagactatatgcatataacaccattaattctgaaatgtaacataaattcagttagccgatgtaaaaatatgcaaaaataaacctattgaaaatgaacactaacatatctttccacatacagaattattaacccattattttattaaaatttaaaattatagaacatgtccttccttaaaaatttaaataacactcaaattgtcttattttttaataaaacagatggaactatagaaataaataaggatagcagagataagagagaaatggaaagaaggaaagagaagcaaaataattattttttaaaatgtcactaaagggtcacctgtctcacaggggttatgtggaaagtttattatctatgatcctgcttcttgatgagactcttcctggtacttagtcaagccggagtccaagtgatattcaaaaagcctttaaaattcactaagccagaacttcaaactcatggaaagaaaggataaattcaaagtagaagagatttatctttgtaaagtatgaagtaaagtcaccagtgcctgtgtctctctgaatctaactcaatgtgacaaagaaaattagaaacagaaaataaaacttcatcctcaataaaacagttatcaataatcccaagccaaagcacaaaagaattagatgacaaatattgtgaaaggaccaagataagagcagatatgaagagcaggtaggtgcctgctgctggagtaagccagcagaaagggcacaaaaatagttctcagagtaggaaactgatgaaaaattttaaaaaacaagaacaaaaattaaaaaaaaaaacttgcttgaaatataaggctgggccaattttccatcaaagagtgtttggggtagaagaaaagacactggcagaatttggaatttcagagacatgcaacattgagggcccatgaaggaaaatcagcagtcctgttgctactgttattcactggggtgacgaaaaataaatccattctccctctctcccacctctgtcacacacatacacatgcatatgcatatatgtgttcacacacaagcaattgaaaaaccaatattttcctctgagccagggaagattctgcttgtttctcattgacaaggacattgtgttgactcacacacattcccacaaatactaaggttttgaagaactaaatttaaagataagaaaaacttagaaaggaattagtgcaaaatagactgttgtgtttgtgtgcaaatgtaaatgtaaaaataaatgagtatgaaaagagccagacatcttatataagtattattttaccaagcatattaaaattacagctagataattttaagacaagtataaatattactatacaacaaaatatttaaggagatataaaagactcaggatatatattagttaataaaatgagaggaatcccaatggcagaattccagaaaaaatagaggataaattaaatgccagtattcactggcccttttgtttcctctccatgatagcagtgcaaatgcactgcttctagtctgccatcttgacccaacatccctttaaatgtattttctaactcattccctagcttctagggtgtcctggcatcttagctatggatatcccagtacctgcaggtcacaaggtaacagagactatgacagtcatctgggtctcctggaacggaggacacagagcagtggagatggaccccaagctctaggtggagtaagagacctactttgaattctttatccagcatcccaacatttcattttgtttaggattcaagatccagtattactatgctgatttttttctcatctggagaaacacttcttactcttgtttactttttttggggtgggacttttcttgaggatgtgcctatgatgtatgttgagtaaggccatttggctttgcttctgggtatgtttagtggctgtattagtctgttttcacgctgctgataaagacatactagacacgggggaaaaaaaggtttcattggacttacagctccacatggctaaagaggcctcagaatcatgatgggaggcgaaaggtatgtcttacatggtggtggcaagagaaaaataaggaagaagcaaaaggaaaaacccctgacaaacccatcagatcccatgagacttaatgactatcacgagaatagcacaggaaagacctgcctccatgattcaattacctccccctgggtcccttccataacatgtgggaattctgggatatacaattcaagttgagatttggatggggatatagtcaaaccatatcatttcacccatggcccttccaaatctcatgtcctcacatttcaaaaccaatcatgtgttcctaacagtccctcaaagtcttaactcatttcagcattaactcaaaagtccaaattctcatctgagacaaggcaagtcccttccacctatgtgtctgtaaaatcaaaagcaagatagttatttcctagatacagtgggggtacaggtattgggtaagtacagctgttccaaatgggagaaattggccaaaacaaaggggttacagggcccatgcaagttcaaaatccagcgaggcaatcaaattttaaagctccaaaatgatctcctttgactccatgtctcacatccatgtcacactggtgcaagaggtaagttctcatggtgttgggcagctctgcccctgtggctttgcagggtacagcccccctcctggctgctttcacaggctggcattgtctgtggcttttccaggcacatggtgcaagctgtcagaggatctaccattctggggtctggaggatagtggccctcttctcacagctccactaggtggtgccccagtagggactctgtgtggggactctgaccccacatttcccttccacaatgccctagcagaggttctccatgaggaccccgccccttcagcaaattttgcctgggcatccaggcgattccatacatcttctgaaatctaggcagaggttcccaaacctcagttcttgacttctgtgcccccagaggctcaccaccatgtggaagctgccaaggcttagggcttccaccctctgaagccacagcccaagctgtactttggtcactttcagctatggatggagcatctgggacacagggcaccaagtccctaggctgcacacagtatggtgaccctgggcccagcccacaaaaccattttttgctcctgggactccagggctgtgatgggaggggatgctgtgaaggtctctggcatggcctgcagacattttccccatggtcttcggcattaacattaggctccttgctacttatgcaaatttctgcagccagtttgaatttctccccagaaaaagggttttttcttttctattgcatagtcaggctgcaaattttccaaattattatgctctgcttcccttataaaactgaatgcctttaacagtacccaagtcacctcttgaatgccttgctgcttagaaatttctactgtcagataccctaaatcatcattctcaaattcaaagttccacaaatctctagggcaggggcaaaattccaccagtctctttgctaaaacataacaagagtcaccttttctccagttcccaacaagttcttcatctccatctgagaccactgcagcctggaccttattgtccatatcactatcagcatttggggcaaagccattcaacaagactctaggaagttcaaaacgttcccacattttcctgtcttcttctgagccctccaaactgttccaacctctgactattacccagttccaaagtcacttccacgtttttgggtatcttttcagcagcaccccattctactggtaccatttactgtattagttcattttcatgctgctgataaagatatacccgagactgggaagaaaaagaggcttaattggatttatagttctacatggctgggcaggcctaagaaagaatcatggtgggagatgaaagccacttcttacatggtagtggcaagagaataatgaggaagaagcaaaagcgaaaacccctggtaaacccgtcagatctcatgagacttaatcactatcacaagaatagtgcgggaaagaccagacctcatgattcaattacctccccctgggtccctcccacaatacatgggaattctgggtgatacaattcaagttgagatttggatggggcacaaccaaactctatcagtggaatagactctgtatgatttctttggttatacgtagtcttcatgtggtggcttctcaaatgctcattgtggtagcgatgtgcctggtgtgtcagcaggcccaaggcctcctaatgagcaagggtggtgtgaataatagtggtagcagaggtcatatgaggctaccttcccaaatgctgtgtacttgtgtcagcagatactgaaatgggctatgaagtagatcttaaggccagaaagtggtgcttataggtgagagccagatggcatggtcactagctctctcctgtaagatgttctcaccttgtctagatgatctctcatctacacccaaaggtgtaatctaaatgaagttctcaggttcccaggtggtgggttgggttgtagaacattcagtggtccttgtcccccactttgcctctgaggacagaggcagcatagctgggaactgggccaagcgagcctgcatgtgggcccctaatggtgggtgcaagcaccagccccagtagggttcggagtcagttctcgggtccctagaataacttcccaatgaggagcagaataatcattgctgggcctaagacccaggatggggaatgagagatggctcaggctctacagactagcaagtggtagtgggacctgctgtgctctcgtactcccaacctaggagggctccctcctatagtctgactctggcagaaacttagaacagttagccaaagcactcctagtttgccttcaggcagacctatcccaggccacaaaactttctgctggggtcaaaaccacacccactcatgtcctctgaagagggagcacccaagtactgtgcctgtggctggagcacataccacatttgcctctcaattctagccccaggggcttctcccctgctcaagatcataaatctctgacctgagactctccagaccagtaactgccacttgtgctggctggcaggtttccacatagctccctatgagctaggatacagaatggcctcattctattgatgcccagttctaggagagcatgcaggataatttctagggctgttcctgctcatagacttctgatggctccccaggttagatccagagcttggttgggacaaggatctccgttatagcctggattgcccagcttcccagtgggaatgtgcatcatggaggcaatcactctctatctcatgcactggggattcactcacaattttctgctggagcctgccacatgagttgttacctgcattttttttctaagtgcccaaagttttctttaactcttatgttgatctcccgtgttcctttttgcacagaagttcacagtgtgaatctttacacacaattttgctatttctaagtaggtgaggtatactaacaaagcctccaattacccatctggtgaaagaaaggtgtttaaaaactttgaaaaagagatagaccctaaaatgtaggtatttgtaaagaattcctataccaagacatacgttaattgtgatttactgtgaaaagcaagagcaaatataaagactatacaggcgatatacgtcatgatttttttacaaaagaaagcagagttatattttctcattctgaagtcaaagaagaattttatagctgaatcttttagtataggacattgggaaacatgatggaccatgtcttgatgtatggctttgcaataggtatagaaatgttcaaatgcacatcttttaaactgattctgcatgaaaattgaaggcaaaatgtaacatgctaactttgtgtggaaaaaaaaggattattagctcgaataatgtgctctagacacagatctaggagaaacacataaaatggattccttagttttatgtgagctctttttgtttgtcagctggcttatcattttgaaagctgatagttactcggggcatgcattggaaatacccacagattattgagcaaaacaacattgatctgagaagaaagccctctacaagaaaagaaatatccctaaatcaaactagcaatacgaaatcttacttacctagaaatacactaataaaagttattgattacttacgtgatcaattctatagactgaaacaatttagaataacaaatacagaaataaaactttttaccattaaatttatgtcaaaactccccagcataagaaaaaccacaacactgaacaaccctttcatcactgatttggcaaggagttacaggtgacaataaaaaataatgtcaaatcttaagggttctggtgtaagaagtcctaaattctatatctcttctgctaataacatgtcatttgaaaagccaactgatctatataatttttttatatcctcatataagaaacaaacataaataatatcagtatatcatctggccatagttataataaaagtcaaattaaaagtttctatgaaacccctttattaagataaacatagtaaatagataatttaatttacatttaaagatttctcatgctgaaaaaaagtatcgatgttttgaaatagtttatcagaaattattacaaaaggaaaattttcaaaagcccaacaaatagggtataagagggtggaaatgaactgtgaatggggcacaagaaaactttctagggtgatggataagttctatattttgggttcagtggtagttacacaagtaagtgcaattgccaaaactccttaaattgtatatgtaaaatctttgcattttattatgtgtaatcacaataaaaaatgtccaaaagctattgaataccttatgaaaagtctatttctctaaaaacattgcctcccccttccccataaaaagaaagagtaagggaaaaagtctacttcaaaacataagaaaaatgcaggaccttaattatatcatttttttaagaacttaatatcaaattttgattatctttcaaaaaaagaaaatacagattttgcagcaaataatattctcatgtacatttttcctttatttccatatgtgattacctttcttccacagttcaatacaaataattttactcacaaataccataatcctaaatttcacattttgtgtttgttatagtcatggtcattgccctcccatgcaacattgaatctgaaacaaacagtaactaatggctttcaattcatttctaatgagccattgctgaatatgtctgcatcattctggttttgtttcatggtattatgtttttacatttttcttaaattttacagtttctagtactttgcattaaaacaattcatcatctttaaaaacaaatgttaaaaaagaagaaaacaagcaaaatctattcttagatatagtactttttaaaagtccatttttttttaattttagtttatttttaattgacaaataataaggcaacacttttaatctgaacctggtattatggttctatgtgaaataatgagataacctaatacggaatgatttttttctaactacacctctaaacaagcaaaattatctttgaatatgtttctatgcagttctgtgaataaaatttaaagattttatgtatggctatgctaaattataatcttctgggcttcaataaccgtaagatatgttttcataactgcactcaggagacatcagaaggtgttggggttgaattgtatctccccaaaagaccttgaggtcctaatcaccaggatctcaaaatgtggccttttttgaaaatagagtatttacagtgatattcaaatgaaagtgaatccattagggtggaaactaattcaataggaccactgtcttttaaaaaggggggaaattttgacacagagataggccctcacacaggaagaaaactacaaaaattgaaggctgagatgagggtgattcttcagaagccaagggatgccaaagattgtcccggcaaagtaatacagaaggtatacagggagctttttacaattactatgatgcctgataaaactgtctcttcctccattctttcaactcagttttggtgaaataagagagttcatttattcattcaaaataaggtctttaataccttttctgtttatcactgcctgtcttcaaataatatgccacttcctgtaaaacataatagccttacaacaagatactgtgctttccccttttcttcctttgtgctactgttatcaaaaagcaattttacttaatcagttagttctaaggcctatttgtacaataattatttgaccaataattggtggtaggatgtatttatctgtcaaagaaagtatacttaactcctgagttactcctttttgataaaatttgaactacatgaggttccaacttttccagtgagaaaataataattatttagtctttcacaaatttgttaaaccttgggaactgagagatatcatacatatcaacatatgttgccactggcaacgtatgtatgattatatactataagcaggatcagatgatgatgatctcaaaccattgatgtggagtcacacctgtcttgttctggtatttagatttactactttttaacactgtgatttctgcataagttacggaaaatatctaagtttttgttctttcatatataaaataaacataaataaaatctgactaagagatttgctcaagaacaaaatgatacaaactgtaagtgtctgctatagataattgctttaattacttgtgtgaatttactgaatctgtccaaaagataatttgataaaaactactcgaatatttaatgtagacacactttgatccagcaattacacttatagtaatttattctacaaataaacatgcacacatatatacagaggcatatataattcctcaaataatagattataattgtaaaatattaaaaattccctgtgtctgttatatctgtaaactacagtgtagctataccataagaggatgagtgatctacctacccacacatattttgttcaaacctccggtttttgtgaaggaaaaatcttttaactcttaaagatagatattgtgccatagattgctattgcctgaactaaaattttgtcatggctttgcttttatattagcacttaggacttctatgcataaataaggtaaaaaaaaaaaaaaaaaaaaagcaaaacaatatctctggtaacacattaaaactttcatagtttttatttgatgtgttaagatatacataaataatcacaagtttttaacttattaaatgtcagactttttcagttattatatccattaaaaatttttaaacatttttataagagatgaaaattttaatgcatagtgcttcatgatttaaggtatttatttaaatactcataaaagacaaactaaggaaaaaaatgcttacagtcatctgggagcaaaccttcacgttgtctgaaagtcagctttgtagtgtccataagaaaagcaggccaaagcatcaacacaaatgccaactgcacaggcagcaaagagccagatgctgttggcaaaacatgctccagagtgtggcatctgggtccaataatggccatacagagccccatctgtagctaaagctgttgactctgctttgggggaagaaaaatcagaaataaagaaggcagttaaattttaaaccatgccaggaatagcagaaggcaggttgcagtcagcattcaaattacatcgctagcccaatttgctttttaatgtcttgaaactgtgtaaacactaaactatgttaactccagttgtttagagagatgagcacatataggtagttcagtaacttaggacacacaaatcagctaaatagatttgatattccatcagacgttcatttatctaatttttttctcaaggaatataagcatatggtccatgaaatgcaattctaatttgatctattaaaatatgcaattttaagtgttcattatggtatataattttcttcaaatagcataaaatttaagactcttctttacaatgtttataatattttattagaataactcttcacaaagttaaataggatattcatgtatccttcactgagactccttaaagttttgatcagtggaaatttgtgggaaagctacaaagaaccttaagctttaatcaaataaagtttttcaaaattataaagagatgatcaaaataatctctttttagtgttcttcatttgttgtacatataaatatataaaatggaattagttgatatccagatgattaaaaagattcatcatttataagatgccacactaatcttatctatgcatatatttttgaaaacaagatcaatgttttaaataataaaaactaatgatatttacagtgaactatatataaaaaagttaactaaaactttgtggacagaatattatttatcaccataaccctgagacattactattgttgattctactttctagctaaggaaactggaagcttgcaaatgtaatgtaaacttacttatcccaattcacacaaacccttagagacagaatcaaacttaatatgcagacactgcagacactgtgattgtagaacccatatttattctccttctccccaataagatgaaaataaaatataacttgatagaatcatttctgtaatagcagaggaagaactagtcaaacatacactcttccataaaagaaacttgtacattgataaatatagttaaaataagctgtttcagaactgtgtaaatgaactaaaggcttgaaacaatctccgtgtttattcaagaaaaatgattgaatctcataagcctaatcagcttcgtggttgtaaacaaccatccctctctccccagctcttcaatggacttgaaatccaatatcattgcaataatggtagctgagaaaccagcaacctaatagccagtggagggggaggggatagtacaggtatgcatttgactcaaaagacccttcccaaggaatgtcactatttcattggtttgacagcactctgaaaaactccattctcagggactgactttatttgacctgactaaaaattcactcttataaaaaaccatatatctagggaatttgttaaaaataatcagtggcaattgcttaatatcacagtgtttgaggcaataattccagttgagggcaactctaggttgatcaatataatcaaagatttaataactcgggaattagatgtacctagaagtctttgaaagctagaaaaaatcctggaaaactagaaaacatcacagcatgcaagtctataaacaggcctaagaaagatataaacagccctaatctctgatctctgactaaccttgaggctctatacaagcaggaagtaaagaataaagtacagttgtaaactgcctggctgagcattgaagacatgtctcaacacacacacagagtcctttagtaaaggctggaagatgttttagttccaaaaatctaagaaaaatctctgtgaaatgattcattttagctgaccactaagttaatcaagcagagactaaaatggccacacatggtaaagaacaatcccagtgaaacactagacaaatagtagaaacaacaaaaacaaaaacactagctactaggaaagagcaagatttgatttccagatgtaccaagttatgctatttaaaatgtcaagttaccagaaaatattataagacatacaaagaaataaaagtatgggccatgcacagaaataaaaccagtaaatagaaactgcctttgaggacacccgaatattggatttacttgacaaatatattaagtcagctatggtaaacttgttcaaagggaaatataaactattatataatcaattaaggaaagtaggagattgatgtcttaccaaatcagtaataaaaataaaggaagcaattattaaaaaattaaaaaacaaatagaatttccagagttggaaattataaaaactgaaaaacaaatgtaaaagagaaaaacaacgtcatcaaaaagtgggcaaaggataggaacagatacttctcaaaaggagacatttatgtggccaacaaacatatgaaaaaaagcttatcatcaccggtcattagagaaatgcaaatcaaaaccacaatgagataccatttcacgccagttagaatggcaatcattaaaaatcagtaaacaacagatgctggagaggatgtggagaaataggaatgcttttacactgttggtgggagtgtaaattagttgcaccactgtggaagacagtgtggcgattcctcaaggatctagaactaaaaataccatttgagccagcaatcccattactgggtatatacctgaaggattataaatcattctactataaaaacacatccacacgtatgtttattgcaacactgttcacaaagcaaagacttggaaccaatccaaatgcccaccaatgatagattggataaggaaaatgtggcacatatacagcatgaaatactctgcagctataaaaaaggatgagtttatgtcctttgcagagacatggatgaaaatggaaaccatcattatcagcaaaccaacacaggaacagaaaaccaaacactgcatgttctcactcgtaagtgggagttcaacaatgagcacacagggaggggaacatcacacaccagggcctgttggggggtcagggggatagtggagggatagcattagaagaaatacctaatgtaaatgatgggttgatgggtgcagtaaaccaccatggcatgtgtatggcacatgtagacctatgtaaaaaacctgcacattctgtacatgtatcccagaacttaaagtatattaaaaaaaaaaagttattggaaaaaataaaataattactaactgagcaaaacaagagacttaatttggcagaagaaagaagtagtgaacataaagataagtttattaagataattgtgtctgaggatcatcagaaaaaaaataaataaatgagtagatcctcagagatctactcacatatgagttccaaaaggaaaagggatagataaatgctttgaaaaattaatggccaaaactttctgaatattatgaacaaatgttgatctatacatccatgaacctcatcaaactcaaagtagaataaattgaaagagattgaaagttaatcatgatagtcaaactgtaaaacacaaagagataatagtgatagcatcaagaaagaaagtgatttattacatacaaggatcctcataagaataacaattgacttcccatcagaagccaccatgtagataagaaagcagcagaatgatatatttgaagtgctaaaagaaaaaaaaagactatcaaccatgaattctatatcctacaatgctaccttctaaattaaagcagaaactaagacattttcagataaacaagaacaggaagatttcataactagcagactaacatataaagaatagtaatgatagtcctttaggttaaaatgaaaagaaactatagaatcttaattattcacacataaaaatcatgagatccagtaatggtaactatattagtaaatattaaaaccagtataaatatgttttgttcataactcttttctctgtatatgatttaaaagatggagcataaaaccataattataacagtttgttgatgggcttataatgtataagatataatttgtatcacaataataaaacaagggagtaaaaaaaggggagcaatggtggagcaatatttttgcacagtgttaaaaataagttgctattaatgctgtgtaattgctttatcttaagaggttacttataatctataggtcaaccattaaaaattttctaaataatacaataaatgtaacaagggtgttaaagtggtatatcagaaaaaaatatctatttaacacaaagtaaggcaataatggaagaaggcagcagcaaaagagaagaagacatatagaaaacaaatggcataatagcagaagtaaactctaccttatcagtaattacagtaagtgcaaattgagtgaacattccaatcaaaagacaaataatggcagaatgtgcttaatgaaaaaattgttcaactatatgctatttgtaatagttatactttgtattcaatagtgaaaactaaattcatagcaaaaggaaggagaacataatgaaaattaaagcataaattaataaagcagagaataaaaaagcaatagaataacacaatgaaatctaaaactggtactttccaaaactgaaaaaccattaactagaatgatcaagaaaaaacagagaagacccagattacaagaatcagaaatgaaagagaagaaaatactacactcttccaaaaacaaaaaaggattcaaagagaatactaaacaattacacgctaaccaattataaaggctaaatgaaatagataactttacagaaaggtaaaaccacggaaagtaacccaaaaaaagtatagcatatcaataaacttacaataagcaaagagatttagtaataaaaatgtgttccacaaaataagtacatgagtagattgctttaccagtgactttaccaaatgtttacagaataatgaacaccaatccttctgcaactgttccaaaagagaaggggaaaattcttaacatgttctatgtggctaatattacccagtctaaatccagtcaaagatatgacaaaaaaagaaaaatacagatcaatatgccttaggaatacagaccccaaattccttcatgaagtactagcaaatggaattcagcaacatatacaaagaaatatacattatgaccaattgggacatatattagttctgcaaggttggttttaaaatagaaaaccactaaatgcaatatacaatattaatagaatataagacaaattacacatataaacagcttcattgacagcatttgaaaacattcaacacattttataaaaaacaaaacaaaaaaaacactcaacaaaccagaaacaggagggaatgtccaaaatctggtaaagtgtcccatgaaaaatctacagctaacatcatactttatggtgaaagactgcttgattttcttttaagctcaggaacaagacaagcatatttagtctgtcatttctaagttcaacattgtactggaagttgttgggataattaaacataaaacagaaaaaaacgtatcaatattggacaggtaggagcaaaattgtctccattatcagatattaaaaatcctaaggaatcgaccaaaaattattataactaataaataagtttactgatgttgaaaaatacatcatcaatatacaaaaatcagtgctgtctctatacactagcaaagaacaatctgaaaatggcatgaagacaattccatttctaataacataaaaagattcaaattcttaagaatagattctaagaagtacaagtatacataggaaacaataaaatattattgaaagaaattaaagaagattcaataaaatctctattaaagttatggctgccattttcttcagaaagtaacaagctgatactaaaattcatatggaagtacaaggatcccagtttagcaaaacaatgatggaacaaaaaaataagttggattcatatttcctgacttcaaacttaccaaaagctacaataagagggtgtggtattagaataaagataaatagaatagagggtctagaaatccttacaagtttgtctaattcatgttaaagttaccaagataatttaatatggaaagaatagtatttttaagaaattatcctgagacaactggatattcatgtgtagaagaatgaggctagacctttacctcacaccacacacataaaaattaactaactcaaaatggattatatctcaatataagagctaaaaatataaagtttatagaagaaaatacagaaataaaattattgtaatcttcagttagacaacaatttcttagctatgatatgaaaagcaaaagtggcaaaagaaaatgagtcaattggttgtcctcaaaattaaaattgtttgtgcctgaaaggacaccatgaagaaaaagataactcacataatggaagaaaatatttgcaaatcatatttgataattggcttgtatccaaaatatataaaatttcttacaactaagataaaaggtacataacttccattcccaaatgagcaaatgatatgaggagatattctcccaaaaagagatacacgaggtcagaaagcacatgttaagatgagctgtattattagtccttagggagatgaaaatcaaatgtgcattgaaataccatttcacacctactagaagggttaaaaagacaaacatcaacaaatattggcaagatgtggagaagttgacactctcatacactgctggtggtactgcaaaaattatacattcactttggaaaagagtttggaagttcctctaaaagttaagcacagagttactctatgatccagcaattctactctagttttatatgaaaaataattgaaaatatatgtctggacatgtattgcacatgtttatagcagcgttattcataatagtcaaaaagttgtaataatcaacatgtttatcagctgaaaaataaacaaatttgctgtaactttatgatgtaatgttatctggccataaaaaagaaacaaagtccttataactgctatgacataagtcttgaaaatattatgctaagtcaaacaaaccagtcaccaaaaaacatatattgcatgattccatttatatgaaatgtccagaacagacaaatcctagagatagaaagtcgattagggggactttatttatttcaagggggaagaaggaaatggggagaggctatggtaatggtatgagttcctttggaataataaaagtattctaacattagatagtggtgatccttgtacttctctacgaatctactaaatctatagtagttctctccttttccatggttttgctttctggtttcagttaccagcagtcaaccatgctctaaaaatagatgaatatagtataataagatattttgagagagagagagagagagagaccacattgacacacttttattacagtatgttatgatttttctatttaattagtagttattgttgttaatctcttaatgtgcctaacttatatttaaacttcaccatagttatatatagaaaaatacataatttatatatagatggtccccaactggtttgacgtgatgtcttgtctttacaatgggataaaagcaatttacattaagtagaaactacacttcaagtacgcttacaacaattatgtttttttgctttcagtggagtattcaataaattacatgagatattcaataatttattataaaataggaattgtgtttttctccaccggtaagttaatgtaggttctgagcatgtttaagggaggctaggataagctatgatattcagtaagtatattaaatacttacaagtacatttccaacttacaatttttgtcaatatacaatgggtttatcagaaaaataaccctattgtaagttaagggatatgtgtaaccctgtatagagttcggtgctatctttgattttcagacatccactgggggtcttggaacatatctcccttggaatagtaaagggggactattgtactgaattgtacacctaaaaaggtgaattgtatggtgtgttaattatgtctcaataaaattattatttagaaagataactaggtaaggaaattcctaagttgtaagtcatcctatttatatgcaacatatggaatacatacattatgctcatctcattaatatagcatatttagtgactgctcttttctctttacaatctagaaaagccaatatgaatataatgttcatattaatacattatctttataatcacaaaggagaagcacattcagaaaatctgattcagctaaactttaaattttatagccagataaaatgcaacaaatatctgaaatatgaaaataaataaagcaaataatatatcaaaaatcttaggaatgatgaaatgactaagagtttgtcttaatttaggtaacaaaatctcctgaaacatttatacatttaaatcactaggagttcacaataagccatgtcagggttatctagaaagactgattatgtatcatgaatattaaagtattttgaattaagccttgtagatgttgcttattttgttttcaatttttatgacgtctatatcaaatgcgatacttttatttaaataaaattaataccatgttggacaataaattaatatttgagtcctctcattttgttgggatatataagaatattttgaaccaataggtggacaaacataagtgatgtatttcatacacacacacacacacacatacacacgtgtatttaactcatatgtataagacattgttttgggaaggagcaaagtagcttctgatagccaggatattcaggagctagccatatagtataaagcaggtttagagctaggtgtaagtgttcttctgatgaccatttcaacaatttcatagaacatcagtatcagacatggctaatctatgcaaatgagagatcacaaaaactaggctaacttataatcatatcaaatagagacaaaaccaggaacatcacccaaacaaaagactaacaaaacaatcccctgtcatggctaatataagtaattgctacctcttttgaaaacattggctttcacttctttcttgtcttttcctccatcctcctaggtaagacttaccataaacctaataataaaattctgctcccttcttgacaacttatccagagcaaagacccactctttgaaaccatcccccaaaatacaagtagcaagctcaagtcggtaagtcctttctaacatccttttatttagatatccctgtggatctacatgatgtgttttctcccttgttgcaatgagttataaacccaacttttgcaaccctaggtgtgttcccagtggtgtttgtctggtgactgccaacagcatcaacacacacatacagaaacgcatatacaagttatcttaagaaattataggaagagctaaatgccaaaaaaaggatatatcagagtctcaatgaaagaaatactagaaaatttatagtacatattataggttataattaattaatgtaagaaaaataaaacagataacaattaatattatgtttttagttcatcaaaagtttattatttctcctaatatacaggtggaaaggttattaatatcaatttgtgttcatacatcaacttactaattgctaatgtcacaaaaatgtctctgggtctttttatttttatatatctttaactaatcctaactactggcattgtgagttttcctatattaccaaaattatttatttatcttttttttgtcacatagtatctatgccattattgccagctattgtggaattcaatttaataaagcaaactgcctactgttgaacagtctgcaccttataacccactttaatcaccaaaaaattagaaacatttgtgaaaagttttacaggcatgagataatccagaattctcaaccttaatcacaaggcaaaagagaatgtatgatttattttggaggacattctgaaataattttaacattttcctttgtaaaataatcatctgagtgtgtttgtatgcaattcatctgcttctgaacaagaaaaggatttagttatgatatacttgattatgcatctacataagagatgcaatgtatgccaaacaaatctaggattaaaaattatttaccaagggcagggcatggtggctcatgcctataatctgagcactttgggaggctgaggcgggcaggtcacttgagatcaggagttcgagaccagcctggctaacatggtgaaactccatctctactacaaatacaaaaattatccaggcatggtgtcaggcacctgtaatcctagctactcggaggctgaggcaggagaattacttgaacccaggaggtggaggttgcagtgagccaagatcatgccactgcactccagcctggaaaacagagtgagagtctgcctcaaaaaaaaaatttacaaatatatacgtggttattaagcttttggaataatagcaatagctactaagaatttctttttcatgtgtatgcatcattttagatttagggagtacatgtgcaactgttacatggatatactgcatgatgctggagtttggggtacaaatgatcccatcacccaggtagtgagcatagtatccaacagtcagtttttcaacccatacttacctccttcccttcccactctagaattccccagtgtttattactgccctctttatgtccacgagtacccagtgtttagcttccacttataagtgagaacatatgatatttggttttatgtttctgtattaattcacctagaataatggcctcaagctacatccatgttgctgcaaagaacatgactttgttcttcttcatggctgcatagtagtccatggtgtatatgaaccacattttctttatgcaatcccatgttgatgggaacctaggttagttctatgtctttgctatggtgagtagcgctgagatgactacatgagtgcatgtatctttttggtagaatgatttatttacttttggatataagcccagtaatgggattggtgggtgaaatggtagttctatgttaagtttttgagaaatctccaaactgctctccacagtagctgaactaatttatatcccaacaacagtgtttaaacgttctcttttctccaatgccttatcagcatctgttggttttttaactttttaataataacaatgctgatgtgtgtgagatgttgtctcattgcggttttgatttggatttctctgattaatgatgttgagcatttttttcatatgtttatggggcacttgttaaatgcgtatctcaaaatgtcagaaagatatcaaactaatgatccaatatcatacttggaaaaccagaaacataagagcaaactaattccaaacctagcaaaagaaaagaactaaaatcagagcagaactgaacaaaattaagaccccaaaatccagggaaataatcaacttaaccagaagttggttttttgaaagcataaacaagattgataaaccactgtctacattaacaaagaaaaaacgacagaagatccaaataagtacagtcagagatgacaaaggtgacattacaactgatctcacagaagtagaatgattctgagagacccttatgaacacctccatacacataaactagaaaatctaaaggaaatgggtaaatacctggtaacacaccacctctcaagattgaatgagaaaaaaattgaaatcctgaaaacaccaagttttgaaattgaatcagtaattttaaaaaaacaacctaccaactaaataaagccccagaccagatggattcacgccaaattttactagatgtaaaaagaaaagctggtacccattctactgtaactcttccaaaaaaaaaaaaaaaacaaaaatgaagtcgaaggaactcctccctaattcactctatgaaccagtattatcgagataccaaaacctggaaaagatacaacacaaaaagaaaactacaggccaatacaccttatgaccctcaacaaaatactaggaagcctaatatggcagcacatcaaaaagttaattctccaactaagcttcattcctgggatgaaactgtttcaccaaacacaaatcaataaatgtgattcactgcataaacagaattaaaaacaaaaaacacatgatgatcccaatagaagtggaaaattctgctatgaaattcaacatcatgctaaaaatcctaaatagactaggtatctaagaaacatatctcaaaataataagagccatctatggtaaacccacagccaacatcatactaaatgggcaaagtctacaagcattcccctggaggactggaacaagcccagcctcacaacttctattcaacacagtaccggaagtccgagccagagctatcaggcaagagaaataaataaaaggtatccaaaaaggaacaaaataagtcaaactatctctccttactggtgatatgattctacacctagaagatgctgaagactccaccaaaaggctcaaagtttcaggacacaaaatcgatgtatacaaatcagtaacatttctatgcaccaataacattcaagctgagagccaaatccagaatccatttacaatatgaaatctcatttacaatagcacacacaccaaaaacaaaaaacaaacaaacaaacaaaaaagcaaggaatacatctaatcaaggatgtgaaagatctgtacaaggagaactacaaaacactgctaaaagcaatcagtaatgacacaaacaaatgaaaaaataccccgtgttcatggcttggaagaatccatatcattaaaatggacataatgcccaaagcatgcacagattcaacgtatcaacctacgaatgtcatttttcacagaattagagaaaaactatactaaaatgtacgtagagtgaagaaagagattgaataactaaagcaatcttagagaggaaataaaaaaagatggaggcatcatgttacctgacttcaaactatacgtaagtctacagtaaccaaaaacagcatggcagcattgcactggtaaaacaacaacaataacagacacacagatcagtggaacagaatagcaaaaccagaaataaagcaacatactgacagccatttaatatttgataaatcaacaaaaataagcaataagggaaggaccccctattcaataaatggtgctgggaaaattggctgtccatatgcagaggactgaaactggacccttaccttttactatacacagaaaagtaacccaggatggactaaatatataaatataagacctctgactataagaatcctaaaagaaaacctagaaaacaccattctggacatcagccttgataaataatttatgagtgagtccacaaaagcaactacaacaaaaccaaaaattgacaagtaagattaagctaaagagcttctgcatagcaaaggaaactatcaacagagtaaacagacaactgacagaatgggaaaaataaagtggagtattctcccaatgtgatagtctgaaatatagtctgaaaccaggggcacaatgcactgtggaaagccgtagggacctctgcccttgaaagcggggtattgtccaaggtttctccccatatgatagtctgaaatatggcctcctgggatgagaaagacctgaccgtcccccagcccaacacccttaaagggtctgtgctgaggaggattagtaaaagaggaaagcatcttgcagctgagatagaggaaggccactgtctcctgcctgtccctgggaactgaatgtctcggtataaaacccgattgtacatttgttcaattctgagatcagagaaaaaccgccctatggtgggaggcgagacatgtttgcagcaatgctgccttgttattctttactccactgacatgtttgggtggagagaaacataaatctggcttatgtgcatgtccagtcatagtaccttcccttgaacttaattatgacatagattctattgttcacatatttgttgctgaccttctccttattatcaccctgccctcctactacattcctttttgctgaaataatgaagataataatcaataaaagctgagggaactcagaggccggtgcaggtccttggtatgctgagtgccggtcccctgggcccactgttgtttctctattaaaaaaaaaaaaaaaaaaaaagaatgggaaaaatagtcacgatctatgcatccaataaaggtgtgatatgctgaatctataaggaacttattcaacaagcaaaaaacaactccattaaaaggtgggcataatacataaacacctactcagaatttctatttggagtttcttcagaattctcatctaagaactaattaatacaattgaattatggaatatgtggaaaatttatactataaaatatatcaaaaattttactaaaataatccaaaatcacaataatctctaagtaaaaaattggaagttttaatttagcggactcactcctttcttgtcagagtgtggtagttctcatactgcatggaaaggtccaaaacaatgttaagatggcaaaaacatgttttgaagaagtaaatgcatttgtatcattaccatattggaacattgcattttcaagttaaaatttgtttatactttgttgacatctgcccttcagtgttttcaaatttcaaatgattgcgacaccatcttgtcagtaaatggctcttcattgctggatggttattttaattaaatgtatctaaagtgaaaataatgtctggatgtatcccaaggacactgagcactccaagtaatttcatgaagaaagctaaaaatatgttactcaccgatagcttttgtaaaggtcagtacaggtggaattgttcttgcaaggattcattttacactcattggattcttgttcacaaaaatttccttcccaatcagataggcacacacactggtagctctaagagaatatgaaattatatatttttaggctatttcttactattaagcctataatacagatattactcctggccattttgatatctctgtcaatttataatttttttagttttatagaatgccaatactccccccaaatgacttttaccacatttttaaaagcgtgtgaacagtattctttagtatctaattaaataaagttttgtagtaagtcaatagattctacagaaggtattaaagatttatgcattatgctcacaatgtagaattatcatctttgttaaatgttttaaaagaaaaatagcatgttagtcatatgatggtagatgatggagtataactaaataactaattaaacaactcagcaactagctcacaagttaaaaatacaagtataaataaggaaacttttgacagatttattgttacagataaatatttaaaataaattaacagacttttggtcaattaaaatcgtaaaacttttcatggtgtttttctgaaacagagagttgccctatgacaatgtaattcagaatgctagaggtaaaattttgctttcctagtattgggcaaacaaacaaacaaaagaaacactttaaattactctgtgaaaatactttctatatgaaaaatatttttgaagaatagagctcttgtcaaaattagattttgggcttttgtctgtagagaatctagatatagcattataaaaacggtaaaatcaatgttaactgttatttaaatctgcacttttcaatacagtagccacatgtggctataaaacattgaaacatggctagtaccatttaagatgtgctataaatataaaatacatattgaatgttgaaaagttagtattaaaaaaggaatgccaagtatctcactaaaattttttattatttactttcggttgaaatggaaataattttgatataaagagttaaatgaaacgtacgatttcaattaatttcatttatttccatagctttttgtagtggctactagaaaagttaaaacacaaacagagatctcttttaatttctactgaacagaggtgagagttgagttagataatgccagcccagtttctccatttgtggatagagttaagaagtctatatacttataagcacaatgtgatgagtaggagccctgagattacagaacgcatcttagtttaatacatctcaacatcctgtacagatctagcaccctatgtttaattaatgttgattaaataaacagaaaaaacaaacatgatatgaccaataatttaaaggttgaagttagtagccaaaacaaaattcaaaatgatccttcatcactttggtacatttggacagcaaattttttttacaaacataacaatgaaacatgataaccagaagaaaaataaatgcatgctccatgtatgtgcatttagtttacaacagtttaaatgtataagaagttctactcagtactgtgctttggttgaacagggccaattggttttccatgctaggtattaataactagcttaaaagcacaagaatgagagccaccttttcaacattgtgctttattcttgacacatatactagtctccactcagaataatctttaagggtactccagttttgctggattttagcagatttttttttcacataccatgctccctacattgttaacttcctccatgagtgtggtaacatttacagttttcattggttgcgtttggcttattttttctttttttttttttttgtaaacattaaaagaggacttacataaaaattgaatataatgattatattttgttttatgaatgtgctatttaaaatgaaagcaattccacaatagtcaagacaacatcagctgtggtgaatgggagaaaatcatcccactcagtagcataaatggcatatgcataaaatcttcgggacatgcccattcgttatgttctgaaatttctcatattatggggtataaattatttatgtaaagacaaatgcataagcacactgctgatttttattttgatgcctcaataatattttgaaacaaatttagtgagtcaaaaattcagtcaaatttttcctattaaattcatatatttcttaaaagctaataactattggtattttcaataacttgataattagtagaaaattgtcaatttcagggtatcattatcattaaagtatcaggtactatagcagtgaattccagatatgatgaactatatacaaaaagaaaacataaaaggatgaagaaaatataatttaaaaaattaaaatttaaagatgtaaatgatgaagagaacaaaagtgcatagcaactaaaaataacccagagtttgagaatttttattcatcagtatcttacttgattcaaaagcattttcctcaatttagacattcttgctgcaaagcagtttctcattcaacattgaataattgattccagtaatttaaaataactgttccttaaatttgcactggtcaatacagtggccagaatagtattaaataatattaaatattgtatttaatattattaaatattaaatattaataactattaaatattttaatattaattataaaaatagaaattatattccactagaaaactgaaatataattaatattaatatttaatattttaatattaaatattaagtaattattaaatattaaataatattaaataatagtaaatactagtattaaatagtattaaatagtattaaagtaaaatactatttttaaaagcacattttcagccaattttgatggaaaaggaaagtattattaaaatgtgtttaccaaaaggagtaaaggtttacattatttattaaattagaatcttatcattttttaacttctcactacaaagtagacattactcttcctactaaacttggataaaacagtagtttgaaaatatgcatgtgacaggaaagacagatgataaaaacacaggtctacaatattgaactctgcagccagtgagaaaaaaataaagacaaagctgtcaagtttgatagttgtaaatgcataaactatatagtagttcactttttcagatcaacagccagatattttaaatttttcttatcagtaacagatgtactaaagtaagatggatagcataattgtgaacatgaattttcaagttagagagattaaacaatatctctgatgcttattaaatctctagacatctagtatattagttttctcttactgcctaaaagattactacaagtttcgtgtcttaaaacaacataaatgtattgtctcacagtttcaataagtcagtgtacaagagtcagtcacctaaatcctttgctttcggtctcaccatgctgaaatcaaggtattgactgggatgtgatctcacctaggaaatggagttctcttccaagttcaatgattgtagcagaattcatttcattctgcctctaggactcagatctcattttcttgctagctaccaggtaaagactactctcagcgtttagaaggtatttgcaggtccttgacacatggcctcctcctctcacagcatgccagtttgtttttttaaggacaacaggagaatctctgctgttacctcttgttttgttaaaggcccatttaattagggcagcccatgtaggacaaccacatgtttgattaaataaaagtcacttattgggggtgttaataacactgtaaaatctctttctacatataatataatcatggaagaagtatcatatttacaggtttcactcacacccaaggggagattttacagggcatatacaccaggagatgggaatctcgaggatcatcttaaaattttgcctttaatatctactaatctacttaatctttccaagtaacctactcaagttctccaagcctcaggtgccttcatatgtaaagtactaacaatttatacttcataaatatacttaagccttgaaggtagtaataactataatattcttagcctagcgacaaataattatcattaattagtagtagccattacctctaggcaaaacagtctagatctaacaacgtcaaagaataattgacagaagtaccacgattggctcaaacctattcatcaatacattacttatttttataaacatttaagccatgtaataagagataaccagactaggaaaaacaaagaaggaggaagagcaagagaatccagcaatatgtaatttatgaacacagacttacatgaagtggattaatataagaaaatataaatgaggaaaatgtattcaagatgaaatagaaaatcacactaaaccagtagacatttaaaaatataccaaaggagggagatttgctaacatagactcaaacaaaattactcccaagtctttatttattctcttatgccacataggtgaagagaatagaaaaacaggaaaaactactcaaattattttttgagactatcaaaacctagctaccaaattctagcaagcatataacaacaaatagaaatttagccaatgtttttaggatcaaaaagtcaatttttttcaaaaaaacataaatttagatagtcgaaaacagtaatgtatttaaaatacattatatagtttgagctggaaatatgccagaaatggaaatatgcctcaacacaagaaaatcttttagagaaagaaaaatggttttatcatttcagagcagaaaaatattttataaaattcaatacacattctaaaaatttcttttagcaaatgaaaacaaaatgggaatgtacttacattaacaacaactacctacaaaatgatttaaaaaaaccctgccaaacatcagtttatcaaaaacaaatgtagaaactgaataaaaaatatatacacatatacatatacatatatatatatatatatatatatatatatatatattgttgaattgttacaagaacaactgaagttgactagatcttctaaagctaaagagataagaagcaagcaaagttaagactacagagggctctgcttttcaaaccaggacatctgcccatttgcttccagataagtagttgcatctagataagcagaaagtagtagctggagtttgcagcagcttctttgaatgaaaagaaaacactagcattcagcttggtcaaggagattaggtccgtgaagagaagaacagagaagtgagcccacaatttgatcagccctattctatagaggcacttgttccctttcaaccttgtatttatagtatgaaattacacagaagtaaagcattagcagtctagtagtgcaaggaagataaaagttggagtttagggccagcaatatcttacagtcttgttaaacacttctagctttcaatgaacacaacagaggggcatatcttgaagaaaaaccagcaaaaaaacaaaaacaaaaacagctttaacggcatgaaaaccatacttgcctaaaatgtgatcatgcattcctattctgtctgccagaaaaataaaaataaaaaatcctctttggaagatgttaacattagatggagcttttcaaagtttgaaacaaatgtctgccattcaataaaaaagtttcttaaatgctgattaccaaatgtcaagagacaaactgacagtagaaatatactattgagatactgtgattattggatagagatttaaaaatacttatgatgaatacatataaaaatatagaagacaaatagggaattccactagaaaactgaaatctataaaagagacaaagaaaaactctgagtttgaaaattataacctgaaatttaatgacttaatatattattttaataatagacttattagacagaattaataaacttgctagtaaaagatatacagattgaaatatttatataaaggatataacagtcataaaagaaaacgaaatatgggaactaatgaaaatagccattatttgtttaattggaatatcaaaaacgaaggtagagaaattgggcaagaacaatatttgaaaaattgctgcctgagaattttcaaaagatggcaaaaagagagtgaccacagatttagaaagttcttgagacctatgctggatacataaaaataaaactttatctagattaaaacttctgaaaatgaaagacaaggagtaaatcatacaggcagccaatgaacaaagacatattatcttcaaagggacacaaagatcacaacttactccccagtatcagaagcaagaacccagtgagccaacatcataatggagtgaaagaaaataactgccaatttaaacttctatacccagtaaaaatacacttcaattatgaaagcagaacaaactcactttttacaaaaacaaaacctgagaacttactgcaatgtttaagattgtgggaatttgttgacagatgacctggatttaaattcaggctctaagaattatgacttatataattttaagcatgttacttaatttcaaggcacatcagaaataatgctacctgcccaacgagggtataagaagtacagcactgagtataggacgtagtgtaatatctaacatagtaagacaaccataaattttaactaaaatgttctcatatactgtgacttgtccaggtaagctaaactacttctcagtctctgtgatgtttgtttcctttactttcttccacttggaatgactttgtctacttccaccaatccctgaccatactttccaagttttatccacctgcaaatgtcaaaacaagtgccacatagtacctgaagctttgataatttccttcagcataccttctcttacttactgttttagattttatgatacatttaaagcatgttagttacttatgtacatataagctgtattctgcttagtgcttattgtatttaaaaatatcttaattatattattgcgtatttctctagtttctaaagtataaattccaagagggcagaaactttctttactttgttcaacaattatcatcaataataacatctggaatagtgtctaatgtttgactgaataggtgctagagattggaacatctataatgatattcattggtactaatatagtcatggaggatattttatttatcatttctagatatttaataatcttattttcctaacaagaaaaagacttttttaaaagaattcatttaaataattatttcattacaatcaaccaaaagcagttctataaatgaaggattaaaatccccattgaaagaaaacttggattgcttccattttgaaaagtttttatacattagaattattgtattttattcagtcttagccacaattttttactaacatgtgtgctttgtgaaactttctattagattactgaaaatgtagatatatactgaaaaaaatagaaatttcaaattatagtctctttctgatcattatttatgtaactcttgaaagaaggacaaatatttttctttgctttaataaaaaaacttttgaagtaaaatttgtaatgaatttaatccttgtaaaaataaagggctctccctattgacttattatctcttttatttaaatgttattttaagttttcactttaattcataaatacttatagagttggctatagacacaaaggtttccaaatactgaatgctgatactcaggattatacataaaaacactaatctttatttataaaaacaaacagaactatcttaatatgatttctttcagcaagagaaaatgatttatcttggtgctttaaatctaaagtaaaataatatgtattattctgacagaaagtaaatggaatatttagaaacaatttctataaaaagttacaaacactgaatttgattgaacatattttgaaataaggcaaagaaaatacactttacaatgagtgatactttcaaggcaaaacttgtagaaaaacacaatttcttttacttgggaaaatgtaatacaaatacatgaagaatatgaaaagtcacatggtagaggaagataatatagagtataaatcaagctatactggattttgaaaacattttctaaagaaaacataaacctctaagaaacttagtcattgttcccatgtgattatacttttcattagtaacaaaaaaaaaagcaaatggtcattttagtgcctaatattccaaatgagaaaacaaacattaagtataaatttccactggttttatttcctatatctagtaaatctactatcaaaataacttcagctgtttgtctactatgctattttcaatttatagtttttattagtaatctttacttataatttagttctcttacggcatgccctaccttcataaaccatttgtgatcctttttaagggttcctttacctttaatgtcggtttaaaaaaaaaaagaatttaaaactagaataaagaagtttagactaactgtaataaaccatgggaaaaaataactcatctgtcattgatgtgtactgctcaaacatatttattatgttttgaatattatcttccttattgactcaatttgacaattagagatatagtctaatacccaaagctttttccctagtacacaaataataagaatatagaaaatataatcttgtatgagatgatcacataaagatgacagtatataaatgtaattctgcaacatatagttttggggagcattacatgttttggtctgagagccaaatgacaataataatgcaagtacaccatggactaaaaatcacttgtaagttttgaaccacaagtacaaaactcatttccagtattatgacctcaaagaaaattagcaactgaggcagagcaagatggtggaatagaaagcttcgtcaatttttcccccacccctggcaagggcaccaaattaacaactatatacactgaaaacaccttcataagaaccaaaaatcagtacatacaaaaatcagtagtatttctatatgccaaaagtgaacaaactgaaaaacaaatcaaaaacataggctaggcatggtggctcacacctgtaatcccagaactttggaaggctgaggcaggtagatcacctgagatcaggagttcaagactagcctggccaatatggtgaaaccatttctctaccaaaaatacaatacaaaacaaaaaattagccgggcatggtggcaggcacctgtagtcccagctactcaggatgctgaggcaggagaaacacttgaacctgggaggcggaggcagcagtgagcagtaattgtgtcactgcactccagtccagcctaggtgacagagtgagactctgtctcaaaaaacaaacaaccaacaaaaaaaaaatcttaattccatttacaatagccaaaaatgaaattaaatacctaggaattaaccagagaaaggaaagatcacaataatgaaaatatacgacactgatgaaggaaattgaagaggacatcaaaaaaatgaaaaaaaaattccatattcatggattagaagaatcgatattgttaaaacatccatactattgggagaggacatagttagaggctggctacacacacagagagggagagtcttgggagagaggcagtgcgcatggaaacacactggcaccacccttgtggtgtagttagcaggaaaaaatatggttaagaacttcctcttataccaggatgtttgctcagaagggatttattgtgcaagcacaataaatcaactaaatgtcctgaatatgacccagagctaattgtaatatcatcggcattgcagttttggctccctatcccatgggttttgcttaggcattcttgggtaataactacgatggagtcactatggtctactccagatatgcatagatgcaacgtccccgggggagcgggggaactttactcctcctattaaggcagaacctacgaaaggctttcttatttttccccacagaaaaaatatccccagcactcagaaccatttctggcaactcgctttgggtcccctctcactgctaataatttttctattgctttacaaattctgctctgccttactcactctctggtgtccacatgccttattcttctttgtcctctgacaagaactcagacctcactaaattaaggaatagagaaactgcaatactatgcaaagcagtctacacattcagtgtaatctctatcaaaatatcaatgacatccttcacagaaatagaaaaaaaaaattccaaaatgtatatgaaaccacaaaagacccaggatagccaaagctatcctaagcaaaaagaatgaaatggaaataattacattacttgacttcaaattatactacagtgctatagtaaccaaacagcatgttgctggcataaaaacagatacagaccaatggaacagattagagaacccaaaaacaaatccacacacctacagtgaactcatttttggtaaaggtgtcaagaacatgcactggagaaaagacagtttgttcaataaatggtgctgggaaagctggatatccatagacaaaagaatgaaactggatgcctatctctcatcatgtacaaaagtcaaatcaaaatggattagataattaaatctaagacctcagactatgtaactaccacagaaaactggggaaaatctccaggacattggtcaaatatttcttgagcaataaccacaagcacaggcaaccaaagcaaaaatggacaaatgacatcacatcaagttaaaaagctcctgcacagcaagggaaacaatcaacaaagtaaagagacaatccacagaatgagaggaaaatttttgtaaattaccaatctgacaagggactaataaccagaatatataaggatctcaaacaattttataggaaaaaaactctaataatctgatcaataaatgggcaaaaaatttcaacagacatttatcaaaagaagacacacaaatggcaaacaggcatatgaaaaggtgcttaacatcactgattatcagagaaatgcacatcaaacaatgagaaatcatctgaccccagttaatatatccaaaagacgcaacaacaaatgccggtgaagatgtggagaaaagggaatccacttatactgttgatgtgaatgtaaatcagtacagtcactatggaaaacaatttgaggttcctcaaaaaactaaaaatagagctatcaaatgatccagcaatcccactgctgggtatacaccccccaaatgaaaatcagtatatcaaagagatatcttcacttccatgtttgttgcagcattgttcacaatagccaagacttgcaagcaacctaagtgtccatcaaaagataaatggattaaaaaaatgcagtacacatgcacaatggcgtactattgagccattgagaagaatgagatcctgtcatttgcaacaacatggatggaactggagattattatgaagtgaaataagccaggcacagaaagacaaatcaaatattgcatgttctcacttagttgtgagacctataaatcaaagcaattgaattcatggacacagagagtagaaggatggttaccagaggctgggaagggtagtggatggtttgggagatgtgggaatggttaatggataaaaaaaaaaaattagggagaacgaataagatctactatttgatggcacaacagggtgcctatagtcaataacaacttaattgtacattttgaaataactaaaatagtgtaatttgattgtaatttgttgtgtaatttgtaacacaacagatgaatgcttgaagggatgaagacctcattctccatgatttgattatttcacattgcatgcctgtatcaaaacatctcatgcataccataaatatatacacctattatgtacccgcaaatataaaaataaaaataaatgcaacctccttcatcaaaaaaaattagtgcctgtaaaagtggaaaaatcgtctaggctttttcacagcaaaacagagacaaataccaaacaaataatatggtatttgcttattgtttttaaatattttcaatacctacttaaatagttcatttaatcacctggtaaaataaaataaaatgaccaatatgagataatataaagaaacgttcaactgtattttagcctatttgacagttttatgttctgtaaaacttctaatattttacatttattaggatttttttctgtaaaatggttttaagtttgaactgaaagcatttttatgtaattctgtatatatatcacacataaaatatatttgtataattatacatacacaatgtattacatataattataaatatacctagtatatataataacatacgtatataccatatgttgtgtgtatatgtatataacatcaaattttggctgggtgcggtggctcaggcctctaatcctagttgttcgggaggctgagacatgagagtcgcctgagtccgggaggcagcggttgcagtgagcgaaaatcgcgccactgcactccagcctgggtgacagagtgagactccatctcaaaaactaaacaaaacaaaacaaacaaatttaatgtcatctgaatctaaacctcactttcacagagattaagaaacaatcttcaggccgggcgcggtggctcacgcctgtaatcccagcactttgggaggccgaggcgggtggatcacgaggtcaggagatcgagaccacggtgaaaccccgtctctactaaaaatacaaaaaattagccgggcgcagtggcgggcgcctgtagtcccagctactcgggaggctgaggcaggaggatggtgtgaacccggaaggcggagcttgcagtgagcggagatcgcgccacagcactccagcctgggcgacaaaacgagactccgtctcaaaaaaaaaaaaaaaaaaaaaaaaaaaaagaaacaatcttcagcaaatatacatactgtaatcaaactgtggtgtttctttacattttatatttcataaacataataatttcttggcaattggtaagaggaattctggaaacattacagttagacacacaatcattggagtgtaaataatataaactggcttcatatcccaggaccttaacaattattgaatgacttgtatatctgtaggttatagttccttgataagaggactattttgtcttatggttagccattatgattttgttgctggctgatagactacctgctttgcattagaaaccagtaggggtaagatgggggatataaatactcagtcgtagttgtggtaaccatgtaagcggcaggtgagaagggagtagaacaatgtaagaatacttagaaaaaatgtgagctacaatttcgaatatccctgtcatcatcagcatgttggaattccataattcctcaataataattccaagaagcaaatttgctgtaaaactcattaatttatgaaaacaagccctccaatctgtgttttgcattgtagaatgtgttattattgacataatcattactcctctcctcagagtaatcagggatatcagaagcataagtgtttttttcttttccttcattattctttattttttgaattcaggaatgaaggttctgttgtcattctatccacagataccataaatattttctacacacattaaaccactcatgatattgacttaatgtgaatggagacatgggtaaaatgccctaggcagatgtcagggtatttgattctggtcccagatgctatgacatgtaggctattgaacatcttatccaattggtcataactggtcttaattttaaatcaacaaatttgaactcagtgattttttttactctttcaattctaaaatgattatatttttattgccttatttatagtttctaaaagcaccagatattaacaagaactgtctctctattgtgccaagtattctgaccagatgtctaaggtgttcctagtgattggttaatccctgagtaacaaaactatgttgtaaagtttcagctgcaaacacagttaagtagttcacgactcaggattttttttttttttttttttttttaagaagaaccactgttaaagtttgtctttgttgccaatcacttaccacagtgcatgggcaaatgtgtgtttaaaaacttgcagagagaaatttgtattactgagtcacaatgattgatgttttacttaccaagcacataagtgatattagtcttaatgcctttcaattgaataaaatcaatggtaattttcaggtatagaaaaaaagtggagtctctaaggctaagtttgacttgtgatttgaagtttacaaatagttttccagatattttcttaatcctgttaacaaatatttataatgagaggaaattactaataccttctcattataaatattaatatgaacaataaaagtaatctttgattatgtagaatatgtaaatagttactttatagtcatatgtcatataatcattttcttgtaaaataagggataattttaagcaactgtcttcaaatgttaagacaaaaatgattttgaaaggatttttccttttacctttttaaattgctgtcaataattttttaacaatgtagaacctaggtcactgaatacagtgttttgtataactttgttttttccaatatatattccaaattatttataggttttccttttcattttctacttttagaagagccaattgtgattcaacttatatctacaattctgagtctgttcccaaaatctttgatgtcacaaaataaatccgtgccatcttacatttggcatttctatatttttccttctttttaacttttatattaagttcaggggtatatgtgcaggtttgttccatagataaacttgtattatggtggtttcttgtacagaatattccatcatcaggtattaagcctagtacccattagttatttttcctgatcctctccctactccctactgccacccaccaccctctgatggtccccaatgtgtgttgttcccctctatgtgtccatgtggtctcatcatttagctcccattgacacatgagaacatacagtatttggttttctgttcctgggttagtttgctaaagataatggcctccagctccatccatatccctgcaaagacatgatttatttcttcattatgactgcataaaccatagtgtatgtgtaccacattttctttatccagtctatcactgatggtcatttaggttgattccttgtctttgctattgtgaatagtaccagagtgaatatatgtgtgcatgtgcctttataatagaacaattgatatttatttgggtatatacctaggaatgggattgcagggttgaatagtggttctgtcattacatcattgaggaatcatcacactgtcttccacagtggttgaactaattgactttgattatggaatgtagccctttaaagacgtgtttcccaaaggaacattttggtcagtggtgttgtatgtatctgttgttgtaaactattaattattcaaataaattttaatataagtaaatgaaatcctattatgatcatctaactgtagtgaacaggaatgaagtgatcagttatcctttccaatatatcatatatatatatatatacacacacaatttatatacacataaattgtatatttgtatatacatgcatatctgtgtgtgtataattcctcttcctctttaaaatactcaacagctacactgttcacctctcagtcatttataagctaggaataatgtttttcaaaaaatgcatgcttcatcagtacaatggaataagtccagagggaatttataaggcattttcatgtattctattcattttattacatcattaatcctctcccaactcacaatcctaccaatacacctttataatgctcagtgcacttgagttgcaattcagcttctgttttgagcccttatgctattaggcaatttacttagcctatctttttatttataaaactagaaaaataataggaaatttgggggagataatttctgaagcggtttttctatactcatatactaaaaattcataatttatctatcatcataattattttattgatccattagtattttaaaattctcaatccagagttttcattcttcaactctagtgaagtcaccaaaaacataatcataacttcctcacgtttcccctaagaaattttctatctccaaaacctcaaattatgatattctgttctttgtcactacttcttcagctttatcactcctaaccctgcacttctattctagttgctattcttctcagtatttctcggttagcacacttgctttctagccattagttctttctcttcacttttcagcataaacaccatcataagggggtttccaaaaactacaccactagtagtaaatgagatggtctgataaacagaggtttattttattttaaactttatttatctagttgtgttaaataaaaataaactgtttatctaatttatctatgtatctctttatctctctctttatctaattgtattagatagataaattgtgttatttctttactctaaattgtgttacaaaaacagaacaagtaggtggggcatggtggctcatgcctgaaatcatagccctttgggaggccaaggcgggaggatcacttgatccagcagtccgagaccagtctgggcaacataggaagacaccctatctttacaaaaaaaaaagaaaagaaaaaaaaagcttgtcatggtgctgtatgcctgtagtcccagatactcatgaggctgaggggctgaggcttgagggacgcttgagcccaggagtttgaggctgcaatgagctgtgatcacaccattgtactccagcctgggcaacagaataagaccaggtctcctccccaacaaccctcaaaaaaagagagagagaaatatagaacaagtgcaccaaattctgaatagattaccgaagagtaagtatatcttaattaaaaaatgatttaggtggtataaacatttgtatcaagaacacaaatttctataattttgattagctcgatgaggcttaaaaatgtgtgcccttagtcctattatcatatctccttgcttctgtattactgtactcaggactatttgaatgatattttctatgtagtttaaaatgttttgaacttttatggtaaaagatatgcatatgaatgtgtgcgtgcatgtattattctgagtgtcactctacagacaatggtttatctttctttagcagaaaatctctctctaggtgtagtaagctagtgttctgattagaaagcccacattctaaagatagttactgcaaatacttcagttatctttatctctgaccaacactcaatacttttgcaaatagcaaaatattaatttacaaattggatttcattagcgaaattattattaaacatatatagacttagtaaatattttacagccattcttagttacttcttgaccaggatgtagtgagccctatagtcattagccataggaatggcaccctaggtttgataatttaattatcctttacctctcccttcgttcaggaatttcccattcttttgactctgaaagatgttaagataatccaacgacttgaatattgtcaacagtgacctactgtgaaacttttatgcaagcaatttctgagaccaccaaaagatagagaacagagacctcattgatgcaataaatgtgtgcacgatagcataatttggcctatggcttgtttttgataaccaagtggtaaattagtgaggaaggaagcaactcatacaattttagctattcgtagtgatagagacacaccaagtagaaactaataatattatctatgttcaaacagattttagtcaatttccaaatccttaagtacatttctattcattttgtcagatgagtgaaataggagtcttttgtatatcaaaagttcactgaacaattaataacatacagcacatatataaaatgctgaccaacagcaaaatatttctttagaaaataaactcttttaagttgtaatacataatatagaattacaatatattatgttgtacttttttattaggtaaaacacacatgaatacactacctacttttaagcaataggggttaatatttcctgttagagattagaaagcaatggttatcaactggattttataaaaccttacatctataacttctcaacaaattttaccttttatgattatcactattacatatttttaataaacacacacttctcacactatttgaaaataagatctatatcatttgggtttaagataaaagtagctcaaattttagtgagattttaatatagggctctcgatatgtattcatgtaaattatgaaggaatttttatttcctctttaatttggaaataatcactttttaccatctgtctgacttccttcccttcaaaagttttcatacaatattctttatgattaaatggatattcagcattccttattccttaaaggaaaatctttcaacttttataaatgattttatttaattattagactttttagctttatgttattactataatgtgtcaatttaaaatgtcatatgttaaattacatttttctttcctgtccactgagataattcgtatattctaattttagtcaatatttgttgataaaatatcttatgtttgttaaggtgaatatttgggaaatttcctgtcacagtggcggcaccagcaagcaattcatcaaagtatgagctatattctttgctctttagcggatgcaaaataacataaaatatgtctttttgcctaaaaagcaaaagtatggaaagtttctattaataacattaataaaattgagttcattgaaatgaattctatataggctgggtgcagttgctcacacctgtaatcccaggacattgggaggccaaggcaggcagatcacttgaggtcaggagttcaagaccagcccggtcaacatggtgaaatccccatctctactaaaaatacaaaagttagccaggtgtggtggcatacacctgtaatcccagccactcaggaggctaaggcacaagaatcacttgaacctgggaagtggaggttgcagtgtactgagatcacaccattgcactcctgctggatgacagagtgagactccatctcaaaaaaataaaaagaaattaattttatataaaacaatttaccctcatgcccaagggtaataaataaatgctattaaattatatcatcataatattaaaactgcaaaattgaagcacagaaaattcatgtagtcttttttggataccataagtatttgctaaatatgtattaaatgatctgcatcctaggagtttgaaatactttagcgaacagaattgacaaaatattcctgcttgaatgcttgtctgaaaattactataatgtccatataggaagatcatagtattgaccataaatgatcataaaaagataataaaatagctattgtttataggcctttttgtccaatatattatatatgttattacaatgtaaatgtatatatattttattttttacatataggaaagtaaatgcattgatatatttgtaaatgtgctgattaacttgtcactaattgaagaatcatataaatgaagatcattcagacttttcattcttcattataaatgaggaaagcaaaatgacaaaataaaagaaaaacccaaaaagggaaattttctaactcatgagtacccccatgagttttatactttttatatagcatcatccctaacttttttcatttattttatagaggttatcagatttattacaaagtatactgaccattcaattggttttatatgctccttgattgcttgcttttttatagtttatgagcagaaatattttagatacatatattaagatacagctacctacaaactattactgaaaacagaatatattttatatattagagatacatagattgtgaatcagtttatggcttgaaatttgttactgaaagttctgtcttttttaaaaggcagcgactttaagaagtgtttggttgcctaatagctgctgaaaattgtgagtgtgtgtgtgtgtgtgtgtgtgtgcgcctgtgtgtgtatttcgaagtctattcaaaatgcttgtccattttactgggttgcgaaatgggtataaagggtacagggaatttaatttaatctggttaactgaaagttactccatgcctttgagttggagaaaagacaagttgatttcttatgagtgaattatttgttattaaatgtatgtttttctgagttgttgctttattatttatatagataagtatcaaaatatgagaaaaaagattcatttgtcctatatgctaatggatagattatttttagctatgagaaaagagagcctaaattggtttgttagtatgttttgtcaaaatctagaaagaaattggtgttggggggggtattgtttaacttgttaaatgtttaagcttgttaatgatttggcagtcctgatggtttaatttaaggattgaaatatgtcatattctattaaaattaccatggcttagaattaataactgttgacaagagatgtagagtataaagccaaatatctgcttctctttatgtgaggacgaaaacaggttaggtggtcactctggggataaaagatatggccaccttcaaggggctttaggggaaaatctgttccatttccttttctagcttctagaactgctttcttatcatccttggtttatgcccaccttttccttcatctgtaaagacaacagtgtaacatggttgcttcaatcctcacatagcctttttcttctatcttcaaatctctttctgcttccctctgataaggatactcctgattacatttaggacacacacagataatccaggataatgtcctcaatatccttaatttaattgcatctgcaaaatccctattaccatataaagtaactttcacaagttccacaggttccaggaattggaacctcatctctttagtggccatcaagtctaccctttgatcatctggctactctctggcattctatatacaaaggtagccctccagttagcacatcaaaaagccatggttttcaaattaaattccattgcattcttaaattatattctactaattacatgaaattattttttctttgaagtttctttctaatcaactaccactaccttattactgggatattatctttagcttcaattatggcatccattttccatgtaatctgcctgtctctaaccatactcagtcctacttcatagcagccagaattacttttctaaaaattaaacacagctatgttactcagctccttagaaagactctgcttatttttaccattcatgggacaaaatctaaacttacactttggaataagctgttcactgtagtctgagatcaaaactccattttttttttttttaagacagagtctcactctgtcccccaagctggagtgcagtggcatgatcttggctcacttcaacctctgcctcctgggttcaagtgattctcctgtctcagcctcccaagtaactggaattagagcaaccacacctggctaatttttttatttttagtagagatggggtttcgccatgttggtcaggctggtctcgaagtcccgacctcaggtgatccacctgcctcggcctcccaaagtgctgggattacaggcgtgagccacagtgcccggcctccattgtctttcttatcacccacatcattccattcagtacaccatatgctcccactacactgaggattaacactactttacaaatctgtactataaaattaactccagtattttgcttggaaatctcccatttatcattcaggaaggcaggtgctaaatttcataacgatttttctcccttctgcaatgtataaaaatggctgctccatcttttgggttttcacaattcagtcttatttcttgtataatatttgttgtatggtgttaattttttaaaataaccactctatcccctcaacatgaatttgggcatgtgaaaagtactgtgcccagttcatctttgtagtcccaaagcctagaactcagcagaaagaagacattggacaaatgtgattagttaaatgaatgaggccttcagaggcaagtgaaatgaactagtgcccacaatacaacataaaagacaaatttgtaccctctcttcaagattacagccatatataacactagagtcctctcaagaaataatctttgattaaacaggaaattaacttcgatttttaaaataaatatgggtatttattattacttacagaaacagtaaaaaaatgtatataaaacacatctgttaacacttgacccaagatttttttttatgggaagtttaaaattactcagtgatgcagttgttctataaattttccactgccttgaaaactatggcaattttatattttcaaaacttgtttaaaaaataattttgctgatcaaataaatgtgttattctttcaaaatatatttatatgagtttcttcatttacaaattaaattttaaaatgtttgcaatttttctgatctaaaacctttgtatattcactcaaaaatacttttctccaatcaatctctttctccttttgaattgttacctgagagggtctgattgctttatatagatgctcgaagcagtattatttttttcagaaaataaaacaatcacattacctaggaccctcaatttggcttccaaaattctgcttgtcaaaagctggattgcctactccatgtttattttctttactagtcaatagccccattggctgtttttgtggttgccatggtgtgcccccagatctgtcttcatagctgaggctctcttagccccagcttcccagactgttggcagttgaaaactcatagctgagtctttgcctaggacctgtccttacctgaaaggagatgctttgctcttcttccaaccccagaccacatccaatcattgctttatatgaaggtacaaagaccaagctcttttccctcaattcaagatatctctaatgaggtaccccagctcaagcactttctgtgggattgcccaagatctctgttataattgctgttcaaattgtctatttctctttccttcactctctcacagacattgttttctgagtatttcacaatcaactccttgcgtgaaaaaaaaaaaaatctcatttcctaaaacttttcctggggaatctcccttaaaagagttggagaccggcatggcctaggacatggactgtaaaatgatgctttgaagctaaattgtcagctgaaagaaaaaagtctctgtcagtggttgcaggtggagtgtgaatggcccatagcatgctgtagtagggcaactgttaaaacttgctactagctggggactggatcaggataccagagaatgtctttgcaaatgcagtatcacacacatttgtgaggaacagtgggagtggaaatcacaataatgtaatcagatggctcttgctgggtatcattaaggcattgaaaaaggcaaagattaagggtgaataatcaccattttaaagaatgaaacttagggggtcactttggaagcatttagactccattcttggcagccacagatctgtaaaaaatgagggccaggtccaggacttacttctaaggacagtagagcccaaattccctggaacccactaggactgtagaagaagccacttcttttgcttgaagatggtgcagacatctctgcattccaagataataacatgaaactgctctccctaggatttaatcccacatagctagtgatgttaagattatatgataagccttccaagcaaagtcttccttcacacagaggttactagcctatctccacacatacaaaggcagtaaaaggtctaaacaattgtaccaaatgtgaagtctcaaaggcctagtagaatttcaccttggtactcttcagtctgtgaccccagatgttacctaaactttccaatctcatactatgtaaaattgctttagattgtcataccaatgattataaaatctgtggctttaatacagtagctatttctataataagaatgtaatacagttgttccatgaacaacacaggtttgaaatggacacatacatttataagcagatttttttcaataagtattgttggaaaatttggggtagatttgtaacaatgtaaaaacctcaaatatgaattgccaagcctagaaatacaaaaaaaaaaagttgtgaaaaagttagaaatgtaatgaatgcataaagtgtatgtagatactagtttatcgtattattcactaccataaaatatacacaaatccactgtgaaaagttaaaatttatcaaagactaagcaaacaaacacagatcatacatagtgctcatacatcccgagtagctgggattacaggcatgggctcctatgcccggctaatttttatatttttagtagagatggggtttcgtcatgttggccaggctggtctggaatccttgacctcaggtactctgctcaccttggcctcccaaagtgctagaattacaggcgtgaaccactgtgcctggccactgcaataattttataaccacctcctgtagctattgcagtgatcccaagtgttatgagtagccacttaaaacatcatgtgatgctaatcatctccaagtgagcagttatctctccagcaaattgtgcatcacagtaaaaagtgatttttcaaagttcttatagatttttcttcctgtttagtacaatacgtaaaccttgaataacaccactgaacccatatgaagtgccactagtgatgctgcaagtgctcccaaagagcagagaaaagtcatgacattacaagaaaaagttaaattgcttgatatgtaccatagaatgaggtctgcagttgctgccattttgagataaatgaattcagactaagaaccattgtgataaagaaaagaaaatttgtgacaccatcactgcagctacatcagcagatgtgaaaactgcacttctttttgtgaaatatatttatttttaatctcatatttaaaatgcagcttttatggagattcaggattgctctaaggaaggcataactatagactctgatataatgcaagaaaaagcaaaatcattatatgataacttagagcaaaatgaaggtgaaggatttcaagctggaaaatttaatgccaacaaaggatggcttgataattttaggaagagtttggcttaatacatttcaagataacaggagaagcagcttctgctgcccaagaggcagcagcagagttcccagatgccaataagaaaatcactgaggaaaaatgatatttgcctgaacaaatgcagatgaaagtgtcctattctagaaaaaaaaaaagccacaaaggacattcattagcatggatgaaaagtgagcatcgggacttaaggcggtagagataggctaactctactgttttatacaaacacacttgggtttattatgatcagggctgctcttatctataaagctgctacacactaagtttgaagggaaaaaaaataaacagcttccagttttttggttgtaaaacatgaaggcctggacaatgagaaacctttttctgacttggttccattgatgctttgtttctgaaatcaggaagtacttagcaagtaagggactacttttaaaaattcttttgatagtggacatgcccctagccactgacaaccccttgagttcaacagtgaaggtgtcaaagtgctctatttgttcttaagcacaatgtgtctaattcagcttctacataggggatcataagaatatttaaggttaattacacacagtactctctagaaaggattgtcagtgctggaagagaatcccgatagagagaacatcatgaaattgtggaagaattataacattggagatgcctttgttgttacagaaaagtaatgaaagccatcaagcataattaagtaagttcttgctgaagaaaactgtatccaaatgttatacaaaacttcccagatttatgatgatgccaatccaggaaatcatgaaagagattgtggatatggcaaaaaaaaagaataaagaaaaaacatggtcagggggtaaagcgtttctagcaatgtatcttggagaaattcaagagctaacacacaccacaccaaacaaattagcagaagaccacctgatgatgatttcttatgaaccagtgccagaagatgagaaagaagacgtggaagaagacatagaaaaagcattgccagaaaacattttgacattaggcaatctggcagaagagttctgattgctcaacgttggttttgatttcttttaggacatagactcttctataatacagctactgaaactaaagcaaatggcaggagaaggattggtactgtacagaaacattcctatagaaatgaaaaagaaaacagttatgacaaaagttactatgtattttcatgaagttacagaatgtgtctctctcctgcctctccttccacctcttccacctctgcgactcctgagacagcaaagccaatccctcctgttcctcctcttcctcactctagccaatccctcctcttcctcactctactcaatgtgaagacaataaggaccttaaagatgactcaattctccttaatgaatagtagatatattttctcttccttatgattttcttataacattattttctctagcttactttattgtaagaatagagtaatgcatataatatagaaaacgtgttagtagactacattactggtaagtcttccagtcaacagttggctattagtaattgtttgaggagtcaaaagttttacatagattttgactatttcaggggttggtgcccccaacacccacattgttcaaatgcaatttaacatgttacctaccaataaatattaatactaggcattataggtcttatctctaggtatgttctttagagtaaaaagcctactttcccaattcacctctaatgtatatgaatccaaattaaattaataagtgattgagaagaatcacaggtagaaaaatctgtaggcattttaatttttcaatatctccactatatcaggtatcattttaaaatataatttataataaatatggatctgacttcactattattttgtactatatgatttatagccctatataccgaaaggactagaaatactgttatttttataggagcataattaagtaaaattgcccaatattctttgacaaaataatacacctaggagaatctcagcctttcagaaaacaaatctataggaaagacatcttgttgattcacttaacagatacttactgactacccttctatgtactaggcactagccactgggcaaataatcaataagctatatcacatcattactcttacgtcataagtaagacatagatgtcttccttatgtatgtgtatataaaatcatcatagtctgtgctgtgaagaaaagggagtgttaaaacatacatctaacaataacacataatttagcttggcgggttatgtgatttttttatcacactttgtggtgaaaatagtttacttttctctctctctaagagtcccaaaggaagagattgtgtattgtttaccattctatattcattttaaagcacagcattgggaaactttattatttttgaatgagtgcataaactaatctagaaaaacaaactgagagcacataaagtcagtgattcatggagcatttattaactgaagatagtgctaagtctttcctaagtcttaaagactcaaagtgtaaactgcagtataattgtggaaaccaaataatggaaaattattctttggaaatattacctgcatttttcgtaaagcaggcattatttctcatttttaaaatgggctttattataatttccaagtcaaaagggtgaaattcctttctgttttagataaacatagataagtcaaattaaaatatgagacaaaatatacagaaagataattcattttttccctcaaaagcaaaggaagttttaaataacttaaataaatttagaaaacattcattgagaaagagaatatacacagcagcatgaaaaagcatttcacattggattccatcattacatttatgagcttctaagaattcacagattataagcacattatcaaagtaatttcttaaaatcatttgtttatatatttataaattgccttaaggaacaaccagagacatctattcaaaaatcgtatgtacagcataaagcactaagcaaaagaaatagattctggccaagttaaccaaaataaagaaaagtatgaaaggggatataatgtatttgaagactattgggttaacttacaataaaataagggaaaataaaagccttctcatgtaaaatccaaggtacttcttgtgattcaaacggtcatttttggcagcttgatctgaatcacctgaggtgcttgttaaaaatgatggattcttgagttccagctcataattactgaatcagactatctagtaatggcctccaggaatctgcatttttaaccccatcaggaaggataattaagcattttaatatttgttcttagagtgactctgctccaaagtttccaaatacaatgtttttctacaaatgtcaaaaatttgggggagattaaactacattttccactccaagttgcagaaccgtctctatcttcatgtccttataggatacatattatattacactgtcaatggcattatttgtgtggatacttctctcttaagttttccataatttatgagcttatttagactagcatcttgatagtctgtgtataccgcacagcacaaagaacaaggacttttcacgtttatgtgcttaaatgttacttgaattgaatgacattgataacatacaagagtaatgacagttttatgggtaagaatattacattgaatggacttcttggtgtgtgcataaatttaaaattgtaaaacttattctgagtcttattagttcattttatacaagagtaaaaaatgacagcaggctcatggttaaatttaatggaaaccagaggtccccagagaatcaaagtcataatcaatcatttcttttctcatatatttagtaaaatataccaagtttcaaaatctttttatttctctgaaaattgcatttgagattgattaggtcaggagctgcacacatttttaaaatcatttagctgctcatcctgatatctctctgagaatttctgatattgattagaaactgcaccacttattgaataagatataaaaacgataattttgtttttgacaacacccgcctgtattaatttatgtgcaaaaagacagctttccttgttaaaaaaaatacattactataaatataaataatgtaaaattcaagactcagagcaaaaactccttctctctgtgctgtaacttaaaaataattccccaggaggaaagggctctggttatttggacagtatatgtgagatgcagacatctgttaggatattttttcccttatttttttaaaaaagtttttgcattgtagttccaatctctccaatacgtgtcatattcacatgaatagctgtctttgcaaaattaaacaaatgaataaataaagccctgaagactcattattaacaagtgaccatttgtttcaaatattgtttagctaaaatagatatcccatataaactaagagttaatagaatcacaggggcctttaataaaattctgtaagaacttttgctggaaaagctgaatctcctaaaaatcccttcttttgatttttataattcataaattttcttttgatttggtaagcaaacattatcatttggtaataattattttgaaaataaacatttttattacatgttattgaaaatatatgttaaatgaaatgcctatttaaataaaactaaatactgtactaaaaactggaggcctattttatgtgatttttttaaaaaaagctaatttgataaaacattttatactatattttcagtaatatctatagagaaatagctgcagtaagttcaaataacattttaaaataaactagtttgactgaaaatatttgcctaactttattaaatgaatctattataatgatacataagcatttttaaatataaatgaaatgaactaagaatacaattattactgaaaagcaagtgacagtaaaagaagctatcaaactttacattgtttgaatatattgaaccgcctcttttttgacttacattgttcaaatatattcaacagcctcttttttgctgaaatttcttggcaagagttcattaataagtatgtgatgaatgtaaaataagaaatattcaaagtgccatgccttactattttacatattggcctattttataattcagagtggtgtttggtttattcaggctgctattaaaaaaaaaaacatgaactaagtggtttataaacaacagaaatttacttcttataattctggtgactgggaagttcaaaatcaagtttgctgacaaattcagtatctgctgaggcctacttcctaaatcataggtggccatccttctaccataactttacatggcagtaggaaagagaggactcccccttttataaaagcagtaatctcatttattgggggctccatgatctaaccaccttgaaatgctccacctactaataccattgctttgggggtaggattttcatatatgaattttaaggggatataaacatttagaacatagcagccatttttatcaagtagtgtttattatacatcatgaaattcatctccattcaagacaaaagagaactatgtttctgtcactaatttattggcataacttattttattgcaattcacaaatattgagattttttttttgcaaagggaaggtttgtgggaatcctgtatcaaatatacttatcagtactattattttttattattttttttgagacggagtctcattctgtcacccaggctggagtgcagtggaatgatatcggctcactgcaacctctgcctcctgggttcatgtgattttcctgtctcagcctccctagtagctgggattagaggcatatgccaccacgcttgcctaattttcgtatttttagtaaagatgggattttgccatgttggctaggctggtcttgaactcctgatctcaaatgatctgcccacctcagccactcaaattattgggattacaggaatgaaccactgcacgttgccttatcagtgccattttttctaacatgtgcatacttcatttctctgtgatacattttgttaattctcacaatatttcaaatgttttcattattatatgtgttatgttgataagtgatcagtaattttttatgttactattgaagttactttggggcactattaatcacacccatacaagatggcaaacttaaataataaatgttgtgtgcgtctgactacttcaacaactggctgttctctagctctctccctctgctaaagcttccccatatcctgagacataacaatattaaaatgaggccaattaataaccctacaatgacctctaagtgatcaagtgaaaggaagagttgcacatgtctcactttaaatcaaaatctagaaataactaagcctagtgtggaaggcatgttgaaagccaagagaggctgaaagctaggccttttgcaccaaatagtaagccaagctgtgaatgaaaaaaaaaaaaaaaaacttgaagaaaatttaaattgcccctccagtgaacatgcaaattgtaggaaagagaaagagaaacagccttattgctgatagagtgaaagttttagtaatctggatagaagatcaaataagtcatgatagtccagttaggcgaaacccaatctagagcaagaacttgactctcttcaattctgtgaaggctgagagaggtgtcaaagctgcagaagaaagtctgaagctaggagaggtgggttcatgagttttaaggaaaaaggctatctctaaaacataaaagtacaaggtgaagcagcaagtgacaatagaagcagcaagtgactgtagaagctgcagcattattcagaagatctagctaagatgattgatgaaggtgactacactaaacaacacatttccagtgtaggtaaaacagctttctgtcagaagaagatgctatgtaggactttcacagttagagaggagatgtcaatgcctgaattcaaagcttcagaggacaagctgacactctggttaggggatgatgcaatttgtgacttgaagttgaagccagtgttcatttaccattccccaaatactaaggcccttaataattatgctagatccagtcttcctatgctctataaatggaaaaacaaagcctggataacagcacatctgtttacagcatggcttactgaatactttaagcccactctttagacctactgaccaaaaagaaaagattcgtttcaaaatattactgtgctttgacaatatagatgatcatgcaagaattctgatgggagatgtacaaggagattaatattttcatgcctgctaatacaacatccattctgtagcccatgaatgaaagagtaattttgactttcaagtcttactatttaagaaatacaattcataatgctatagctgctgtagatagtaatttctctgatggatctgggataaataaataaaaatccttctggaaaagattcacaattctagatgccattaagaatattcaggatttatggacagaggtcaaaatatccacattaataagagtttggaagaagtttattccaatgttcacagaagactttgagggattcaatacttcagtggaggatggaactgccaatgtggtggaaataatgagaactagaattagaagtggagcttgaacatgtgactggattgctgccatattgtgatcaaacttgaatgaatgaggaattgtttattatggatgagcaaagaaagcggtttcttgaaatggaatctacttctggtgaagatgctatgaccattgttgaaatgacaaaatgggatttagaatattacataaacagttgataaaacagtggcaggatttcagaagatttacttcaacttaaaacaagttttactgtggatgaaatgctattaaacagcagcgctataagataaatcttttgtgaaagcaagagtcaactgatgcattaggaaaccaaaaactgtatgactcgctttattgctatattcgctttattgcagtagactagaatcaaagccacaatatctctgagttatgcccgtattttaacaattttatgaagtaaccaatgcgaacttaaaacaagatgaaaataaatttttcctacacagaaatgaaactatgttagtgtactagctaattaattatattattagttagtggcataaatctcaagattatgagaaacttgatagaactgacctaagtagagctaactgcccacctcccgtgggaaaaaaagaggaatcataatggctttcctgattacatttaatagcataattctgactgggaattacactttgcactacttttctttgtcttttttgagcagagcaggacctgtactctggaagcatctgactggaatgaagaatgaggagagaaagcaaagatcagttgttgacaggtagattaatttatagctgtaatggaataagaaatgataaggggaataagtaaaataaataacccaagagaatcaagatttaaaaagtcaagcaaaacacttattgctaacatataataaagataaaggactgttagttatgcaagagaagtgtttaagcaatatagtctcctgaaaaataaaggatattttaaaagatatactattgtatagattaattagccaacatgattaatattttttaaaattcccactaagttattgtgagttggacaaattatttttagtagatgataaagtaaataatattttcaacattattctgggatgtcaccacaataagtgatgcacaatccttggagacactaccaaactctttgttccaggtgatggtgtataatagaatctccttccagtaaaataagtgacatccttttagtcctctattgctaaatttttttaaaagaaaaggaaagaaatacagtaagactttctactctgaactgggcaataataaaaaatgtgctgcaagttttttctttccttctctataaaaaaaatggcaatgcaaattttattgttatttcaacatgccacaataatgtacaatcattatgaagaaatgatctcagtttaaatgctacttccccctttaaggcattaaaatagcacagaaaaatttcagaggaatcaagttaaatctaggtcatcaacagaatatatggctggtttcatgaaatggccccaatttgtgataagattgatcatattttaaattagtctgtagcctcaagataattctccagaatgccacaataaatatatatgtctttatatgctgtatatttattgtacattagtaaaacatgaattattaaatacatatttctataaatagcagctgcatttatattacagcatgtctgatattagctaatatcattgctttaatatagctgtattaatacatatactttgtgttcctatctccttcatattgaagaatgatgtaggtttatatgttgtatatgctttgttatgttttatggtgagacaatataagaatatcaagggaaaaatatgtttaaaatcattagcaatgtcaaactgaatgagaggacacattctagttttataaaactaatgatttctcaccaggcctaagactttaatagttgagatgtggtttgtcatcttccatttcatttaaaaatactttggaaattgtccatttgagtgagttaagataaaaaaaaacctttgaggcttaaaaatacccttaatttaaaactggatatcttaaaagagaataagacttttcaggaaggtactgctctcattttaaaacaaaacaaaataacaaaactgaggcccagatttaagtcgctgtaattcaatcataaaattcacttagaaaaggtttgatcaataaatcaataattatagaatttgcctaaggttataaagcctcggtggatgagcaattcattcctatatcacataattattaagcattgattttaatccaggcaatatactgggttttatagattcaaagataaataataaacattcctggctttcaagaactgacatgagaaaaagaatacgtaaagctactgaattagaatgcaaggtaatagagaaacccaagaaaacctaaaacttaagtcatattttgtcatattgctctttaaagtccttaactgacttccctctttttagagtaaaaatcaaagtttgtatgatagcctaccaggtctttcatcagctgcctctatgccttctttctgaacaaattcacttttgttcatgtttttttcactggagccacccttcacctccatttccatttcttgacagatcaaacatgcccttcttaccttcttctaaccacctggcaaaaatcatcatttcttctcttactatacccatatattttatcatattggtcaggtaaccgaagcatagaaagatgacataatttcctcaaaattatagatcctgtacatggttgagccataatttgcatacgggagtctggtttcagatccaacatcttaactgctttattttaaaccattttgttttactgcctcactagtaggggaatccaaaaagaaaagaaaatgcagaccatttttaaatggtttctctcaagaggtttcctccttggctttgggttagaagggaataattggatacaaaatggagggagagggggttgtaagtgacaatatggaaaacagagtttggccaagcttagaactactgccagatgttaccagtggctgtgtctccaaagaattaaaaaccagtaatatgaaagtacctcactgtaggaagggtcccctttttaaacgaggcaactctagatttcaataagaccaggccacaatagtacttgtagcaagagaaatcaagagaagagaaccatgccagcattaatatctttcctttccctctacaggattggcttaattagtgggtgtggcaaatgtaaatataatgattcagtaagcacaatcaatgttacactattcccatttttaattatgtatctctgcatggtacctttttcatgttggtcagcccattaaatcaaatatttaaacaaattgaagatagcaacaaagttttgaattactgtagtagaattaattcaaagaaaaaaagggaagacaaagcaagtttaattatagtgtattcgtgaatcaattataataacttaaatatgccaacactttagattactaataatgcaacattaagaatcatttatttactgtgttgctttttattctacattttatgtgtatgtttataatttaataacttctattagtaggatctgtcatgcacataatttataaattacatgtattttggaaatatatgaacaaaaccttgtattgaaaggagatcaaaatcaaagaagtttgaaaagtgttggcagaaggctgactaaatagggacatagaatcaattgtaattgagtcctaatagagacacattcaatctatatagatatatatgactttgaaaatgattttgagtgcttttaaaacacttaattgtattataatttaataatttaaagtagttatctcctatttgagttgatagatatcagaaaatattaaagattttgtttataatttaaacaaaaactgattttgttgattgtatttatgcttaaccttaataaagtggcaacttctgagtgaaacccaaaatacagttctaaaataatatttttgtatatgatttgtacagaatcgttacccttcagctgtccagtaacaacatttaaatctatacaagaaatctttgaaaataaaatccttatgatgcttgtcagtgcctgagaaatggatgtcaagcataaatctattaaataaatagatatcatggattaaacggttcttattttataacattatgaatttcatgtcggttttatttttcctccacactgatattctcgattttaaaaagataaagcgttcatattacgcatcatcttttgatttactcatagagtaccactgaataggaattagctttgaaagaggtcatctatgggcaaaatgtcaacaggattgctacactgcctagacagaataatgtacaatatgaagtaagtgatttaattaactgaaactgtctcagtagagtgcacttcttatctagtgaagacataaaaaagatagataactgcattatgtcaattaatctactcatatttcagggtgaatataagaaatgcgggagcatatgagctatttgtgtcaggataaatagataataaatatatatagcttcactcaattgagtcaatacaaccagttttccccccacacaaaacttatacttttgatgtttccactcataaacaatgatgcttccaacataatatttttaaaaactcttattacaatttttaaaatcattatttaaagatatttggatactattataaagcccatttaaggatttctcctactttttacttctgttgtactagtatgtgttaatggggttactatgaagtggatatgctgatttaacaacaggtgctgaacattttcttgatgaacattttctaggtaattttttttttctgctaagttttaagactcaattttgtggttatttctccctgttttaaacatggtgagataatctcctgtacgctagtccttaaacagaaaagtcataaaaccatgagtctaaagaagaccagtctttggcacaagtttacatgactttgtagcatttaaccaccaagctcttaaacacctggcatagagcatctttatttagcaaagtgaggaagcagaaaagtagagcgctgtctaaagtaggcagagactactcaactccaggaatcctgtttgtattagaatcccgtctggaattacgagatctgattattcaaaagaaaatgaaaatcctgattcttatatgatgaaatgtgtccattattaaattttgaaaaatgattcaaacttaaaacattgtagaccaactaatgaaaggcaaactggacttctgaggtcagatatagtctctgggccctccagataaactacccttgacatctcccttccaatcatgtagaagcagagatgaccccattacagactgattctcccattggatggcttttcttctaaaggagcagagaggttaccaaactatcaactgaaaactaaaagacatatgataatattttccacaccatttttgtgaagaaggatatactgatgatgactgtcttggtagtaagatttgaaattactttttaaaaaattttaattgtatttgtccatatctttttaaactgcctacaaaagaacatgtattagtttttcactcagatttttaaatgttattaaataattatgtaaaaattaaaaaaggaagttcaatgctctgtaatcaattttcgtgtacaagaaaaacaaggcagtggcatcatttgaaaataagaaagaattagctagctatacattattgatagacgagactattttaaattgtaaatttatttatgatgggtttgtaatatgtcctacccaataaagacaactgaactccctctgccttacagtgcagccagggacatatcttcttagtgaacttatttctgtgatacgatccaggttttattcttatccatccctccagcagccttactgtagcaaaatcagtttcttgtaacagaaataaaagtttctttcttagcttccggaaattattgactttcaagaatttttgagattctgcctccctttaacaaagtacaaataaacctctttttaacattcagacaatctaaaaacttgctgaaaatcagacaatgaatacctattggagcctcccttgacatatattaattttctggtacaatcttttgtaaatatttaataattagctcctgttttatgaatatgcagatgtaggacaagccttatatgaataggtcctggttgtagcaattgaactgatgcaatcacatgtcatccctgaaaacaaaagcagatgccactgaagaccatccttgtcaaaatatttccacaagcctgcgaaaggtcttaacctatacaaatgttatgactttgcttagggctgtaatttcttctttttgaactcaagtaacaaaaagaggatttgtcagttgaatgaataagaagaagtagcaaattatttggggatctgactaattaagcctatcaggaagtacctcaggcagtgtcattatttgtttagctaaattgtcagtctagacaatgagggagtaatgccttattttatttttcctcctctatgatattttgctcaactgcatattctaagctgctctagaagaattcacttagaacaattctatcttcttttattgaaattaagtcaaactctaagtgaggtctaaaaataaatttaaaaaaccttttttacaaaaagataagaataacagtcatatagtgactgaaaaaataaatttctttaaaataaagtctgatttaattagggttgttagacaaactattggacacaatatgagtttcagagaaaaactgattcttttactataaatatgtcccatgcaatatttggacatctgtatttttgtttgctgaatctggcaatcttagactgaatttatgttccggagaaagtgtagagtaagtatgtttaaaagagggttcagaagatttgtataaaaactaactgtggaagtcggcctcagctctttagatatatgcctgttctgccacaactgtccagcagtctgctctactcagctgcttctacttatcacgttttccagaatccagctacgttctgtcacagctctccatactcatatctcaatgtttactgagaccaagttttgatttatcattatcatatggaagaatctatatcagataacttttttaaacttgtttattctatttctcaatattcaagcaaataaagggttttgcaagcctatattcccatccacaaaggaattgaggtataccttaatttccattataagaaaagaataacgattaaaaaagaatatagaaaaaaagaaaaacttttatcagaaggtgccaggcttattattcaaagaaatcttgtttcatttcctttgctacatctatcttttttctataattttcatctaatgtagcaaataaaatatacacatatgtaaataacacatacaaattcctatgtcaatttattgtataaatatcactcacagaaaggtgaatgaaaaggcagtacaaaataaattcactttatttcacaattttaacttgactgccttgaattattggaagatcctttaagatgtatactgtaaaggcagtcctatgcaatttttttttttctaatacttcatggtgtttcctgcaatgtttcccagatatctacacaaaaattataataatacttactatggtttgtttttactttttgtttctatgtattaggttcttcattcatccaattgtctcctcttagaaacaattataagggccaaattacagttagactaatacacagtaaagttaaaatgttttgcacattatatttcttcaccatttcatactattaattttaaattttagttaaaattgatgtattttagaaatgtttttagtttgtctcagaatatatatatatatataactcagaccaaaaattctagtgtagttgttctgtctattccatttattatatttaagcctaaagaaaaaccttggtggcaaatgacagaaatctgttgattaagctcattgaattggcaaaccttaagaagagagtactctctttttccattagaacatcacctttctgatggtaaaagtgcagtaattgatactgtttgggagaagtgactagaggtctatatccttaggaaaagatttcaaaagctttggattctgttatgttttattatcaatatatttagaattctagttctaaattcccttcaactccagttattctggcgacaagcagcttttacttgtatttcaatctctgtggctaagtcctatcacctgttagcagatgatttccggaatcatcaggttcttgctacacctctcagtgcaagcttccatgcagataagcattggctgggtgcagaatgctgcgtataaaatgcttagaaacataaatcactgtggctatgcacagtccaatacttatgcactatggctctgcaactgaattctctgtgggggatattaaaaacacagagtctcaacctcaccttctattcactaaatcagaatccccaaagcgggaataccaaatatgcatgcagtttataactggcacaggtgattctggtgtattgtagagactctgaaatactgatttgctcttggaatccttgtccttccttgttttgtgagtcctgtgggcagctgaactcaaggtctgatactttcagaggtacagcatatgtaggacagaaagggaatcttgggggaggcatgacttgtgctgtatattccccgtgtctccttgtgaaacttgcttcacttctatgaacattacatttttctctgtgaaatataccttctatgatataccagtgaactataaaagacatcctggaaagacacacctcagaacaaagtgggatttatattttctgaaaagcaaactagtccttgattgtatatagtaataagaatttaaaaaagcatagaattggtaataacactctaaacccacatgtatgtgtaaattcattttcatatttaatacacttgtgtttaatatagtgttatatttaatatacttattgtattaaatatattatgtttaacatgatatttaatatactcatccacatttatatccacaccaatcccattggtctcttttgagtttttgtttcaggcttttttaagaatgtagggcaaagttttggtcttggtcttttaagcacagcagctacaggaagggagattttcttgctctgagagggcaaaaaaaaaagaccagcaacttaaaccaggggaactgacctaaaaggctgtgccactgataagattcacttggacttagccagattagaggcttgatacctggagagagagagatcaggctgaggtgttttgctttgtgtctatcagatgcagagcatttcagcagaaatgcagcaatctcacagcaagccttaaaaggtggcccaagagcctcagcatccgatgatatcatgtcaaacaaatgctatcatgtcaaacaaatgctatcagcatctgggaaatctctggaatctgggcatgagtatagactctgtgagtttcttactctatgaaaaaatctaaaaaaagttaaaagacgtacaggtaaacacctgaccattcatttcttctttccttcctttctttctctcttcctccttccctccttctctccctctttctctctctgtctctcactcagcaatctgcaatgtttcaggcattgtcataactcagccttgaggatataataattttaaaaaatattatagagcataacctcatcctcaaagaattgacattagtggttaaagtaaataattaaaccctgacaaaatattgttaagagttagcagtcttcataataggtattttattttgtactttcttcaaagttttcatgtaaaaatataagcttatatattatttgatatgaaaatatattaatatcaaaacacatgatcagtgaagaaattatttttaacacaaaagtgactgaattacagctcacttccatacacttgaataaaataccctggcttggcaaatcagtgtaagagctttagttcaactcagagaaacactaggtgcaccatagttaaatcattataatcataataaaacatggtatatatctattaatgccttgtatgggacaggcattatgttatagattcaacataaagtaaaatacatgaagcattttacatttaatttgtgtaacaattccacagagtacctgctatgaatatgtttattattaaaattaactgactgaggcttagaaacgttaaatgacttgttcaaggtaacacagctggtgaggccaaagctatttatcccaaaggccctcttctcttctataagcagacttttggttttaaagagcacactacaaaatttaaccctactgtagtcaagatgatgccatagatcattctctatcagttcaaatcaaggttcttcatcaatttacaggaagaggctatttactggctagctgtaatatatatatatatatatatatgaatatatatgagaaacaggaagaggctatttactggctagctgtaatatatatatatatatatatatataagaatatatatgagaaacatgtaatacataaaattataatatatattatgttataatatatcatatattttatatttaagaactatgtaatgtataaaaattatattatttaatttaaattaaataaatataaattaaatataaattaaatacataattataaaaattatattatttatttttatacattaaattttatatcttacatatttcttatgtataaattataatataattttatattatatataattgtatacattatatatttcttataaatataaaaatatataacatagaatatatattcatacacacacacacacacacacacacacacacacactcacacacactataaccaagacaggtttattgtaggaagtagctggtttcagctcaagagcttgattttagaaaggtgttaagctctatttatcgtaggatggttggcagaagactaaagaacagagatacacatattctctatttgtgtaggtacacacaaatgtacaggcatacttgcacatgtgcttgtttacacatgtatctatcaactcccaaatcctaaatttcctatttattttttacttttaataaactacctacagacaaatgaggtggttagaaataaacagggacttagaacacaatggagttatttactgaggctattaagttaataaattgctaaaatcaatctgttctgaaagaaagtgtgattttatttctctatgaaccccttaaatgcatgatatgaacacagtgtacacaacacagcggtttttagaaccaatttttatatggtcaactaattaaaaatggtatctaaatggcatataaaatgttttctaggaaaaaaagtggaattcctgtagaatgtaactattgattgatttctcagaaataaattgtgaagctcagagatgagtcccatttatagttatgtaaatatcacaaataataacggtaaagtgcagtgtttgttttgaaatcagcttaatttgtctcataattctttcaaaataaattcatttctttatgcactttggctaatattggaaatggaaatagtattcaatcagttctaaatcattttttaagctagataatttctggaaagtgctgacttttgttagaaaatctgaaaatggaaaattcctctcagtgatctgctatgtcttcacatattatttatgaagttaatactgcttcatggatttcttaaatctcaaaattcagccatctgtaaacctctcttctctgtaatgaatcttggaataagaaagaagagaaaatatgttttagcttccagaggagatttctgaagtccaaagcattaaagctcacatacttgtttactcaggtgaatcaacaagtctttttctcaggttctgtttgcttttattttgcatgtaatcctgataaatttaatcagtttcagagccatcataggttcaaaacaatagtttaaaagggaagaaataaggttgcttcagataggcatagtaactatgattaaaactgacaattgagggggaacatattaagataattatacaggtcatcagatgagggaatttaagttctattttagtcttacatcatacagggaaaagaattccataatctagtttattgtagaaatgacagaaagctgacctctatcatagttaaccatagttataaatgtaacattaaattatgttcaataaattcttaaagggaagattggtataataaaaagtagagatctgagtaatacattgtaggcagattttattctatataaacatagcaggctgtttaaaatgggcatgaccaaaaaactttattttgtgttacctagtcactgcagtgcctcttttaacaataggttttgaagttagctaatacatcaaggtttagttcaagttttggctacataataactactgatgatgttgcagcaagagatttaataacagatttaagtgaaccttttggatatcataataatcaatcagtcattgattatttttaatatgctcataatgatttcaaacattatatccagcctctaagagaagctataatttcatgtatggattttctgattagtaaatgccaatacatagggagactaacacttcactaatttattacaatagtgtggagaaaaccatatattattatctctcccacaaaagaattggaatagaataaatagactttattctgcttgtcttaaagacaaaaacattaaaaccgaaggaggaatccacaagaaaatagtacttaatgaaggaaagatgctatgaaatatgctgttaaaaacagagaggatgaatcagttttatcattttccaaatttttcagatcatccattatttcctctttaaggtactaaataaattgtgaattatcaatacacatgaaatagaaatctctgtgctttactcagaatatcacaggaatttagagctagagagtgctatctagataactagttcaatgattttcaaatagaagtacacatcaaaatcacaaggcgttataaattatctaaatgcctggacccatcatctgaatcagaattttaagcacgtgtcttttcaaaagcaactccctattttagaacaattgagtccagctcctacattttatggaagaaactgataaacaaattaaaatgtctaataataggtatttgcttatgcatattttgacactaaaataaaaaggtatatagtctttaatgtaataaaataaattggtatatagtaaacttgtatgaatactataagaagttttcatttcgttttatgattctaataaattggctagttgtgaatcatagaacaaattcatgtcaaagctagacaatcttcaaatgctgtctctgctcttttaagttctctaagcttacaagttgtttaatctaataaaaataaaaaaagttaagaaaatatttattcttagaagtttaacattttagactaaattccatagaaaccattacttaaaagcaatattaatataaaatatatccatttaaaggctatatataagagctaagatatttcaggatggattaattttgtcacactccaaagtatctgagaaattaatgagaactaaatgtgcttttgtctctctttttgctacaaaaattgaatttttcctttctttaggcatattcagatggctgtttgtgttttgagaattctggaactccggagctctgatatgagtcagattctctgtgttaatttccaacaaatgtgattaagcaaatctttatagagaaggaggatatgaaagaaatgaaggctttagtatttggacagagagcagttggattgattccgcactgatggggagtttgtattcctggagaaagaagagaacctagaggtttttgtggttccaacttggtatactgaagggacaactgggacctgaccactgattagctaagcatcatgcccttgaaggcaagggtacagagaaggtcctgggagccacatttggtatgcaaggattgaaaccatttcacagattaacatatttttgaaaggagcatggagataccatataggcattttattaggagccaagatgaactgtatagcaaaggctgttccccattaattctggattgatccacctccagtgtttactcaaatcccaagggaaggaaataagcgactctcaaataattgacatgtaccacattttcttaatccagtctatcattgttggacatttgggttggttccaagtctttgctattgtgaatagtgccacaataaacatacgtgtgcatgtgtctttatagcagcatgatttataatcctctgggtatatacccagtaatgggatggctgggtcaaatggtatatatacaccatggactactacgcagccataaaaaatgatgagttcacgtcctttgtaggaacatggatgaagctcgaaaccatcattctcagcaaactaccgcaaggacaaaaaatcaaacctgcatgttctcactcataggtgggaattgaacaatgagaacacatggacacaggaaggggaacatcacacactggggtctcttgtggggtggggggaggggggagggatagcattaggagatatacctaatgttaaatgacgagttaatgggtgcagcacaccaacatggcacatgtatacatatgtaactaacctgcacgttgtgcacatgtaccctaaaacttaaagtataattaaaaaaaaaccaaaataatgaaaaaaaaattgacatggattttcaaccatatggtggatgaaagtaaaggtagtttttttttttttagaagacatataaattcagtttgtttttgcatctgaatgtttgggggaaaagttaaacctgtagtatacgtgtgtgtgtgtgtgatgtgtgtgatatttatatatatatatttatatattgcagagttgttccttccacattagttctactgcactatttttgtttcccctgctgttatcaaaaataagcattcattattcatgtaagataaagaggaaaacgaaactaaaatgagaggggaaatactagattaatttgatcatacatatttaaataaccacaagaaatagttattctcaaatatacataacaaagttacactagggaatagatcttactatacacattcttaacatttgtattttattatatgctagactttcaaaagattattttttcctcctattgttttcttagatttactgaaccataaagaaaggaaaagaagaaaactggctcattgttacaaatcacttcctactgtggatttgaagtcttcttattttctgcttttcatctaaattcagcatcatgatgctgcaatacaatcaaaagaaaatgctgtaaatataaaaatgttaatttaaagctatacacataccaggttcaaagaagatgcaagccacatgtcagtgggattgcctgggttcatctggacagtccagctcatacaacaagcaggccggtgactctttaggcaaatgcgaatgttttatagattaaataaatcatctttctgtttttttaaggttattaaatattctgcagaaaaatccaactctgtgcctttctaattttctcttccacttcaaatccttcacattttatgttttttcttttaccaatgagttagtaaaagcaagtaaatataaaactcaaaaaattatgtattatgtctaatccaggctttattttaaaaatatgaattttggctctttttatatgacttagtatctttgtactatttttgttttattattatagaatgcattgttttccaatagtatactatttattcatacacaaaaaggcaatatttaacaagacatttgagcaagaaagcattaactcaaaattcagggctcaagcctacatatattccatcggaaggaccggccctttactggctcctgggagataacctctgaatttggaatatcctgacagataataatgtctttgatacctgagacctcgagctgtgccaaatagtttatgctaattagatgtgatttatgcttgcaaccctttttttgtatgcctagggctttggggcatgctgcatcagcttggcccctgcaggagctggagactgattagctaaggtcagttatgcaggtgcttcatgtcatcatgactgacctacagtgaaaaccatagacaacaaggcttatgtgagcttccttggttggttacactttatatatgttgccctacattgtttctgagaaagtattttaagtacttttcatgcaactccaatgggagaatacacctggaagactgtacctgctttatcttagactttatcttatgtgtctttccctttgctaattttaatctgtaacttttatagtaataaatcctagcaaaaagtaaaacagtttttctgagttcttcttatacattatcaaacctgagggtagtctttaggccccagacacaatatctgaaagctatgaaatgctttgagctttaatattttaagcaatttgtggtctccataacaccatttcttggaaggatatcaccagtatgatgacatttctgttcttgaagttgatatatgacttacagttaggagttagataatttcaatagtctccttatgttaaaatatatttaaaccagttaataagatgagaactttatctcttcttcaactttgcttctttctgcttcccccccgccccatattcttattatcacaatttctggaaacaggagtcaagattttaaactatactacagttagttggaatagcttcttagtggcaattcataaaatagataaatgagacaagaatatccttggaagttctgttatttggtataaggcaagatgtaaagttgtactccttgacttgtcaaatgactggcttaatgtcccacagaatatctgtggcagtgtcaggtctgaaagtggaatcttatattacaggtatggggttctttcttctgtaataaactcagattattcctgaagttactgccaaaatcacaacctaaaataaagcgtaattacattatggatgtgtacattagatgatttacctgcaagtaaaaggaactctgacttcagtaatattaaacaagaggccataaggatcaaatatattaggtccagaggttgggcaggcaacctgagaggttcagtcaagagttcaacagttgaccacaggccagatttcttttatctctaatctctgctgttttcaggacactcactaataatagactaatagtttattatattattatttaagtagttaatagtgatagtctaatcaactatacccccccatcttgctttagggcctcaaaatggtaacagcaactacataaatccagatgttagaaggtataggagaggtcacgcatacttttcctcacattctaagagcaggcgacgaaatctttcctcagaaagaatgcctcccttgcctcagagaccagcatagtgtcacatgtccacttctaaaggaatccccaagagtgggatgtgattaacatgactgccttagataaagcatgagacatggaccaagacaaagcaaccagacaaccacaaatacttgaaaagtggctagacaacctctggagtaactctgtttctggtcatggatatgtaaatgcgagttacagttattccattaggtatctgcagtccttgtgggaaaaaacagtttgccacaaatgttccttctattgtaaaaacaatgtcagtgcactgacagtcaaaatatgtggtggctgaaaccatattttggcttttcaaaggtttgcttttaaagctttgttttctaacttcaacaagtatagtcttcttgcaaatatcagttctgttgttaagtaacaaactataagcctggattagtattgtagccctgacttgtgttgtatgttgcttattttctgaagccagtcagtgagtgagtccaccttgagtaggtgtttttatgtcaggctttgtgagaaatgaggagccggaggggatcccaaatcaattgccaaccatgtcacagatcatttaaggcagaatggaacatgcttgtgacaaaggtgatgacaaatgaatatgtactgaagggacaacaccaacagatgagtgaaggaaactggaaatatgtaatatgagatggaggtcagagtgaaatgtaagataatgataatgaaatacatgtgtgaatgtaataccatgagttagataaaaataggtggccgttaagactcacacagtgcctttcagaataaattctgaaattttacacaaattcaatattgccacaagttgtgaatccaataagtgaacagtttgttatataatatttaaaccaacctgtatagagtggagaatagaacatgttttactacctttaagttaaaaaaaaaaagttgcttgagtttctgttttctaaccttgagaagtaagcatatgtaatatatatactaacctaacacacaggcaaaaactcactctatttgtacataggtgttaaattatattagtccacatttaggtatataaaaagccagtggatactaacgagatgcaggtctttgcaggtagaattgtgctcacaggcattcaggatgcagtcatcaatgtcctgttcacatcttatcccaacatagcctggattgcataagcaggaaaagccatcaaccactggaaacaacagaaaagagaaaactcttaacattcctttaaccttagtacaggtaattataattagtctaaaattctataatcatttatgtagttcacttttaaccaaataaagtaagaattattatatttaatcgattacatagtcatctacaatattttctaaataaccatcttattcagttctatttaacttaaaaaaaaaacttcagttagttgaaataagaacaattactatggacatttggtaatagtttgcaaagcaacaatgaaaatatccaattttacttgctctctcttgtttttggcagtacacaatatatatgataaataggttactcttgtatcatttaattttcccaagttgttttaggtttaataaacaagaccttaactgttcagttgttaaagttctatgtatgacagaatatattaaagtgcattgtgatctcaaagttgataatgagctacttaagccttagttaaaaagagctttcacgtttcatcaaaatctttgtaaaataatgatcacaatttgttcttcattttaccattaatgatgaaaaagaatggtgtctgaagcatctcaaggaagtagtgacagtatgaattgcagttggagcaggcaccaatttataactacttgcagtcagtccctgagtccttcattatccctgagatttaccatgaaatctatactcccattatgcctctctgcatgtacttgctattactctcattaaatgcttaggtcttcagtggcaacagcatttttaatgcactgtaataaatgtatctagcttctggatttttgcagccatgttttgtacaacatgtgtaactagggcctctaaggagaacagggcagtcatagacatcaacaagagacaagtgaaatacacaagaataggcagctccttagacaggattttacttctgttttactttccttttgtatctagcacctagtttttaacctctcattgactacaaattgttaataaataaacagatgtaattgtaaatgaattaatgtgataaaatgtcagtctgtgcttctatgttacacatggtattttttattttaacatattaaaaccacatattatacaatatataattaagacattgtggagtgtcatcaatcataacaatatttaaaattatccttatggttattatttaagttgggatactgatgcatactgacaagtaacaactggagtcaaattaactttcagcattgatgttacgtgttctatgaagacaaattataaattacattaaacgcaaaggacaacaaaaggtcactttgaacaaacgaagtgtctggaaacagattgttaaaaaaataaagcatgcttttattgtcaataaatgtgtttctaacatagattaatacagacaaggaatgtgtttctaacactttattctggaataaaaattaataaatggactaagtgccagaagagaacctagagaactaaattggataccaaagggaaatcggatactgcaaagaagatagaaaaaaattaaatatttaaaacaaagtaacaaaaagtagagggtttttctcatatgtaatttgttaaccacggggctatgtgataaccaataaccatttcacaggaaagacatgttatacacatagtcttgctcttgattgttgttgttgtttttaacagaaaatctagtcactgtgatatggaagtgctggaatgggaagagtgtggtccctttaaatgatacagaagggggaagggaagtgctgggtagaggagggcgtggtccctggctagggctccacccccatggatctacgtgaggacggcactcctgcctttatgccagaatgttgcatttcccaagaccaccctgtcccaccctgcccacatcgtgtgcctataaaaaccccggagaccctagcaggcagacacacatgtggctggatgtagtgagaaacacatcaggggaagaagacacagtggcacctggacattgagaggcacacatcagcagaggaacacacaggtggctgcacatcaggaggaacgcactgacaagcgccggcacgctggagctccagaacaacatggagttttgccagggcagtcagaggggagcccaggacgccgagcaccccaactccaagggaaaaccacctcccttctggcttgcattgtctgagagctacttccacccagtaaaaccttgcactcattctccaagtccaggtgtgatctgattcttctggtacaccaaggcaagaacccaggatacagaaagccctctgtccttgtgacaaagtagagggtctaattgagctggttaacacaagccgcctatagatggcaaaactaaaagagcaaaactaaatgagcaccctgtaacacacgcccactggggcttcaggagctgtagacattcacccctatgcactgcggtggagtcagagctccacatcctgcctgtctatacgttccgctagaggaatggggcactgaagaagcgagccactccccctgtcacacaccctgcaagggggaaaaaggacctttcccatttcaactgcattggtattagtctgtgtttataaatatttcatactactattttgaggccaaattttcttaaaataggccttctatgaatctggatgtattattcattttatgcttaaatgtgtaccagacatcatatatactggttgtactgaatgaaagtttgtaatgtgacaaaactttttggtggaatatacagaggtattttaaaactgtaacagcaggccaggcaggtggctcacacttgtaatcccagcacttcgggaggccgaggcaggtggatcattggaggtcaggagttcaagaccagcctgatcaacatggtgaaaccccatcgctactaaaaatataaaaaaaaaaattagccgggcttggtggcacatgcctgtagtcccagctacttgggaagctgaggcaggacaattgcttgaacctgggagacagaggtcacagtgagcctagatcgtgccactgcactccacactggaagacagagcaagactccattaaaaaacaaacaaacctgtaacaacaaaatggtgaacaaccgtataatggtgttcaagatttacagactcacacacaaacacacacatatatgcagtgatttctcatatattgtcctgtaataaatactattgacatgctagagttccctgatccctctcgcaggacatgcgacaggggtgtggctggcctgctcagttgccgcagctgctgaaaccccttgagggagggggaccacgcagataggcaggtgcagaggccagggcgagtgctttgggctctggacctgtggtagtgtctaggggtggatgcctgcaaccccagtgttacaatgctctcagccttgctgtccgcagatggctttaagggttaaccagctgaatggaccctctgccttttcacaagggcagaaggccagtatgatagctatctgtatcctgagctcttgcctagcgtcccggaagattcgggtcacacatgggcttgaaggttgaatgagagatcttgagtggtggaggtggctctcagcaggatggatggggaagtgaaagcaggggatggagtgggaagataatcttcccctggagttgggccgcacagtggccaaactcctctctgaccactcccaaactcctcttggtattcagatgttcctcctcttctctctttctctgcggaagagtccgttggtctgcctgtcttacctcttcaacttccggttcactctggagtctgaggttcagcatttatctgggtacgggctagggagcatggcaagccaaaaggcaactttttgggtggaaaaacaggaatgcctgttctcatttatggctacgggtatccaggcttgaggatgcggcctttgccagggcatcttgtaccttcttctacccagtatttccgtgtcttctgtctgtattactattaactagaattcaggaagtttagcttcccaaaccattttatttcagagaaagtatgaagaatctagtgtcttagtttcattctgataacattctacatgtgtgatataaattttaataaatattttggttgcctggtagctaaatatccttagatggggtccaaaatatattatgaatgattatattatgaaatacattaatatattaagtattcaaattttacatttcccataatatattatggtttcaaaattttaataggtagtattgcattataagtaacattataaattgcattttcatatcttagaaaaaatcatatattaaaatatttatgaagaacttttaaaagtcaaatataatacattgttaatcaatgtgaacaatttaaatttaaattgtctattataatcattatagtagggctgcctacatatttcaaaaacaaaaaatctctaacttctctctcagccatgcgatattttaaaatgacatgaatcttttttaagtatcattcctcaccagacacctgtgggtttgagctcagaaatgatacaatactgacttacttcaaggtaatttgagaatttcagaaattttaaaatacaatcttggaagtgccaaaatctggaacaaaaataataacttggtgatttatatcaagagcagcaaaaatatggcatatagtccacagaactgttttgctcagctggcacaatgttagaaaattaacgtgatattagtatctatacagatatttcagtttgctagggccccaccactaccttttatatctgggttcttttatatctgggtggcttcacccaatttacaaaattcaattgccttgatattggcttttatttgcacagcacttgttttgagaaacaaatttaaaatttgagttaaatcctactgtttctaaataaaaagacaataacataactttctattgaaatgaggttttatatgtaattttaactatttattcatatattgaggtgttgtgggaagtcagggaccccaaacagagggaccggctgaagccatggcagaagaacgtagattgtgaagatttcatggacatttattagttccccaaattaatacttttataatttcttatgcctgtctttactgcaatctctaaacataaattgtaaagatttcatggacaattatcacttccccaatcaatatcctagtgatttcctatgcctgtctttacttcaatctcttaatcctgtcagctgaggaggatgtatatcgcctcaggaccctgtaataattgcattaactgcacaaattgtacagcatgtgtgtttgagcaatatgaaatctgggcaccttgaaaaaagaacaggataacagcaatgtttaggaaacaagagagataaccttgaactctgaccgccggtgagctgggcagaacagagccatatttctcttctttcaaaagcaaatgggagaaatatagctgaattctttttctcagcaaggaacatccctgagaaagagaatgtgcacctgggggtgggtctctgaactggcccccctgggcgtggccatctcttatggttgagactgcaggcgtgaaatagaccccagtctcccacagcactcccaggcttattagaaagaggaaattcctgcctaataaattttggtcagaccggttgctctcaaaaccctgtctcctgataagatgttatcaacgaaatggtgcccgaaacttcattagcaattttaatttcacctcagtcctgtggtcctgtgatcttgccctgcctccacttgccttgtgatattctattaccttgtaaagtacttgatgtctgtgacccacacctattcgcacactccctccccttttgaaactccctaataaaaacttgctgggttttgtgtcttgtggggcatcacagaacctaccaacatgggatgtctcccccggatgcccagctttaaaatttctctcttttgtactctgtccctttatttctcaagccggccggcacttaaggaaaatagaaaagaacctacgtgaatatcagggcaggttacctgatactgagggatcatgtagaaatatattttaaaggaggtgagataaaaccaaataagatagttttttgcaacacccttctagacctttgtttatttctgtttctcctttttatgcctcagccacattctgtatataatgtcatttcgttttctgtgtctcaacaaaattacccattttaggcatgttcttccacagaaaaatccatgtttccatcttacttttccctctttccttcttttcttcctgtctttttcctctataaatttatatttttttaggaatataaatttcagtaggaagaagtgtgagtgtgtggggtgatatatgtataaaataggctaaactaatgttattttgaatactgtaaacaatgctttctcatgcctaagggtgaatatttttaaaaattctaccatttcaaataaaattgcaaaggttaattctgacactagaaaggaaaagtcacatttcattagatttcctcattcgctgcacttgtgactcacaaaaatataaatgaatttgtcagaaattgggggtacttagtgaagataactgacattgactttgatgttcaagccaggctaaagtcagtaaataatcatggttatatcctaaactctcccattactatgttacattctacaatggtctgctctacaataattgcagccgctgaaggaactcactgtcatagcaatatccatgcaggcaagggctggaactgcactcattgacattgatctcacagcgtggacctgaaaagctggcacactggcaccggaactcaaggggaaacatttccaaatccattttctctccacgcacagctccattctcacaagaatcactagctttgcaaggtccaaattcacagtgataacttggaaaagaaagaatcaaagtgccaatgcttattgaatgaaccaattcttacaactgctgtcattcacctggcatatttcagcataaaggcatccaatttattctctattctcttccatattatcattgtgactctctctctctctccctttccctctacattacaatttaagaaagaaatgttatttatgatttctatgcttcatctaacaaagtaccagcaggtagcaatgataagtgacagcatttttaaaaattatattttgtttcttcatacttcccacttcttgttcaacaatgttctctgaagacattgcaattaagaaagtagattattgggcaaccccctttgggtcccctccctttgcatgggagctctgttttcactctgttaaatcttgcaactgcactcttctggtctatgtttgttatggcttgagctgagctttcgcttgccgtccaccactgctgtttgccactgttgcagaccagctgctgacttccatcccttgagatctggcaggatgtccgctgtgctcctgatccagcgaggcgcccattgccactcccgatcgggctaaaggcttgccattgttcctgcacggctaagtgcctgcgttcatcctaatcgagctgaacgctagtcactgggttccacggttctcttccatgacccacggcttctaatagagctataacacttaccgcatggcccaagattccattcctcggaatccgtgaggccaagagccccaggtcagagaacacaaggcttgccaccatcttggaagcgggtcaccgccatcttgggacctctgtgagcaaggaccacccggtaacattttggcgaccacgaagggacctccaaagtggtaatgttggaccactttcgcttgctattctgtcctatccttccttagaactggaggaaaataccgggcacctgtccgccagttaaaaacgattagcatggccgctggacttaagacttaggtgtgaggctatctggggaagggctttctaacaacccccgacccttctattggggatgttgatctgcctggagccagcttccactttcaattttcttggagaagctgaggaccgactagaggtagaaagcagctgtcccgaactcccggcagtagccggttaagatcatggcacagccagaagtctctacccagcagtcgcccatgcgtgcacccctacctttccttctgacccacacctcctgggtcccgaccacgacttttttgaaagtgtagccccaaaattctccttacctctgaatctacttcctctgatccctgcctcctaggtactaatggttcagactttcatttcttctagcaagttgtatctccaaagggatctaaggaggctctacactgtgtccttaggcacctaggctataacccagggagtcttatccctgttatccctcctgatttaggtatacagctgtctacatgggcagttacgtgggacccgttccccaccacctgtgccagggccccaagtttgtaatggctaagagagagagacggagagagagacaaaaagggagtcaaagagaaaaagaaagaaaaagatattaatagttaaaaaaaaaaagtgttccctattcatttaaaagccagggtaaatttaaaacctgtaattgataattgccactttgttgtcagtgtaaataagggcttagcaaatccttaacccagtaacccacagatgggccaaatgcattcagtcagtcggtagggacaactgcttcactaaaagtagaaaagtaacttttagaggaaacctcgttgtgagcacacctcaccagttcagagttattctaagtcaaaaaaaaaaaaaaaaaaaagcaaaaaggtagctttctaactcaaaaatattaaagtatggggctattatgttagaaaaagctaatgtaactccaaccactgataattcccttaacccagcagatttcctaatgggggatttaaatcttaattaccatacaaaggtccgaccagagctaggaggaactcccttcaggacaggatgatagatggttcctcccaggtgattgaggaaaaaaccacaatgggtattcagtaattgataaggagacttttgtggaagcagagttagaaaaattgcctaataattggtctcctcaaaggtgcaaactgtttgcactcagccaagccttaaagtacttacagaatcaaaagactatctcaatccagactcaaaagttttgctacaccctctctgaaatgaatttgcataagaactgttgtttacaagaatgcatcttgatggggcagctgggttgttgtgaaatactcagaaacccagcccagctctaggactcaccctgagtgcaaaggcaatgttaggcatgctggtaaaggaccactagaatccagcatcctggatccctttttttgtggtcaagagaggcgggtaaaacagatgcaggactgctacataggtgagtgtaactaatcagataagcagaggtccatgggtggttacgcacctagaaaggaataagcattaggaccatagaggatgctctaggactaatgctcatcggaaaatgactaggggtgctggcatccctatgtccttttatcagatgggaaacatttcccccaaggcaaaaatgcccctaagatgtattctggagaattaagaccaatttgaccctcagacgctaagaaagaaatgacttatattcttctgcagtaccgcctggccactataccctcttcaaggggggagaaacctggcctcctgagggaagtataaattataacaccatcttacagctagacctgttttgtaggaaaaaggcaaatggagtgaagtgccatatgtacaaactttcttttcattaagagacaactggcaattatgtaaaaagtgtgatttatgccctacaggaagccctcagtctacctccctaccccagtgtccccctaactctttccccaatgaataaggaccccccttcaacccaaacggtccaaaaggagataaataaacaattaaccaaagagtgccaatgttccccaattatgccccctccaagcggtgggaggaggagaattcggcccagccagcgtgcatgtacttttttctttctcagacttaaagcaaattaaaatagacctaggtaaattctcagataaccctgatggctatattgatgttttacaagagttagggcaatcctttgatctgacatggagagatataatgttactgctaaatcagacactaaccccaaatgagagaagtgccaccataactgcagcccgagagtttggtgatctctggtatatcagtcaggtcaatgataggatgacaacagaggaaaaagaatgattccccacaggccagcaggcagttcccagtataggccctcactgggacacagactcagaacatggagattggtgccacaaacatttgctaacttgcgtgctagaaggactaaggaaaactaggaagactatgaattattcaatgatgtccactataacacggggaaaggaagaaaatcctaccgcctttctggagagactaagggaggcgttgaggaagcatacctctctcacctgattctattgaaggccaactaatcttaaaggataaatttatcactcaatcagctgcagacattagaaaaaaaaacttcaaaagtctgccataggcccggagcaaaacttagaaaccctattgaacgtggcaaccttggttttttataaaagagatcaggaggagcaggtggaacaggacaaatgggataaaaaaaaaggctaccgctttagtcatggccctcaggcaagcggacttcggaggctctggaaaagggaaaagctgggaaaattgaatgcctaataggccttgcttccagtgcagtctacaaagacactttaaaaaagattgtccaagtagaagtaagctgcccccttgtccataccccttatgtcaagggaatcactggaaggcccactgccccaagggacgaaggtcctctgagtcagaagccactaaccagatgatccaccagcaggactgagggtgcctggggcaagcgccagcccatgccatcaccctcacagagccccaggtatgcttgaccattgagggccaggaggttaactgtctcctggacaccggtgcggccttctcagtcttactctcctgtcttggacaactgtcctccagatctgtcactatccgagggggtcctaggacagccagtcactagatacttctcccagccactaagctgtgatggggcgctttactcttttcacatgcttttctaattatgcctgaaagccccaatcccttgttagggagagacattctagcaaaagcaggggccattatacacgtgaacataggagaaggaacacccgttggttgtcccctgcttgaggaaggaattaatcctaaagtctaggcaacagaaggacaatatagacgagcaaagaatgcccatcctgttcaagtaaaactaagggatcccacctcctttccctaccaaaggcagtacccccttagacctgaggcccaacaagaactccaaaaaattaaggacctaaaagcccaaggcctagtaaaaccatgcaatagcccctgcagtattccaattttaggagtaaagaaaccccatggataatagagattagtgtaacatctcagggctatcaatgatgccattgtccctctatacccagctgtacctagcccttatactctgctttcccaaataccggaggaagcagagtggtttacagtcctggaccttaaggatgtctttttctgcatccctgtacatcctgactatcaattcttggttgcctttgaagagccttcaaacccaacgtctcaactcacctggactgttttaccccaagggttcagagatagcccccatctattaggcattagcccaagacttgagtcaattctcatacctggacactcttgtcctttggtacatggatgatttacttttagctgccctttcagaaaccttgtgccatcaagccacccaagagctcttacatttcctcgctacctgtggctacaaggtttccaaacaaaaggctcagctctgctcacagcagtttaaatacttagggctaaaatcatccaaaggcaccagggccctcagtcaggaatgtatcctgcctatactggcttatcctcatcccaaaaccctaaagcaactaagaggttccttggcataacaggtttctgccgaatatggattcctaggtatggcaaaatagccagaccattatatacactaattaaggaaactcagaaatccaatacccatttagtaagatggacacctgaatcagaagtggctttccaggccctaaagaaggccctaacccaagccccagtgttaagcttgtcaatggggcaagacttgactttatatgtcacagaaaagaacaggaatagctctaggagtccttacacaggtccgagggacaagcttgcaacctgtggcatacctgagtaaggaaactgatgtagtggcaagggttggcctcatggtttacaggtagtggcagcagtagcaggcttagtatctgaagcagttaaaataatacagggatcttactgtgtggacatccatgatgtgaatggcatactaactgctaaaggagacttgtggctgtcagacaaccatttacttaaatatcaggctctattacttgaagggccagtgctgcgactgcgcacttgtgcaactcttaacccagccacatttcttccagacaatgaagaaaagatagaacataactgtcaacaagtaattgctcaaacatacgccacttgaggggacattttagaggttcccttgactgatcccgaccttaacttgtgtactgatggaagttcctttgtagaaaaaggactttgaaaagcgaggtatgcagtggtcagtgataatggaatacttgaaagtaatcccttcactgcaggaactagtgctcagctggcagaactaatagccctcactcaggcactaaaattaggagaaggaaaaagggtaaatatatacacagaatctaagtatgcttacctagtcctccatgcccatgcagcaatatggagagaaagggaattcctaacttccgagggaacacctatcaaacatcaggaagccattaggagattattattggctgtatagaaacctaaagaggtggctgtcttacactgctggggtcatcagaaaggaaaggaaaggaaaatagaagagaaccgccaagcggatattgaagccaaaagagccacaaggcaggaccctccattagaaatgcttatagaaggatccctagtatggggtaatcccctccgggaaaccaagccccaatactcagcaggagaagtagaatggggaacctcacaaggacatagttttctcccctcaggatggctagccactgaagaaggagaaatactgttgcctgcagctaaccaatggaaattacttaaaacccttcaccaaacctttcacttaggcatagatagcaccgatcagatggccaaattattatttactggaccgggccttttcaaaactatcaagcagatagtcagggcctgtgaggtgtgccaaagaaataatcccctgcattgcaggccatacatttcaatccctgtatctttaacctccttgttaagtttgtctcttccagaatagaagctctaaaactacaaatcgttcttcaaatggagccccaaatgcagtccatgactaaggtctaccgcagacccctggactgaccagctagcccatgctctgaagttaatgacattgaagacacccctcccgaggaaatctcaactgcacaacccctactatgccccagttcagcaggaagcagttagggcagtcatcggacaatctccccaacagctcttgggatttcctgttgagagggggaactgagagacagaactagctggatttcctaggccgactaagaatccctaagcctagctgggaaggtgaccgcttccacctttaaacaagaggcttgcaacttaattcacacacgaccaatcagatagtaaggagagctcactaaaatgctaattaggcaacaacaggaggtaaagaaatagccaatcatctgttgcccgagagcacagcgggagggacaatgatcgggatataaacccaggcattcgagctggcaatggcaaccccctttgggtcgcctccctttgtatgggagctctgttttcactctattaaatcttgcaacagcaaaaaaaagaaagtagattattaacaatttgatgctccctatattttctttctggtaccctggaggttgctatcactgtaagctctgtttgaaggatttgttgctattctcaaaacaagtaaatgatggaaaaagaacattgtaataaacatctaatcttaatagaaatacttcaatcctgaaaaattttttatattttactcagaaaatgtaattatataaagtggttgccattgtgtgaaatgtacacaagtatttaagaaataggattatttgattcaagagaaaccatatcagacaaaaagcacagtataagcagcacaaactttttcaacaaagcaacattattatttgagtgtcagttttcaaggcatagtaaaaatatttacatgttacctatttggaaagtacttaaaaataaggctacttattcactaaaatgtacagtacataggtacaaacataggttctaaaaacgcctggctgaatactttaaagcagaaaatatacagtcatcattaagtccttgaactgcttgggttttctcagtaatttcacaactacagggataaaggtataacacaaagacttaggataagggataaaggtttcaaagttgagaagtactatagttgtttgagaaattacaaaagccaagtgtccctgtgattctcccagttctgaccacaagaaaaatagtaagggggactgcctagaagctgctgaggatatcagcaatctgtagagtaaaggcagcaaattgatatcattagtgtccataaaataagagcaataaaactgtaccaaaatggagatgctcaggacttcactttccaagtacagcaaaaaaaaaaaaaaaatgaaaaaaaactacttcacaagaacataaaaataaaaatttccttcaataaaaaaaaatctatcaagtggctactttttgcaatagcaatgcttagtagtatagagaattcaaatagaaacaagatctttttctgaaactattatgagattgaaatgtattataagtaatacatttctggatactattttatcataatcaaagtttttgtgaaataatggaaattgcattgaacaaacatctactcatgcagaaaaaatgaattgtctttaatgaaaagttcccatgcataccctttctttctaattacctactgctaaatatttaattgtgacactaggtgttttgttttgctagtgggaagttaatttagctgttgctttgtaaataattttgtatattataatctattacatagctgaacaacaatgtatatgagaaaatactcatgatattttcttttgcagaacacacatgaattcactgtacccccatatcatgttgatttgtacatgaattcattatactaatatgtaatgagcccttgtcctgtggcaagcactgtgctagacgcgggaggtggggggcaggtgtttaaaagaacaatgatgggttcaaataggcaagtaaatcggtgcaataagtggtaaacatgatcaatttccttgctaaagagtcattatgtaagtagaattccaatatggtttccaagatccccaccactagtgtacataccccatgtaattccctcactttaaatgtgggtgaggctgggtgcagtggctcacaactgtattcccaggactttgggaggccaaggtgggaggattgtttgaggccagaagtttgagactagtttcagcaacatagtgagacccctagaggtggtgaagagatggtgataggcacacctatagtcccagctactacttgggaggctaagatggaaggatcacttgagcttgggaggtcaagtctgcagcaagctgtgattgagccactgcatttcagcctgggaaacagtgagactctctctcttaagtaaataaatcaatgtgggtaagatatgtgaatatgattgaatgtcactccgtaattgtttactttatatggaagaaaagattgtggatataattaagtcccagaatcataagggagtccatcaaaagacacattatcttgagtgggtctgactaaatcaggtaagactttaaaagaagtcagaggcattatcctacttgcctcaaagaagcaaatgaaagctgtgttttataaagctctatgagatagggaatggcatctggtttgcagcagccaagaacactctagacagccagtaagaaagaaagaccagagttctaaaatcacaaggaagtaaattttaccaacagccagtgagcttggaagagaaacgtgagccttagattagctcacagtcctggccaaccttttgatttcagtcttgtgagaccatgagtagagaactcagttaaaccattcacagatttttgacttgcagaaattgtaaaataaaaaatgtgacttgtattaaatctataagcttgtgataagttgttattcagcacagaaaagtaatacagtcaaatataagggccactaagacatcttcagtgctattggaaagcctactgaacaggtgatatttggagtgagccctaaggaatcatcacacattatcgaggttaggcatgtgggatacagaaggggatggggagagttttctagaaggatgagggccagaagatgagaaagttcaggagattgaaaacaaatcaatatgaatggaacacaaaatacagggaagaaggagatgcattaccacatttaaggaattataatatgccatcgattttaagggagtttattttatgtgccattaagggtagcatggtagaaaaaatgatgccctcccactcccttcactacctccctgttgaagatatccagctcctaattctggaaacctgcgagtgctatcttatgtggccaataagaatttgcagatttgattaagttgaggattttgttgtggtaagcttatcctattttatctgggtaggccctaactataatcataagggtcttccaagggcctttataagagagaggcaagaagtttaaaggaggaaggtgacatgaagatgaaagctggagtttggattgatgcaaggaaggggtcatgagcccaggaacaaaggcagcctctagaatctagtaaaggcaagaaaatagaagtcttcagaagcaacacaaccctgcaatacctacctcattttagactttggcctccaaatatataaaataataaacttgtgcagttttaagtttgtgaaaattagttacagccattataggaaactaataaagagagcaaaaactgccagttaaattctgataaagtatttaagacatcactattgtgaaaaactcatcccaatttcaaagatgcttgtgttaatatgtaatgtgttagttatcacgctaatttgtgatgaaaattgggatgtgttaaatgaagttcactaatttgaaataacatctccataggctgggacaagatcctacaagtctttgtgatctatagaacataaacctggtgtgcattgaggaactgttgaaagctttcctaaaaatggaataaagtatggttggtctccttacagagaatcacattgtattgtatttcttagttgtatctaaaaatatatataatgctgctttatttctttgaagttttattttgctgaaaactatattctcttaaattaatgttaagaagctaaggcacattttatctgcatacatatttggtaggaaaaattaaaaacctgttttttattagttttttacaatgatgtcatcaattcagaaaataaaaaatgctgaggttcccactgaaattgtaccaccgggtgcagtggctcacatctgtaatcccagcactttgggaggcggaggtcgatggatcatgaggtcaagagactgagaccatcctggccaacatggtgaaacctcgtctctactaaaaaaaaaaaaaaaaaaaaaaaaattagctgggcatggtagcgcacccatgtagtcccagctactcaggaggctgaggcaggagaatttcttgaacccaggaggcagatgttgcagggagctgagattgtgccactgcaatccaggctggcagcagagcgagactccacatcaaaaaaagaaagaaaagaaaagaaaaagaaaaaaaaaaaaacaggcgccatggctcacacctgtaatcccagcactttgggaggccgaggtggacaaatcacccgaggttaggagctcaagacccgcttggataacatggtgaaacctcgtttctactaaaaaaaaaaagtatatatatatttttcctctaattgaaatttgcatcaaactagtacgttactttcaaatgtatggatgacttttgatatcaagttcattatgataaacttcatatgttcatatgttaaacttcttaaagaacattgcagttttaagagctgtaagtggatatagatgtttacaaaaatgtgaaaatgctaagcatgtcttcatatgagtctagtagcttgaattttagtttctcatgatttagataaacttaaaatctgctgtttaaaatgtttaaagtgataacaaaaattcagatatttagagaaacatagttaaaaagtgagtaaataatagggtggagataatctttctgtgcaagaggcatcatgtaggatatgtaaattacagaagtctttagtgaaatccactataaagttaaataaagtagaatcaagtcatccaacttcaataatcagcaataaaaacatgaaaagattagactggacagtataaattctgtttctgcagtaatatcaaaggacatatagcaggaaaacagttctttatggagcatacctcaacatattaaagataagtcctaattctctttatattttcataaaactcattattcatatactaaagttctatgaaaagacagtcctttttactaaacagaagatctagctaacactgtatatccttaagggacattaagtggtaatggacattgtatatctttaagggacattaagtggtagatattttgtgcattgtaaaagaccagagatggttgctgctatctatcatctagaaattttatgtaaaccaaggaagtctgagtgatgaattttatggggagacatcattttttccctctccctatcccattccctcccagcttcctagactctatttacattggacaaatttcttctcaaatctaacaatgattagtgagacagaaagcaatggaaataactccactttccacataacctttagaaataatatgctaatggcaaatcttatagatgcattttacaaatattgtcataaattggaatatattattaatgtacttattttactctgagaaagcaaattcgctttccaggttgaatgcaaacatatgaagtcagttattttcattttaaatttatgacttacacttttaaataattttttattgttttaaaaagcataccttcaagtattaataaataaaacattaatatccatgttcatgtatgttctttcttgacctcattaaatagcaaatgaattgatttttatcacttcttcatgttagtaaaatattttgtgagtaattaaagtgagagtcaataaagcagccccgccagtatcagctaagctggactggctgcataatcggaccctggtgcttttcttttgagcgtaaacaattttatggatcaccaaaatcagacaaggtctgtgctcatgaaggaacaaaataaaaataatatcactccacactcatatctgagcacagacaaaaacaataaagctgtctaaaccacaaaatggctaacattcatctttcctatctcttctatagttctttacaaattaaagctttagctttatttgtaataggtaatgttattaccttttagataacaattttcgtaatactcccctttgtaacctcatagagtagaggccaaacttcctggaaccacctccagagtcactaaacccaagcttgaatctcaagcctctgttgaaaccctcttaacaaagtgctcccaaattcttcatggtatggagccaataaactcaagtttgtctaatgacaggtgaatttatggtggtctttaagtggagaatgccaataaagatacttctacttttgactagaaatgagagtacttgtgtctatttttctgtgatcgataaaaaaacacactgcattctcacagatgtgtaatatatgtatgtattggtatgctagggcaaccatatcaaagcaccacaaactgggtggcttaaacaacagacagttagtgtttgaccattctggagtctagaagtccatgatcaaggtcttggcagggttggttccttctgagggctgtaagagagaatgtgttccatgtctctcctctagcttcctgtgtttttctgacaatctttggcatcccgtagttgtagatgcatcaccctgatctctacctttatcttcacatgaaggtctctctcaatatttgtctgtgtctaagttttcccttttgttaaggacaccagttatattggattaagggcccacctactccagtatatcctcattttaatttaacaaattacatctgaactgatcctatttccaaataaggtaatattattacaataaagtgctaagtaattaggacaacaatataattttgggaggacacaactcaatcaaatacaatgtgttttgatgtgaaggaagcataagaggtttttctgtatgttggtttttgttttttggtttgtttgtttgtttagaagtttttttttaaaagaccatgttcttctaattgttctctactaaaactttctcatatttcctctaaggttacctttagtgaagcctatatgcataccctgtgtgcatatgtttgcttgttgtttagtagttctgaattgtattgttgttgttgtttaaatatagctagattgtgctttttgcaatcttagcttaaataatattttaaaaatcataggtacaaaaaaattgaccttactgtatgacatcattttggattctagaaataaaaataaagcttataagattatctcaatgaacacaaaatggggaccagaataagtggcataaatgtagaacgagaaagactgggtgccatattttgtatcaatccgatgatttcaccacttggattttatttttgggtaccatatggtttagattaagataaacccattgataataatttcagtctaataggaaaattatttctttatattaaaatttttgtgaatctaggtaccaccatagaagcacagactaaacattcttattctttttacattttttctcacgtttctaaaaatatttaattgaacattatatctcttaaaccactctcactgccacttccaaaatccttgtcctgttatttttctgtcatatctattttataaaaattcagccattcacacaagacaatgtgtggctaacaatgtggacacaacattccaaagagcttggatccaaacccttgcttgatccttaagtagacacgtgatcttaggcatatgacatttccatgcctctgatttctgatacctaacatagagataataacatcacacaactcataggtttgtagtacaaaataaatgacataaggtatgttaagcatttcaaaaagtacctgccaagcaccatattaatttaagacattaatatcattatctctgtccatttgcctagcttgctgattatttctggtaagacaacaggaattatctcaaaatcaaaatttctaactccaggtaggcacccaactcttagtaattgtattagtccattctcatgaggccaataaagacatccctgagactgggtaatttgtaaaggaaagaggattaattgattcacagttcaacgtggctggggaggcctcaggaaacaattgtggcagaaggggaaacaaacatgtccctcttcacatggcggcagcaagaagtgccgagcaaaatggggaaaagccctttataaaatcatcagatcttatgagaactcagtcactatcatgagaacggcaagagagtaacccacccccatgattcaattacctcacaccaggaccctctcacaacacatggggattatgggaactacaattcaagatgagatttgggtggggagacagccaaaccatgtcattctaccctggcccctcccaaatctcatgtcctcacaatttaaaacacaatcatgcccttacgatagtaccccaacatcttaactcattccagcattaactcaaaagtccaatccaaagtctcatctgagacaaggcaagtcccttctacctatgagcctgtaaaatcaaaagcaagttagttacttcctagatacaatgtgagtataggcattgggtaaatggacccatttcaaaagggagaaattaaccaaaacatagaggccacaggccccatggaagtctgaaatccaatagggcagtcattaaatcttaaagttccaaaatggtctcctttgctccatgtctcacatccagatcacatcccatggctttgggcagctctgtccctgtggttttgcagggtacggctctcgatcctagctgctttcacaggctggcattgggtgtctgctacttttccaggggcacggtgcaagctgtcagtggatttaccattcttgggtctggaggactgtggctctcttctcacagctctactaggcagtgctccagtggggattctgtgtgggggctccaaccccacatttccctactgcactgccctagcagatgttctctgtgagggctccacccatgaagcccacctctgcctggacatccagatgtttccatacatcctctgaaatctaggtggcggtttccaaacctcaattcttgtcttctgagtgcctgcaggaccaacaccacatggaagctgccaaggcttgggacttgcaccctctgaagccacagcctgaactgtacatttcccttttttagctatggctggagcagctgggatgcagggcaccaagtcccaaggctgcacacagcagtggggcccgggacccagtccagcaaaccatttttcccttttagatctccaagcctgtgatgggaggggctgccatgaaggcctctgacatgtcctagagacactttccccattgtcttggtgattaacattctgctcctcattacttttgcaaatttctgctgctggtttgaatttctccccagaaaattggcttttattttccagtgcatcatcaggctgctgcaaattttccaaacttttatgctccgcttccttttggatgctttgctgcttagaaattgcttctgctaaatatcctaaatcatctctctcaagttcaaagttccacagatctcaaggacaggggcaaaataccatcagtctctttgctaaagcataacaagtgtcacctttgctctagttcccaacaagttcctcatctccatatgagaccacctcagcctcaactttattgtccatatcactatcagcattttggtcaaagccaatcaacaaggctctcagaagttccaaactttcccacatcttcctgtctcctgattccttcatgtctctaagaagttccaaatgttcccacatttttctgtctttttctgagccatcaaaactcttccagcctctgcctgttacctagtttcaagctcaattccacattttcgggtatctttagagcagcacctcattacccagtagcagtttactgtactagtacattctcatcatgctaataaagacataattgagactggggtaatttcaaagggaaagaggtttaagtgactcactgttcagcatggctgtgggagcctcaggaaagttacagtcatggcaaaaggagaagcaaacacatccttctttacatagtggcagtaaggagaactgctgagcaaaagaggggaaagccctttataaaatcatcacaccttgtgagaactcactcactcactattacaagaacagcagcatggggtaataatccccatgattcaattacctcccactgggtccctcccacaacatgtgggaattatgaggactacaattcaagatgagatatgggtgggaacacagccaaatcatatcagtaataatttaacatatatttcttcaatttctataatggtgtgttttagctgcctagcgtctatccattagcatccagattttctggtggaggatttcttttttctcctaagtctgtgcttagctgaaagatcatttttaaccttatttatcccactgcctacatagtgctacagaaccccaggtgactagatgcttcctccatttgctctctggcttaccaaaagaggcatattatgccagtttatctaattggataaaaagaaagcttcagaaggcatgcttattgcgatagtaacaataatagctggtgtagcattggtggtgttaggtggattttaagcaggaagaggagtactgatgatgacatcttggctaggctgttatggctatttctattctttctgtagctcttcccaaataagcaaaaactgatcaaatttattgacagtggatcaaccctacaaggaatactaaagggaatcttctggctgaaataaactctcataagacagttacttgaatccataaaaggaaataaagagcattgataaaggtaatacacaggtaaattttaaaagaagtacatatataaaactaaatatattatatattaatatatattattttttaaacataaatacaatatatgtaatacaattttatttttctatttaatttaaaaggcatctacataagtcagtatttataaaacttcattgttaaacttataatgcataaagacatcatttgtatgacatagtacaatggagggagggagagaatatagagatatgttgtatcaaggtttttatatactattgaaattgttaacattaatttgaaagaagtcagtcacaaaagaccacatattgtacaattccatttatattacatgtccagaataggaaaatttataaagaaagaaagttgatcagtaggaagagaggactgttaatgggtatggcttttattttggtggtggtgagatgttcttattagattatgatgatgagggttgcacaagtttgtgaatatcctaaaatccattgaactatttactttcagtaaattttatgaattatatctcaactgaatattgaattttatctcagtaaagctattaacttatagtaagttaatattatctttttaattatattaactgcggtcactgttaaatcttggttagtctcagttaccttatttattgcttgtgtcagaaaaagttcagataccacatgcaataaaaaaaaatccaattgaatttccaaatgattatttttctccaccactggaacagatataatactctaaatataaagagatttttaatttcaaaagctaggcttcaagggagaaaaattgttgaaattgttttcattgtagtgtttgttttgtgtttttgttgttgttgaagtggcgataattgtggatttcctgccgttgacatatgttaatccaaaataagaaaaatgggagaagaaagaggaaaaaattcatagttcccacaatttgcagtaagaaaaaggactagaattttttaatagtctctcttttatagtgagaccttccagttttgaaaccagttgaagcagcacaagtggacacagaaatttcttccatagacagaggagactcgggtttgcttgcagcatgaaatcgcaagagcagtcttacaggaaagtatgcacgtgtagtgcagggcaataataaggtaggaatggcagtagggtagtcaaacagacgttgatgtaacttgccccttcatataccaccacctagtaagctgagagaagatgctgaattcaaattctaggttaaacatcatacatagcagtccaataaattaaatgatttcaagtaaaaaatggtttgtgaggttaaaagtttggaaaacagaacgtactagtcaagatggaaggagtctcctactacatgccatagccctcttctttaaagcaagagcaaacctcagtcttctgggtggtctggttttgtcatcactttttacaaaactaactttaacttgagaaaatagtaattcatgtaaatctgtagcctctgtaaacttctatcattgtgaatacatatagcaatgcaatgaaaatatagctggtgctcatatgtctagggagcttttattcacgaaggaggcccacaagatttaagtagcattcatagcaatgacatgatttaatattcataaaaatggcaaaaccttacaacttaaaacaccccaggtactattttaagtgatttctataaccaagtcattgtatcctcacagaaaaaccttagtaggtattgtagtcattcccattcttccctgaggaagtggagatgcagggcgatgtctgtggggagccaggcttctgtccaggccctgaatctatgaattcaacctcattacagggctgagtgttcttcagaatgcccatgtgcttcagtttttcagaattcatgcgtcacgaatgtggtttacttcttcaaaattgtatttttgtttaacttgaagatattgtaggcattttcatatataaataaattccatttttgctttttattcaatcactaagttgccaaaaagttggaaataataggttttgataaatatgattccattgtttaattcttcagattctttgcaagcaatatattcatgtagctttaaaaaaatcccaaatattatgttctaggaactaacatttgatattgtttgagagtgcttcaaaatgatttttttaaataaccgtgaaaaaggtcagctatacctctaagctttcactgaggactatcatcagtcaaatgattagtttcagcaatttcatggcataaatccacaactagggtgattaagggtagtgaatttaggtacaagcctaaaattgaatcaaatagaagcagataaatacctctaccttattctcatataatgaaactcttcttatgtatgaaaaacatcactatattttgagaaatgctaattcacatttaaatttccaagaaaagtgctcttctgaatattttaaagattattcaatagactttacagagtatatttgtacctatcataaaattaaaaatcaatatgcattacccacaaaagtgtacagttgataaaccatacttagctatagcagattttaagagttctgacttccctcaaatccattacattaaacacttcaaccagctaatgtcaaaactggagcaattgcatatcaccccacttaaaacaatacagcaaaatgcacatatcatgtctactaaaatctctgcaataatgaaaatgaattgattttaaacaaatggattttagtgaatgtataaatctgaatcctttgagatatgctaaatgtttaactctgtttttgtattaaatttaatttgcatttatgcatttagagaatatatgttattcaagcagtaaaaagattgaaaataattattttgttcagtaaataaacagtaaagaaacatggtataagactggtactctggtagagctatgcattcatcccagctgcgcaagaggctgaggcacgagaactgtttgaacccaggagggagaggttgcagtgagctgagattgccccactgccctccagcctgggcaacagagtgagacatcatctcaaaaaaataaataagaggaagaaaaacaaaacaatttcttgcttcctgaatcttgaattttaggtaacagaacagatgtctgtcagtgagagaaatatgtgttttaatgatgttctataaagggtacactgggatacaaaggaggaccattagaaaaaactccccagggcagagaaacttccacacaactttctcaagattaatacagtgagtcactcatacaagagcttattttaaaactcagtccataaatacaaaattcctaataaactgtctgaaagtactctaaattgccatatgtatttttttattcaattctgtgtcagtgtctctcattcttcatcagtcattacttttctatgatcttctagtaattcttcagtccctctcttacagattgaaaaagacttcttcagtcgcttattttatttatgaaatctttacatagcctttctaatatgacatggtttatattaactctatccactgttagtttcataaatgaaacagggttattattaggcaaacataattaattcaggtgctctaaatactgtaggctggaactgcactgtagacattctccagaaaataactaaatgaagattgtttagaatttaacaattagagttgttaattgttgaattctaaactttcttaacagaagcataaaagtaataggaaggaaatgcattccaggccaaagggactcatgaaaaaaagaccaggggtatgaccagaaataaaacaaacatgtaggaaggcatttatgcacagatgaatgggctacaaataagggaggggatgttatatgggcctgcgttgccttcctgtgtcagaaggtgcattaggagagcacagtccaaagtccacctagcattttggaaaatactgtcaagaaacaagtaaagattcagatattggccgggcatggtggctctctcctgtaatcccagcactttgggaggccgagacaggcagatcacaaggtcaggagatcgagactgtcctggctaacacagtgaaaccctgtctctactaaaaatacaaaaaattagctgggcgtggtggcgggcgcctgtaatcccagttacctgggaggctgaggcaggaggattgcttgaatccgggaggcagaggttgcagtgagccaagatcgtgccattgcactccagcctgggcgacagagtgagactccgtctcaaaaaaaaaaaaaagattcagatatctctgactctaaacagtcaaaaagtcaccacatgatttgttctacccttttcctcttcctcttgcctatttgtaatgtgtgttttttttttttgacagtgagaagcttggctaccatttataatttatttacttacttgctgaactctacttttacatgtaaagtagtttcagagttgtgcatctatacctcagtaagaaacaaatttaccccaaagagtatgatgtttttgtacagttattttagcttttaccttaatgtcgtcaatcaaaactcttgtttctaaagttatttagatcagttccttttctttccacatcatttagtgatgtcttaacttttctaatgtcatacttttctaatgaactagttctaataaacttttctaataaatctgacttcattagaagtttttgtgacagtcttcattagcagatttgtgacagtctgctttctgttattggaccctcctacatcctggttgatgtttttaatttgtgtacaataagttattacttagggtagagctctattgattttgacaaacatgtgtaccatcacaggactggattaaacaattacagcattctaaacattctcttcaatgcctcattaaaaacaatcccaatctcaactttctgtcaaccactgatctgctgtctgtcctgatatttagctctacattttcctgaatgctgtataagtggaatcatgcaataggtaccttttgtgtatggcttctttcacgtaagaaaatgcacttaagacttatcagtattgtattaatcactttgttcctttttagtgccagatagtatatcattgtatttatgtaccagaagttatctgttcatctgttgtaaggcatgttgtttgtttgcatttattggtgaatacgtataaaggtgaatatgaatatgtataaatgtaccctataaacatttgcatatataacaaaatctttatttcacttgagtaaatacttgattgctggattgtatggtaaagtgaatacttaattaacactaaattattatgccggatttcttttcaaagtctgctttactatcctgcattcccatcatcaatgactacactttgagttcttctgcatcacaagcatttactattgtcatttgttttgtgtttatttcatttttatcttactaagaggtgtgcagtgctcatcatggagtattaagatcaatttctgttaactttttatttttatatagcttaaagcttacaaacaaattaaaatagtgcaagaaactccaatgctttactcagagtcccaaaatgttttgggatattttgctataattgccttaatattttatctctatgttcacttatctatattatatgcatttctacaataatatatattatctatatcatatataattctttttgtgaaacattttagaggaagtttgaaatattatgaacctttatccttaattactgcagtatgtgttttctaagaacaatgttatttcttacatcatcatagtacaattacaaaaaccaatactattgactatagttaataataatgtatacataaaatttgctgagagtagatttttagtatagttttcacataatagtctagtaattttgaaaagtgcccttcaattttggtttatctgatgttaccttttgattcaaattcaggttttatataactttgaaagaagtacaacagaagtgatatgttatcctcagtgcatatcagtggacatttttagttaggttgttctaatatttgttaacttattccagtaaaaaatttatgtaatttatccccttggacttaatgaataattttgttatttaagaactataaacatgtatttttgttaaagaatctttcacccactagtttagcaatcattgataattttccaactccaccttactttcatgtatatgttgattttctgctataaggaagagctttgcctttatacctccctaagtatttgtctatttttcaatttattatacatttatataagaattgaatcatcagttattatattattcagtgaattataatacattaactttattatttattttactgctgaaatttcctcctacttagccagtggaaaacctgtagagctgtcccctgtgtccttttgatttattctcctttttctttgagtacttctttataatgcaaaaaagatatttaaggtttctcttttaacttccttgctctaggcttgaaatttatcttttctgtaaaaagtatggttcctttaagtagagaatgatattaagaaatcaagatctaggtgatcagagtgttctcttataaagggaaagagttaggaaatatgtgcatgtgtgggtatgtatgcatacatacatacacatatgtatatatttatgtctatatattgatatacatacatttatatgcagatacgtactttgtaggaattatataaatacacatgcacacatatacactcatatcagatttatactgataaaccattgacccttgaacagcataggtttaaatgacatgggtctatttatatgcaaagtttttcaataaaatttacatggagtgtgcctgcctctcctgcctccccttctaattccttgacctcttctgcctctgccacccccaagacagcaagaccaacctctcctcttcctcctcctccgaggtctattcaatttgaagatgatgaggatgaagaactttacaagaggagaaggagccaagatggcctactaaatgcagataggaagagcatctcccagcaagagaccagactattaagaagactggcacactgtgtgaggatctttggaagaaaggaattcagagcggatggaaagaagatggatacccggggctgaatggggagcaatctggaatctcttcattggcctgctgagtatgagggacgcattcctggtgccagtgggtcctggggaaggggtgagacaaataagcgaggatggcccactctcactatggaacaccagaatgctagcttcaggacacctcatggccaccatggacatttgagctgacaagaagagctgtttagagaggtcagacctccagcctgtgtggattccagagggtttggctcaagaacagctggagaacagctagggatgtacatcccccaagtctggccacattccccgaagtgtctgtagcctttgatgactgtcagacctggacaaagcagggtgatcttgccaataagatggatgtgacctgagctttcccttctctgccagccactcctagggtccctgcttggctgatgctgcttgcagcacagtgtcagatgcccaaccaggtgcttcctggtggccattgccataggtcctttgttgacagaccctccctaaccatcagagagcttctgcagacagactactgccagcatgcacccaactacgcacagcatccccacactgcagcctccccacaccactatgctggcacacattcacctgtagcacccccactgatttgctggcacctgtgtaggcagaactcactgcatcccctgagcaccctgtccacatgcatgtactccactgtaccactattgctgctggcatgcatgcacaagctgagatcccactgccactgctccagtgaagcatgttggctgacagattccatcggggtattgttgccagtggacagggcataccttgattcctccaacacagcaggtgcttaacgttgagagggtcagagaaaaaggccatggacctgttagtagcccttcaggggctgctttatagtgtcaatcaagtctgcgtaacaacaaacaacaaaatgacaggatcaaatccacatatcaatgttaaccttgaatgtaaataggtaaatgtcttagttaaaaggcaaagaatggcaaggtggataaagaaataagacccaactgtatgctgtctttaagagacccatattccatgcaatgacacccatagcctcaaactaaagagatggagaaaattctacaaggcaaatggaaaacaaaaaagagcagaggttgctattctaatttcagacaaaacagattttaaaccagcaaagataaaagaagggcattacacatgataaataggtcaattcaacaagaagacataaccattctaaacacacacacatttatacatattatatataatattttatattttatatatatatatatacacacacacgcacatacacacacacacacacatatacacacacccaacactggagcacccaggttcataaaacaagttcttagagatctatgaagagactttataaccacacaaaaatagtggcagactttaacacctcacttaaagtattagagaggtcatgaaagaagaaaactaataaggatgtttgggacctgaactctacacttggacaaattgacctagcacacatgtacagaacactccactcaacagcaacagaatatatattcttctcattggcatatgacaccaactctaaaattgaccatgtgataagacataaaataattgttagtaaattcaaaaaaacaaaatcataccaaccatgctcttggaccacagtgcaataaaaataaaaattaataccagaaagatctctcaaaaccatacaattacatggaaattaaacaacctactcctgagtgattttttgagtaaacaatgaaagtaaggcaaaaatcaagaaattttttgaaactaatgaaaacaaagatataatttaccagaatctctgggacattgtgaaagttgtgttaaaagcaaagtttatagcactaaaggctcacatcaaagagttaggaagatatcagattatcaaattaccatcacactcagagggaccagaaaaaaagaacaaacaaacctgaaagttagcagaaaaaaaaataagcaaaatcagagctgaactgaaattaatacatgaaaaatcatacaaaagataaacaaaacccaaaattggtttcttgaaaaaatatataagattcataatacactaattagacaaattaaaatgttgaagatccaaataaacacaatcagaaatgacaaaagggacataaccactgaccccacagataaaaacaaaaacaaacaaacaaacaaaaacaaccctaagaaactattatggacaactctatgcacacaaactagaaaatctaaaataagtgaataaattcctggatacatacaacctcccaagattaaaccaggaagaaactgattccttgaacagagtaataataatgagatctgaaattgaatcagaaaagcctaccaaccagaaaaagcccatgaccagatgtattcagaggtgaatactaccagacatatataaaagagttgtgatatagtttagatatttgttctgtcccaaatctcatattgaatgaaatcctccatgctggagggggcctggtaggaggtgttttgatcatgggggcaggtccctcattgcttatgctatctctgtgatgatgaatgagtttgtatgtgatctggtcatttaaaagtgtgtgacacctgacctaccactgtctctttctcttgctcctgcttttaccatgtgacatgcctattcctctttcaaattctaccataattgttagcttcttgaggcctcccaagaatctgggcagatgccagcaccatacttcctgtaaagcctgcagaacggtgagctaatgaaatatctctctctttttttttttaaataaattacccagtcttgggttctttttatagcagtgaaaaatggtctaacagaacattggtactgaagagtagaatattgctataaaaatacttgcagatgtggaagcagctttggaactgtgcaatgggcagaagctgaaagagtttggagggctcagaagaagatgggaagataagggaaagtttagaatttcttagagattggttaaataattgtgaccaaaatgctgctaatgacatggacagtgaagcccaggttgctgaggtctcagatggaaatgacgaacttattgagaactgaagcaaaggtcacatgtgttatgccctagcaaagagcttgactgcattctgttcatgccctagggatctgtggaggtatgaaatcaagagtgataatttagaatacctggcagaggaaatttctaagcagccaagtgttcaagatgtggccttgctgcttctaacaacctagctcagatgtgggagaaagaaatgacccaaagttggaagttatatatgaaagagaagcaaacataagagtttggaaaatttgcagcctggtcatatggaagagaaagaaaaagctttatcagaagaggaattcaagtagcctgtggagtaatcactttctagagatgtttgcataacaaaaaggagccaagtgccaatagccagagcaatggaaaacatgcctcgaaggtatttcagagaccttcatggcagtcactcccatcacaggccaggaggcctaggaggacagaatcgtttcataggccggtcacaaggcccttttgaagttgctccccatgttctggcctctctagcttcatctgtggctcaaagggacccaggtacagctccaggctgccattctggagaatgcaagtcaaaaaccttggtggaatccatatggtgttaagcctgtaggggcacagaatacaagagtgaagaatgcttggcagcctcctcctggatttcagaggatatatgagaaagcctgggtgctcaggtagaagcctgttgcaggggcagaaccctcacagagaatcactactagggcagtgctgagggaaaaagtggggttggagccttcacacagagtcccaaattgggcattgcctagtggagctgtgagaaaaaggtcactcttcttttgaccccagaaaggtagatccactgacagcttgcaccctgtgcctggaaaagctgcaagaattcaattccaatctgtgagagcagccctggtgctgaatactgccaagacaaagctgtggagctactcaaggccttgaaaacacaccgtttgggttccctgccctagatgcaggatatggaggcaaaggagattattttgaagctttaagacttaatgtaattacttccctgctgggttttgaacttgcacggggcctgtagcccctttcttttggctaatttctcccctttggaacagcaatgtttacccaatgcctatacccccattgtatcttggaagtaaataactaggttttttcaaaaaattcattttacaggatcacatgtagaagggacttcccttgtctcaggcaaaactttgtactttgagttaatgaaatgaattaaatctttgtgggattactgggaaggatgattgtattttttgatgtgagaagtacatgagatttgcgaggggccagtggtagaatgatatagcatggatatttgtctccacttgaatttcatgttgaatggcaatccctattgctggaaatggggcctggtgggaggtgtttggatcatgggagcagatccctcatggcttgttttgtctttactatagtaagtgagttcttgtgaaatctggtcatttaaaagtgtgtggcacctccccctgactctccatattgtttgctcctgcttttgccatgtgatatccctgctccaccttcaagttcttccataattgtaagatttctgaggcctccttagaagctgagcaggtgccagccccatgctttctactaatcatgcataattgtgagctagttaaacttttcttctttataaattacccagtctcagatatttatttatagcaatataaaaatagcctaacactagctactacaattcctactgaaactattccaaaaaatttgaggagaaaggacccctttctaactcattctatgaggccagcattattcctttaccgatacctcacaaagaaacaacaaaaaaagaaaaatttagaccgatatctctgaataacatagattcaaaaatactcaaaaaagtattaccaaacccaatttagtaccacatcaaagagctaatccaccacagtcaagtaggccatattcctgggatgcatggtttgttcaacatatgccaatcaatacatggaattcatcacataaacaacactataaacaaaacccacatgatcatctcaatagatacagaaaaggctttcaataacactcatcgtcacttcatgttaaaaaccctcaacacactaggcaatgaaggaatatacttcaaaatactaagatccatctatgacaaacacacatcatactgaacaggctggaagcattctccttgggaaccagaacaagacaaggatacctacactaactactcatattgaacatagcaccggaagtcctagtcagagcaatcagtcaagagaaggacataaaaggcatccaaataggaagagaggaagtcaccatgatatgattgtatatacagaaaattccatagtctctacccaaaagctcctagatctgataaacaacttcagtaaagtttcaggatacaaaatcaatgtacaaaaatcactagtatttttatacaccaatgatgtccaaactgagaaccacattaagaatgcaattgggttcacaatagccatacacaaaaaaaactagaaatacagctaaacagggttgttaaaaatttctacaatgagaatttcaaaacactgctcaaagatatcagaaatgacacacacaaatggaaaaatgttccatgctcatgaattggaagaatcgttgttaaaatggccatactgaccaaagcaatttacagattccaatgctctgtcaaactagcgatgacatttttcacagaattgctttggctatccaggctcttttctggttccatataaactactaataatttgtattattaataatttgtttgtaatatatattatatatttttatattatagtgttatatattatatattacatagtaatatataataatttattaataagtactttattaataaactattaataatttatatggaaccaaaaagagcctggatagccaaagcaatccttagcacaaagaataaagccagaggcatcacagtatcagaatttgaaccatacaacaaggctacattaaccaaaacagcaggcactggtacaataacaaacacatagaccaatggcatagaatacagcatccagaaatagagcggcacacctaaaaccatctgattttcaacaaagtcaagaaaaagaagaaatgaagaaaggactccctattcaataaacggtgctgagataactagctagctatacgcagaagactgaaacttgaccccttacctttcaccatatacaaaaatcaactaaagatgtattaaacccataaatgtatcacctaaaactataacaatcctagaaaaaaaactaggaaataccattctgaaaataggccatgggaaagaaaatattttcattatgatgccaaaagcaattgtacaaaaccaaaaactgacaaatggcacttaattaaagaggaaactttcaaccagataaacagataccctaaaaaacgggagtaaatacttgcaaactatgcatctaacaaatatctaatatccagaatctgtaaggaacttaaacaaattagtaagccaaaaaaaaaacaaaaaaacaccattgaaaaatgggcaaaggacatgaacatttgtcagaaggtgacatacacatgactaaatctataaaaaaaagttcatcactattcattagataaatgcaaatcaaaaccacattgagataccatctcatacccactcagaatggctatccttaaaagtaaaaaaataacagatgtcggtgaggttgtggggaaaagggaatatttatacactgctggtgggaatataagttagtcctgccgtggttaaaagcagtttggagacttctcaaagaacttaaaacagaattatcatttgacccagcaatgccagtactgggtatatacccaaaggaatataaattgttctaccataaatatgcatgcacatgtatgttcattgcagcactattcctaatagcaaagtcatggaatctatctaaatgcctatcaatggtggagtgaataaagaaaatgtggtacaaatacaccatggaatattaagctgacataaaattgaatgagatcatattctttgtagcaatatggaaggagctggaggccattatcttaattgaattaatgcaagaacaggaaaccaactactgcacattcttacttctaagtgggagctaagcgttgagtacacacagatgcaaataagagaacattgataagaggacctacttgaaggtcaagggtgggaggagggcaaggatcaaaaaactacctatcaggtactaagcttattgcctcagtgatgaaataatctatctgtacaccaaacctccatgacacacaattttcgcacgttatatacctgcacatgtaccttctgaacttaaaataaaaactggaaagaaaaaagacctatatgataactttcacttaataaaaagtaaatgtattttctcttccgtatgattttcttagtgttttttcttttctctaggttactttattcattgtaacaatacgatatttatacctataacatacaaaatacacatatgtgttaatcaactgttaatgttatgggtaaggctcccagtcaagagtttgttattagttgttaagatttaaggagtcgaatttatacataaattttcaactgtgtagttttagcacccttagttcccacattgttcaagagtcaactctatacaatcttatccaatcatccaaagtgttaggaatattctagtatcatatgtaaatacatgcatgtacatatatttatatttatgtttctatgcctgtgtattaaaaaacatgagtttatactcatatctccaatttataaacaatacctcagggtgccttttacttctcctttccgtattagcagttcctcctccaacagtgagaaacctagcttcattaatttcaacaatatctacaaatttgctcaagtcaagaatgcatggcaaaaaggtttagaatcactaaccaaaaccactaataattaataattaaacaaatctaataagaaaacaatttatcatcctgttcttagctaaaatgtacacataagtgcataatcctaaacgtatgtagattagatgggttttaaaaatgcatacagttttaaaactcacattttttaaagatataatacattttcataaacagaaaattccttctgtccccttcccaatcaacactgttacttggggtaacaatttttttaatgtttttccttatttttgaaataaaaagtgaaatcttataataggtcccttttcttttatcttttgtttagcataatatttgagagagtcttatgtcagtagtttgatccttccttcactgagtaatagtccattgtacatacatatcactaggtccttatttattttcatgttgacagatatttttttgtttccaaatctgggttacaatcaataaaactgctataaacatgcttgtaaatgactttttatagaacaatattttcatttcacttgtttatataaattgttattcttagcataggtgtatgtttaattttaaatataatctgcaaaatgtttttcaaattttttaaactttcatttgattccctatcaacaattttatctttttaccaacagtgtgtgagactttgagttacttcacattttcaataatttttttattaactttagtctctggaggagtattcacttttggttagttttacatttttctgatgattaatcataagaattttttacttatctttcaatgaaaatattttctccagttatttgcacaccgttttagtgttttgttttatattagtgaattataagcgctgtctggatatattctgctttatgtcctgggtatgtgtttgtaagtattttctctcatgcttattcattttctaaatagtatcattggtgagcaaaaattttaaatttggttagtctaaattatcattttttctttaatgattattgcttattttacatgttctaatacaaaaattcctactccttgataacaaagaacttctacattttctccttcatagttttaggttttacatagagaatgatgatcatctaaaattagtgtctttgtgtatgatgtgaggtagaagtcaatgtcattttttccgtatgaatatctaccatttccaccatcattttttaaaaggcttttattttcttattgaattgctttggatattttgttgaaaataaattaattgtataagtgtggttctatttctgaaatttttcactttcattgatcaaaccgtctttttatttttcaaattaaacactttcttaagctgtaaaatcagatggtacaatttgtcaactttttcttgtatttaatagacttattggccattatatgtttatacatttctatatcttaaaacacatgtcaatttttaaaaaaaactacttgcattagaagagggattacattgaatctatgaattatcttaaccacatttattcttccagtatgtgatgtgattacatttttccattcttatatatttaatttctcttcgcaatgttttgtatttttctgcatattttcctttttaaaaatattaaccataaatattttatggttttgcagattttataaaaagatattttagaaagtttaatttataatctcaacctaagtcttatgctatgatggaggaagacttttggtatcttagtaaaaaagggtgtattttgcatgtaagtggaatataaataatcattgctagatagcaaaatgtagtaaaaagtaaatggataaatagacaaacaagaaaataaataaataaaataaatattacctcatttttgaatctggatggactctgaaatgtttgcacgatagaatcttgcagaagtgttactttgccaattttggcccacggatcttaagagacttgcactttctgattctttcctcttaaaatagttgctccttaccaggttctcaacttcaccattaatgacacttttatcagataatttttagttgtatgagacttcgttactcattgtaagatgtatacagaatccctgacctctaccttgtatttgtgaggctacgccaaaaaatgggttgtgaaaacaacaaaaatttattgtttcacagttctaaaagctagacatccaagactaaggtcttggtaaagttgattccttctgacaactatgagagagaatctcttccatgttcctcccatgttttccagtgctttgttgataatgtctgtcattcgatggcttgtagaagcatcaccccaatcactgctttcatcttcatatggaggtctccctgtgtgtctgtgcctaaattttcctttttgataaggacatcagtcatattagattagaaacctatcctactcaagtatgacttctccttaactaattacatatatttgagatgactttatttacaaataacattacattgtgatatgacctcactgagggttagaactttaaaatgtgaatttttggaggaaaaatttagcacatagtatactcacttgatgcctcttttattcctccagtcctgacaaccataaatgtctctaggctttgccaaatgtctcctggaaaggcaaagtcatttctagcttagaaccaatgttctaaaaaaatttgattacccccaggttgccatgttgtaaggaagcccaagctagtcatacagaaaactacatggacagaagagtgtttgaccaatcccagctgatcaagtgggatgataagtggtcatttttagatattatgtaacacagctcaatctctggccacaataactaagatgctcaataaggaaattaaactcttttctacctataaatatcttatcacactggaattcacttaaaatctagaatagcattatttagattaagtctggatgtagattgcagaattgtagatgaggctactttactacagtttctctgttttcacttttgggtacagtttttcttgattcagagacttacaaatttaagacgagttatctgctcatccatattctcaatatgaaaagttaagcagagacagaaatactacaacagataaacattcttaaaaaaggagagaagaagaaaggtatatagcacagatcagtccatagtacttctgtgacccttcctctgcaagccataagtcgtggctcacgttgcaggtgaataattttcttagccagcttcctgccagacacacaaatctctcagaattatgttctctctaccatgaggtaagagttaagatatgtcctcatgatttaaaaatatatttatctacctgaggggtctacattcctctgccttagatgattcttaacaaagggtttaaaaaccatgcacccttgatcttgacctgaaccctacttttactggtaatgtcctggattcaataatggctctgagtctattttgaaaactttttaccagctggaagtctgaaaataagaatcttatttattttccaacacagtactcctgtgttaaaaatattttttctaaattttggttaaaaacagtcccatcgtcaactcatctcttatttcctgttttatcataggccagtaaatgaagctatttggtaacttccacattttgtcctgaaatcttagcctagttaataaggtcatgctgtatattttctatctttcacattggcacaagcaacagtgatcccagtatttggtcaatatataatacagtttccatttctccagctccagtacaaatttcctcactgatcttacagacatcattaaaattttctgtttttgcaacctctttccaaaatagtctcaatggcacaaaactgttttatttatggtagcatctcacttctaggtactaatttctgtttcaattgtctctatctgtaacaaacaactgacttagagacttaacaaataaaaacctattattatttctcatgaatctgcatattgtatgcatggttctgctgctccacattttgttgactggagttactgatcaactgaccccttcagtattatgataatcatttttacttctggtctgggatctatttgttctaatatgaatatagatcatcacatttttatgcctttttttgaacagtatatctgtctttcttgcaacttatctatgtctttatatttacctgcatttcttgtagattgaataaagctgggccttgatttttttatccagatgaataatctatacctcggttggatttttgtctagttcattgacattttatggaattattttgatcattgaatttatgtttaccatttgctttttgtaatttggcctattgttttttgttgtaattttcttgctttcatttctgttttattttggttaaatatttttattatttcattgatatagccatccctttttaaatttttttttacttgttgctctttggaatgccttttgcataatccatttaaatttgcactactacacatataagaattttacaccagtatggttcaatttatcacatttgctatattattgtcatatttgttatgtttattatttataaatccaccattcagcattataacatttgtcttaaacagttgcatgtgttttaaaaaataaaaattttgtatattctagtgtatgtgcctacatatttttcattttcaaagacttcatgtctttctgtaagtttccacttggtgctatttccctttatgctgaagaaattctttaagattttattagcttaatatttattttattaaaattattatatatatgtttacgagatactttaaaactacacatttggctaacattttaatttatttctgttgggaagcactggcctcggttatgtctatgtaaacgtgaatgtgtattaaatttcctgagggtcatgtgaaaattcaatttctgattctataggaccgggatggcctgaaaatctagatatcttttgattttattctacattttaaaattactgtgattttttgttaaatcataactgtatacatcatggggtacaatgtgatgttttgatatacgtatacaaagttcaatgattaaattgagctaattaatatatctattacttcatttatcattttttatggggagaaatttgaaagttactcttattttgaaatatacacatgtagtaagtgtttaaagcaaattttataagggtgaattgtgatgcttataaataacataactaagtgtaataaatatgacaatagtacagcaaatgaagtaaatgggactatactggtatattatttttatatcagtgtgtcatagtacaaatgaactctaaatggagtatgttaatggtaatctaaagtactttattattcactgtagttacactgctatgtaatagatttcaaatcttatgcctctttttgaagctttgtacccttttatcaacaattcctaattccctcctgcgcccctcctccagtctctggtaagcattattttgctctctgctactatgagtttaacgtttttagatttcatatgtaagtgagattatttggtacttttctttcagtgtctggattattttatttaacataatgttctccctataggttaatcaatgttgtcacaaaagttctttttcaataatatttcatttatgcatatatatatatgacattttatttatccattcttccattgacagacacttaggttgattccatctcctgactattgtgaataatgctgcaatgatgtgggcatgcaaatatcccttcaacatacagatttcacatcctttgcatacatacccagaaatggaattatttgatcatatgctagttatattttttagttttttgaggaatctccgtaccatttttcatgatggttttactaatttacattctcagaatgtgtaagttccctttttcctgcatcctcaacaaaacttattatttttcaccttttgataataataagagccatgctaagaggagtaaagtgatatttcgttgtggtttttataatatttgtatttccctcatgcttagtgatactgagcatttttaaatgtatctgtttgccatttttatgtctgcttttgagaaacgtctgttcagatcctttgcctatttttcaaccaggttgtgtgttttttgttatagagttgtttttgttccttatatattttggatattaattccttatcatatgtacggtttgaaaataatgttttcctttctgtgggttgtcctcattttgtttgctttgccatgcagaagctttttaccttgatttcatcccatttgtctaattttgcctttgttgcctgtgcttttggagtcatatacaaaatatccttgcccaatccaattttgtggagattttcccctatattttcttctagtaattttactatagtgaaaatattctgaggatgaagtctctctagtaataattatattcttgacatcgtgctgatatgttgcattgtctctggattctgttttcttcctttaagcaatgatgttatttattacagaatgatgttatcacatctgaactcaaatgccataccccacctcaatgtatttggaagcagccacaaccactcagctcctcatactttcagtggttgcttccactggggaaaattgagattccctatgtgtgtgtcattcaggcattaacaaaggatttgtgcaatttgtattttggtacccttccttatgtggtgtcctttcttgaattccccagccccttcacttttctgccattctgggagcctcaaattgtcctgtgactcttctacacttaaaattgcagctttctcctattgttttcactgcccatacatatcagactgaaggtagccctcaggtgaaaagcaatagaaatacacattttactcagcagagcttctttctttcaaagcttgactcctctttaatttctgtctgcttctggtaactctttagtgccttaaaacagttgttttcatgatctgtttagagttcacaattgtcatctgaagaatggtttgtctatatgctattccaccattgccagaagcctccaggattactgtttgcctttttgtgtgtgtgctctcctaagtccacaatatcttagatttctgaacactctgatctttgacaaaatacaattttcatagtgcaatgttttctaaatcatttatttccatttaactctgtgcttctcacttgaatcaacctcccactgtgatagttttccaaaaccttgccattgtatcctgctatagtctgaatgcttgtaacactccacagccccgaatttttatgttgaaatctgatttccaatgtgaaagttttggagatggagtctttgggggcatgatgacattctgagagggaaaacctctcgaataatttctgaggtgtataagaaattcgagtccttataaaagagactacagtccttatagaagagatccttcatcccttctgccatgtcaggttacagtgagaagataaccacatatgaggaagtgagctggtaccagacaccaaaactgtttgtgccttgatgcttgactttgcagcctccagaaccatgacaaatatgtttgttgtttataagccacttagtctatggaatttaagatatggactctgaaatatttgctaagaggtttaattgtcctagagggtttggctcaagaacagctgtagaatggctagggatgtagctggtagatgtagatgtgtttagaatttaacaattagggttaaacagctagggatgtagttggtagatttgttatagcactgcaaacaaactcacccttttgttattaacaacctttcttatattatttattgaatatacttttaccttattgcttcattaaaacctgtttcattattattgcatcatattccttttgtccctcttaagcaacagtttttttctatatcaataaaacttcagactcaagaggtgggattacattcccctggttattcattgacacaaagaacctattaatttctctttatttcctcaattctggactactccaactttttaattctatgcaactcctcttaggctacagagcaccaatagagaaaaatcacacaagtttgaagactgatgtcaagaaatgtgtgaactggacttcaatagtgcctaaatttttataatggaagactcttccagggaaaagagacagaacctcagtagaatcaacattggtacagtgataaatttattagctcaagtagcaaatcatgagagtagaagtgcattcggctcaggtacattagggactataactttgccatatctgtttgtctttttatagctttccttattattattatgattctatccttctatgaacttttttcttccaacttgaggacttccttttgccagtaattgtaaattcatgtttcatatggtcaatgtcaaataaagtctgagcaacattttcccaaattcttcattcaagattccaagaataatttttgatgtggttgagggtagatattaactctagtcaaactagcaactcctaaagaaaaatgtggttaggaaaatcattttcaagtgaaatagacactatcaccagcatacaggaaaatgtatattcatttaaatgtgaaaagttttatactctctgatatggtttggctatgtgttcccacccaaaactcttgttgaattctcaaagttggggaggaacctggtggaaggtgtttgtattatgggggcagatgccccataaatggctttcgtcacccctttgtgataagtgagctctcattttgagttcatgggagatctggtcatttaaaagtgtatggcaccttcgcccctgccccactctctctatcctcttgccatgcaatgtgaagttgtgcttgcttccccttcaccttctgctgtgattctaagttttctgaggcctctgcagccatccctcctgtacagcctgcggaactatgagtcaattaaacctctttttttttttttataaactacccagtctcaggtaattctttatagcattttgagaatagattaatatactttccttgaattataaattgttatttttctagtcagtcacagaatataaccatacctccaaattccagagaacatggatttcatcaaataactccctcaaatttctaccagtaaaacctctagtcttacctatatctccatccatactttgtatttggttactttattaccaaagaacgacagattcatcactgttgatcttgacaaagtccaatttattaatttttccatttctggatcctgttttttgtttcaaatctaagaattctttgaatagctctaagtcccaaatattttctcttatgttttattctaaaagatttatgattatatgtttcacatttaaatctatgaccatttatatttaagatgacatttaatgttatcaccagatttgtagattaccatcataccacattccactgccctctctgttaattatcttctctacctcctgaagttgtagtttctacttctggtctaacatcttcctatgcacacattaggattactaagtgtgattggatcctagcaggcaagagatgatgcaattgaactcagaaatgtgtggggaatttaataagggactacttacaaagtgcggcagagcatgtgaaaaccaccagaaatagaatgaggtcttttctgccacccaggagctgagtggaggtagctgagtggatggtgctagaacctaaggcagaggagctgtgtggagaccactgccttagggaagataacctgatcagtggaggggcatagccagcttgaggcaaaacacagagggaaatgaggtgataaatgtatttgcatctgtctcttcctttcctcttatttcatattggggctcccatttgccaaactcaaaagaaagcatggaaaatacaggtcatgtagtgtagcttcttggacactgagtagatctgaaagggttaatggaagatagccatagtctcttaagccccataacattttgataaacaaatcttgcttttgtctcacgttccccctatttagcctcgtttctccttaccacttttctaccaaatattttcaagaaggaatctagttttactattgccactttttcatttcatctgtacagtcccaaatatatcatcatcaatgactaaactccactgaaaactcttcttgtgaaggttaccaaggccactttagtaatagttctctggaccattttcacaccaaatcacattggactgtccaatcctatttaggactttcttactacttcttcctaattggaactctcccatcttttgtgttcatctttggcttctcattgtgtgttcctttcccgatccagcctttatattttagtatttcttagtaaccaatcctatgaaaaaacttgaccattccatatatacttctttttgactggtgatttataaaacgatagtccttctagaactttctcctatgcttcagatgcacatactaggattatttaaaggaaaccttgattttaataatttacaatctgacagattcagtatgcttgaagctctcctgatctccctcttcattaaatgtgcttcttccactcctgtttccctaaagcaacaatccatttatccgacctaggaaactgaacatcattttctttttttcttactttacacatctgaacaccacaacattctaacctattttgtctgtaacctaaatatctcctgaaattatccaattacctaactcaagccctgtttccatacctctacaatagaccacagcttgatttctgcaagcagttaattttttctttccagtgtgccataagtagattttaggtgccttgtcacaaaaagaaaagtaaccacatgagatgatagatgtgttaatctgcttcgctatagtaaccattttactatctatatgtatcccataaatcatgttgtaaatctcaaatacacaaaagaaaattaattcaaaagaagaaaaaaatcaaattctactttataatttagaataatctccccaaatttatgtttaattttccccagattaatgacttcgcattgcccctaatattccttgggtgacagttctggtttgaattctgttgaaaactccagcttcatgttctcagagtaattttagctaaactgaatgtctttgaggtctttgaattcccacaggttcttttgcctctgctccctattttatttaaatttattccaggaacatgtataatacgaggatatgcatggcagtttagcacttatcaatatatacttctttcaatttaaagggaaaagaccatttttcacatgctgggaaataggtagttgacacatttgaatagatttgaacaacctgaaaagcatatatagtgaaaaagtttaaaagttgaggacagaatgctgaataatatcacagtttaagggtgagtattgtgctggaaatgaagaaaggtacccatttagaaaacaatagcgttgttattactttccaatttttcaaagctttcagaccattatgaattcaatgcaaacaacccttctctgtgatttttaacttaattataattttgtctcattgttagagtgtcaggagtacattttctccttttgacaatgcaaataaaaatgattagtataaaacgtacggtatagttaaacatttctctaagtttaccagacctgtcatcctattgttgcacataataggtaactcagctgggatgggccgtacattaacttgttgataaaaccatataatatgtttatacttatggtcaattacagtactttttcacttgatatgctaactttacagaaaatatagtcaaatataattacccacccaaatggagcagtcaataggttataaaggaagaaggaataataggtctggtccattaacatgaaataaaattaaaatagtagaattaaatacatgtttggccaagatattaaagagctttgaatctaaaataaaaataagagaaaggaataaaagaagcaaaaaaatattttgttttaaatggtagatagaaatattcacatctttcactcaggttccctatatgcttgctgccaaaataaccttagcatgttagcacttacaacgaactaaaggtaaggatttaatcaccaggaagaagaacacaatactgctaataaaaaccaatatttgctccatatttactgtttaattgctagacagaacaaatgaaagacaaaattaacttcaactatttaacgaatcgtttattttttttctattggattaataacttattatggactcagtattttacagttcattcaatttatttgaccactcctccaaaataatactcatattgtcattttcattaaagaaatttaactgacttttggttaatattctaaattgatctggacttgactttaatacatttccagaacattagagatggttgtttgggtagcccagccaaaatattttatactccaagaatctttagtatagctgtagattgagtagactggagcatttaattacagcatctgtagatccccattgtagcttgacacaagaatgactgaatatggcctgtgaaggctgaaaaactaattgctccattatctgcactccagtctttttcacttcacaagcacttaaaaatatatacttaaatctgctttctaattacaagttcccataacagagtgtccctatccagaaaacagcattattactctggctttcaacacacttaagcatttttattttgctgagttttgttcttctttgtttactttcttttgtaaacatgtttaatggctaattaccatttcagctttttatattaattactacacatttagagacatgtgtctttaaatctctagcagataagacatttgctttgctcaaacattattttcattttacttgtctatacgtagctttagcagaatgacattcttattaagtacttactttcttgagaatcaagcaataatttatgacaaagccttatcttttttgcattagctactgaaaacttttatattttagaacaaaagagtaacaacttatttctcagcatcaatatatgacagaaatataaggacaattgttttaacagtgatatatgcaacattattttcccccagaactccttcatttaatgaaattcaatatgtgcaggtttcattttatgaattataaagtcatcaacaatttagtttgatgccagtaaattcacatttaaaaatctgaattgtgcatcatactttatttttaaattgacaaattaaaaatgtatatatgtagcattcaatgtgatgttttgatacatgtatacattatggaatggctaaatcaagttaatgaacacatgtattacctcacacacattttgaggtggtgagaacacaaaatctaatctgtaagtaatttttaagtatataatacattgttttaaactatagtcatcatgttgtacagggcatcttgaattaaataaattctcctaactgaaattttgtatccttttaccaatacctcctcttggatgaacctggaggacatcatgttaagccaggcacaaagagacaaataccgcatgatcccacttatgtgtggaatctaaaaaaagataaagtcatagaatcagagagttgaatcatacctttctgtaggtactagcattaacttcatatagattacagtatcactgatatattaataggcaatattaatattaataggcaatttgagtattgtggtcttttctacccactaagaaagcagccctattcctgaaatgcactttgcttctttaaatacttcattggtaagtaagacacttcctcaattttgtcaggaacaacatttacatggtaggcagttatcttctctttacttccattatatttcatggacattagttttagaatttaaaactgctgattgggtaagggttgccttattggttagcactgattataatatattttaaggaaatagttataactatgtgaaaaaatagcatttttcacatacccaaccccatttagttctgggggaaagatgagtaagtgtgcttaatcccaggtgtgtgtgtttttatgtgtgtgtgcatttatgtatgtgcttaataattacttttcttatgtagaaagaaaatttatactttgaggcagtatttaatctcatttactttacactcaaaacataaaatcccctacttaatacattttgtatatcaagacaaatttatacaaaattcatttttggaagtgctgggcatagagggcttttaataaagagtgcctcagaaagccatcattggccatgacaatagacacgttaatgacaacagtgcttattaggaatgacttcctcatatctttttgttttaattaaaatagaaaattgtggtatccgaacatggaaaatatgtatgcagtctggatcctgctttgctacatgaaaagcatgaggttttgttcaggtatattataataattatatcagggaaagtgaaaactcatttttacatattaaaatttttgttcatttctgaagaaaaattaagtccacagtaacagaaaaccaaataataccctttccttcaaaaagaaatacgtatttgaaatttatttgctaagttcagtttctaagactagaatttgaaagggagccagattaaatcaaagccaaccacttacgccagtggatgaacacttcatggaaaaagaattgtattaagggatttattttccacatttatttgttttttaaaaaatgaagaaaaaagattctacagatatcaaaaaatatacagcattaataacattttgtatgaaagctatgctatttttggaggatctgtaattttagtactagaaactaacatgcataaaaacactgcattattcagctctgcagaagtaattacaccaagatttttctaattattttctattgttcccataaatggactatataatcacaattcccttttcggacaaatacctttttccagtatgtgctttaaaaagttataactggtaataaaacgtaacttctataaatggcaaaatgtttgaactagggtaaattctcagaaaaacactcaaattctcagaaaaacactcaaggtgccatatcttacaatttcatgtatttgctaaacagtcactgtacatattctttacattttcaaacaaattcataaatgcataaactcataaagttatgtattattattatgctacacattttactcaaaatgaaacagttatgaatctaacctagtacaatggggtaagagtcatctacttcttatataaaaaagatagacatcattttatcaaaatatatgttcatgcaaataagcatctaatagacaaaacttggactatatcaacagaaagccacaattagctcaaaaaataggttataggttatagtttgatcattttctacaccaggggccagcaaatgttttctatagaggaccagatagtaaataatttaggatttgcaagcaaagagaacatatactctgtacttgcgtctgaagcagccatccaccatacataaatgaatgagtatagtcgtgtttttgagaggcacaaaacaggtaaaggcctggatattctcccacaggacatattttgctaacctgtatctattgaattccaaacaagtaaagttatcaaattagtgaatcaactaaaaatttaccaacttaatcttgtgattttaatgtgtcattctggagttacattgtttatgtgtactatttttctttctttgggaaaaagactgtgaaatcactaacaggctcagagcgaatttaatcagaaaacaaagagtttctaagttttacaaatagaaattatttgagctttttgcatagaaactgaactcatagatggattatatatacactttttcaaaaattgtatttattcataacaataaaaaattcaattctagtgaggtattcaaggaaagtctttcctattagcattcaaaggttaattcttaacaatgctggttgctgtaaagaacaaagtaccttaaccttagtggtgtagcacaataacaactcataaattaatttgtttatctctcagtataataggggtattcctggtctgtgaacatcttttcatataagaattagggacctatactcttccatcttctggcttttctctagtttttcaggcaactccaagaagaatgtagaagaaatgaaaaagttaaaaactgtgagatatttttatgaaccacattgcaagataaaaactactattgattttctgttggtcagaattcattcacgtggtctcatctacatacaagataattaagcctgtgcctagtagcaaaagaaaaagataaacatgtagccatcttctgatataccagacatgtttccagctgaaagatgtataagaatataaactgaattagaatgtatttatgtctaggatagggtgtctacagtataaatttatgtgatgtgatttccagaaaaatattatacattattaggtatgtgcattttaaaataatttaaccttgtttttgcttttttgttttatgtatgtacagttccattgaacgtgttaatgtaccatataaagctaaggcactaccattaactgaagaatccttttcactataattcatagattaaaatatttagtatttagtatatgaaggttaaaatatttatgattacctaacatttctattcatgctttgcaaattctgttttgttttaatggaaaatattttggtttggttttggttttaggttttcttttgttactgttttttatttgtttattgtataaatggggtctcactttgtcactcaggctgggctgcagtggcacaataataattcacagaagcctcaaccttatggggtcaaccaatcctcctgcttcagcctcctgagtagctaggaccacaagcatgccaccacaactggctcatttttcctttctatttcttagagacagggatttgctatgttggccacgctggtctagaacttctggcttcaagcaatccttttgcctcaacctctcaatgtgcaggggctacaggtgtgagccactatgtccagcctaatgtaaaatattttgaatcagaaattatttgcaattgtttatttgtaaattaaacttttattttagagtagttttagatttacagaacagttgcaaggatagtacagagaggtcctgtatactccataacaagtttcccctgtattaatatcctatgctactatggtacatttgtcacaacaaatgaaccaatattgatgttattaactaatgtctgtactttatttgtatttccttagttttaagctgatgtctttttttctgttccaatatctcttccaagataccatattacttttagaagtaatatttccttaggcttctcttggctttgaaagtttctcagacttttcttgcttttgatgaccttaacagatttgagaaattctagtcaagtattttttagaatgtctgtcaattgggatttgtctgataattttttgatgactagactcagaaaatgtacttttgaaaggaagatgagagacaaaaagtgccattctcatcatttcatatcaaaagtttaggttattaacacggctgtgtatgttgatgttaaccttggtcctgtagctcaggtagcaattgtcagacttctccactgtaaagctgctcttccctccatgaccccctttttacatgccatactctttgaaagccagtcactatctgctgtccaaatttaagggatggggagttttgttccacttcattaagttcaaagtacctacataaattatttgggattattgtacaaaaagatgcatctattacttctcatttattcattcaaccatacatttccattagtatggactcttacatatttatattttgggtaccagccaatattcctttattttggtgctcaaatcattctagctttgatcattgggagctccttccattggctcgctttgacttaatctcagacttttgtgtttaagtacttccacattttctggcattacaatattattcatgctatatttcatgctttagtcctaaaatagctagatctctaaggagatttgattttttaaattgaagaatgtatgaaaatccaaaatctgggcagtagaaaaacagctattttttaaatgaagtctaccagcctgggcaacacagtgaaaccctgtctctacaaaaatacaaaaactaccctgatatgctggcatgcacctgtagtcctatctactcaggggactaaggggaggatcacttaagcccaggaggcagaggctgcagtgagctacgatagcaccactgcaccccaaccttgttgacagagtgagatcctctctcaaaaaataaaaaatgaagtctaatatttttaccgagattacttaggccattccctctgtatctttaaagatgtatgattaaataagtatgaattgatatcccacctgcccaagcatgataaaatagtgtctattatataaatattacatatttgttagaacattgttggaaattataattaaacaattattattaatttttggcagacattgtggtatttaaataacatttctcatttaaattacattcaactaaatgagctagatatattcttattgtcatttaacagtgagaaagttataacttaatgtgtttaaatggatgtaaaaatatttgaagtgaggcaaacaatcttacatttttcataagtaattataagatacctttttaaggtaaataggtataacattaaaaaaaatctaaattaattttatttagttgaacagtttcaaatttcttagcttagaaagagatactaaagttcaaggaagtactcaatgaattagtatctatatactagttgcaataatatattaacatatttataaggcaaagcaaggatttgtttagtttatggagaaaaaatacaattcctgaactgaagttgaagaaataccatcaaagttgaacactgaaaaattaaacagatgattagcttagaaagaagaagagaaaacttgacaatttcataagaaattaaataatacagaagaatatttcaaatataacatgctaggctggtaatatattccttccttacttttttattgtatcttttggtttcattggtgacctttcaaatagaaaaataagaaactcaactattttagtgtgtatgtaaacaaaactaatttcactctagtttctgcctaaggaataattggttggtcactttagaagctgactttaagaaaatgaaggactaataatgttgttggaagactgaaatgagttcagacaagagacagaagtgctttttaaagttaattatgtttgcttttccttatcccttggtgttcattacctttaaatggaggcacacactggcagaagtaattaccaggttggtcaatgcaggtggctccatttttgcagggatgtgaagcacactcatctatatcaatttcacattgcgtacctttggaaaataggaaaaaaaaatgttaagtgttaacaagacaggcatgtatcaagtcgtaattcttaaatttgcacaagcctttaatccacttaggatgacatctgaaaccaaatttattagataagaatgccacatatattactatcagaacccatttatttcaccttgctacaaactgtagtaacttctcttagaattactaaaaggacactaatctcttctgagtttgtaggcatgcaaagtctctttagatgtgaactaatttatcttttgctagagagtctagagatggtgcagatatttcaggttactgaaatgcagatcaaatgttaggtgaaaggaaataaaaaaggaacgaaaagaaaatattggtgaatcaataacatcctgatgtatgtccctgagggctgaatgttatttgttcatttgtttgttttggagagggaatctcgctccgtctcccaggctgtagtgcagtggtgcgatcttggatcactgcaacctctgcctcccgggttcaagaaattatccagtctcagcctcctgagtagctggaattacaggcacacaccaccatgccaggctaatctttgtattttcagtagagacagggcttcaccatattggtcaggctgttctcgaaatcctgacttcaggagatccacccactttggcctcccaaagcgcaggaattacagacatgggccactgagcctggccctaaatgttctttataaggcacagttattgagtactatttactaataaagccatgagtaatgggtagatgcatttcaatctactcatgatctttgtagatataatattatggtgccagggtgatgaattactttttttctagtaattttacaacgtaagcctatatggaaagaaaacaaataaatgtccattaactatatagtcttagcattttctttaaactgttgtccaattcatattttcattcatcctccacctagaacttgttttgctaaagctgacctttcttattataccacttagattgcttaatttcccaacagttgaaaatcatagcctcaactgacactgaattgatttttatcacttatgacagctaattttcttaccaatttataacaataatagaaaattgacattgacacaatgcaaattattagcaaattatttgaatggaaacattccttctttttttaaaaaaattctgtaaaacagtaacatgaatttagaaagaagaaaacctacatcaaattaatctaataggaatcaacgtactggactaaatagaaaatatcactattatcactgacaaaatgaaatatttagtgaatacctgacactagaacatcagggtaagctgagaaaaaaagtgaatattaaaaagaattatgtgagtgaatgaaaactttttaaaccttaaatatattagtttttttaatgagataatttaattttgtggaaattgagaaccctactgtcaaagcaaaagtttaaccagaaaaaaagttaaacaatcaggaaagattttattgaaggctattgcaatcaaggagagaagccaaaaatcagtctgagtttgactccattgtaacaatggttgagagtttttaagagctggggtaagagagctcataggtcatatgcatttgctatttagccttaacaaaaagaaaattagatttgtttttcaatcttcaagttaggaggtagtattacaacttggatcaaggtgcataccaaagttagtctcctaccctcctacagagactgggagattacatatgctatcttccttacacttcaaagggatggctcccaggtccttgagaaagatagtcttgggttcctaaatgaacaagaggcttttaaagatatttataccccaaagaggcaaagaaagaatttataattattgggttctgaagtaaattctctaagaaaatgaaggggaggaacttctgtggttagatcatttagatcctgtaaagaggtaacaagagaagcacctcaggaagaaacctgtttaagtttagtcacactgagggaaacctgtttgtcttgtgacaaatacactttgtggagattcctacagtcctcaagttcccaaagactggaaggaggaaagaaataatgaaatattaatttataatattaacatgatactcttctaaatttctggtgaagttggagaaacatgggtcacattcctgcacacaggggaatcaatcaccctgtccctctctaggttactattcttaaatatgtctctgtgtcttctgatcccagcttccccttatcaacctgaatgtcacactgccatgagcttgtatttctaaaagacaaatgtgatgaaatagctaacaatttcagccttcaatttctttccacccctcatccgtatttcccaaactaatctattagagcaatcctaactaatgaggataaagaatttatgatcttagacatcaggagggtttgacaagacacctacaaggaagactttttttttttttcaaatttgacactttaaattcatgcaaatcttggattttgcatcatattttatcctcattaatatataacacattctataacacaatacgtatacacccatagggaaacttgacagtccaagatgattctacaatcactgttgtgactttcatgaagctttaaattcatcccctaaagtacagtgctttagcaggagaaatacaaatttagaggatgatgtaaaaaactcacagcatactttacaggaacatcatggtctgtacctagccttccttcttggtcttctctctcttatccttccctgtttcttgttcaccctcttacccaagtaaccacaatgaatttttaaatgcctgtgattttgcctgggaatacctggtttccttttaaaacctggatcatctcaggtatcctctgcctattctttctgggtacaggttagcacaacacttttctagtgtttacaccttcttctgcagtcagttgcatatataaatacatatatatatatgtgtatatacatgtgtatatatatgtgtatatatatatatatatatacacacacatacatatatatgtaatttctttaaaatgtatgcttatgaaaatattttctagtatccatggctcttagaatagctactgtctgatattagtgctcaaaaaccatttgttaaatgaatgaaaaattaacagactaaatgcagaaaaatgccaatgatactgtatctgtaaaggacaggtaatcattttcaatcctgtttaggacaaatcattaacaaaataataaaattccaaatgatgtaataaatatcataaagattgccagaaacagattttgcgactgactcttcaatttcagagtgtgttccacatgatttggcaacaataggccacatttaaggtgtacatgtatataattttagagcttttattgccaaaatgtagattgaatttaaatgagatttcaatttgattcagtgagctgtagtaaaatttccacttatttgacaaataaattaataagcataagtagtttgaacacattcaataaaatagcattcatgtatccttttcaaaagtttctgggcagacaaattaaacaatcaagcattctacatctcattattttaaaatagactttaatttttaaatagttttaggttcacagcaatattaagcagagggtacaaagatttcccatatactcactccacacatgcgtaatctctcccattatcgacatcccccaccagactggagacatttgtgacaactgatgaacgtacattgactatcagacacttcattttaaaataagtttcatgtgttaatttctaaataatcatattttttcttcctcatgtatttctaggtctatgtttcaattccacctaacacacacacatacacacacacacatatacatttaaattagttttccttttaattgtttaactgaattttaatctgttacttaatgatatttacttccatcatattcctcaattgcttgcaccatctgggctaaatcacactgtgatcgttttctcctcataggaaccatcatgtaggaatcatccattgaccaaaaagcaatccaaataattagagttctgtttcatgcatagtatctcaaacattctatgctttctttactctgggttttctgtttcttcttactctttatttttttgtggtctgtcctaaatcctgaatttgcttcctgttttctcctgtccattggatgtcacctttatttttgtttattcattctttcatttgaaattatatttttctacctattcatgtaattgaaaccatcaactgatttacagaaacctcaaccgtatcatgccctctacatgacagactcccaaatcaaaatttctccagtcccaggaactcctggcttcaatgcctaattaaatattagttgacaacaccacttggacatattctaggcatctcaaattcaacatgggcaaacaaaactctctaagcagctctaccttccttattaactgtgataaataacaaaacccaagagttattctttattgttcctcaccctccctgaattattagtaaatctttgcaactttatgtctaaaaatgtaccaaacctgtctatttatctccatctctattaccaatatctagtctaagtatccccatccccaatgagaacaagagttgctttaactgtttttctgctttcactcttactctaatgcagtgcacaacacatccagagtaatttttttaagtgtaatataattaggaaatacaaatccagtaagaaagttaatggcagtactccaaactccttaccttatatgataaggccctgaaaacctttgagtttagaacacatagtaatcctttcttgctcacttattttccagccacactgaacttctttagattattttaccaaacccatttttacctgagggtcttgctctaacaacttctatcactggaaagtcttctctggaggataactcattcttatccagtttttggtgtaaatggaaaccgcataaagaggattatctttactatccagtaactcctctcacatcaccgtcttttactttgctttataaaacttattacacacatagacatgcatgtatatgggtatgagtttgtgtatttcttatttttgtttggttttcctcccacttgaaaattagcacacaatagcaagtaccttcttttccatccttagctgttggaaaatagttgacaaaatagttcacagcgcaaagttgggccacattaaatattttaaatgaattcatgtattcttggaagtcagagtccattattagtatatgaaaattacatagaaatgcaactgtttatataaaacaaagaaaaaatagaattataagaacttaatttacatattttacaattttctgaaattatatgtaaatgtctttcaatcttcaatatttatgaatatcattattaaatctggttattattaatgtagaggtggaagctattgcttatcctactgaacttgtttgatcaccatcaaattcctttttacatatattttggtttgtggaatgtattataaactacatttattctaaacaaaagtcttactttaacataaaaatctcactgtatagcacgttatatgagatttcttcttcagtagaaaagaaaaaggcactaagtactattactgtgggagaactagagcatagagtatggtcagaaaaatgggggtaaatgtcccataatttcaaatcaagtcagagcagtagctctttcacttacaacccaggtcagaataatggccaaaaggtgtctgatccaaggagtttgggagaaagtcaatactttcaccaatgatgtaattaaatgaggtagaaatctaaagttaaaggaaatgtcttttctcttccatgcttagttttcattcagagtaactttgccttaaaactcttgaccttctgttattcaaatttttttcttcccaaaaatggcacaaagagttatctaaatggtgacaaatagccattggctcaaagttgttagtttacagtacagctaaactttcaaagttggcagaagagtaaatcactgtctcttgccttcctcactggtactgatagaagccaatagtctaagtactctgctctgcagactggacatactcatttggattttacactaagctatatcctcctagactttattattaatgtaatactttgttggatggaagaattttacactaagctatacactaatactttacactaggctatatactaatgctctgccatatactaatactgctatacagtaacatactttgctacatactaatatactatatatagtatattatatattgcatattataagtatatagtatatataacatatataatatatataatatatagtatatatagtatactatatatcatatactatatattatatatgtatgatatatatatgatatatatgatatatatatcatatatagtatactatatatcatatagtatactattcttctctttatttttttgtggattgtcctaagtcctgaatttgctatatatcatatagtatatgatatatataccatatactatgtgatatatagtatacgatatatcatatatactatataccatataccatatatcatatatactatatactgtatatgatatgatatatagtatatgatatatagtatatataatatataatatagtataatatatgtactatatactaatatactctgctatatactaatatactctgctatatactatatatatactataaaagttatatactatatagctatatagtaatagctatatactaataccagtactttgttggatggaagaatatgatttatattatggttcaaactcaggcagagaaaaagaatgctatttcttggttcaaacactcacagacccaataggtctaagtgtggtctgtgtttctgtaataccagaagtggacttgccctctattccctcctcaggtagaatctagaaacgttatagatctctggagataaattggaaaaattgtatatgcaaaccttggactgaaagctgggaagtgagtacctaagatcttagttaaaggagctgaatagtcaggatggccctggaaggtgagtctcacagaaaggctgatccttaattttaatgttcacctctagagctcactgcaaacacagacactaggcatggaagtggcaggctgacttgagatctgattctttgtgtgagtaagccaccaggaaacccctaggcctctttctttgtgactaagaatctaggcgtgctgagccttcaggtgtctaataacatgatggagaacatgagtttatagagcaggtgtcaattaataggcatgtattaaaatttggggtgacataataaaatcatcacaggacctgtcttataaattgaaaattttctcacaactgtgatacagtttgttgactagaaatacttacttcccagatgataatctgctaatggctttaggccaactaaatttttttcagtgttgaaaaacaaatcaaaggatttacttaaaagtgatttgtctgggaaaaaaacaattttttttttttttttgagatggagtatcgctctgtctcccaggctggagtgcagtggcgcgatctctgctcattgcaagctccacctcccgggttcacgccattctcctgcctcagcctccagggtagctgggactacaggtgcccaccaccacgcctggctatttttttttttaatttctagtagagacggggtttcacagcattagccaggatggtctcaattcctgacctgtgatctgcccgcctcggcctcccaaagtgctgggattacaggcgtgagccaccacacctggccagaaagcaacatcttttaaatgggaatacacaagatcagatttatagtaattcttcttcacactattgccacacatgcctaggaaacttttataactggcagttggccttgtaaattaatacgtttgacagtgcacagaagaatgtgtcacatgtatttgttttcaatccccacacttactaccttatggttttcctatggtccttgctattagaacctatccaataaatgtaaatttcattggctgtctacattatttacagatatctacaactgaatggccctcctgcaaaataagcatattgactgccttcagtttttgttcaaacatcttggtttaattagttcaatgacaaccacaaaaataaagaggctagggacatcattgcttgttgatgggcatggcattttcaaagccacagcatctgagcctggccaagccttttcattctggatcccacagagattcctcatatcagtaaatggttaataaaataatctcaatttattaaacattaccacttgccactgtccaaacatgtatattgttactagaattgataagatgaagccagtgaaattacataaatttcttaaagctgtgagtcatgtaaaaattatctttgattgtacctttagcaattttgaacctatttccaggtcatgtacaattggtaataacaagattactcttggcaattatacacttgcagatttcctaatattctcaggtgaaataacaatatggaaacccattttcctataatgctcagtctcataaatgaatacttttttgtataatgaagcaggagcttattaggcatgtcatcagagttgaaagaaaaagtacaacagacctgtttcatgatacagtagactttatatcacagagtgcttcagaaagaagatattagatttatagaaataatcttgtctcagtttttagtcaaaattacaacatattcaaaagactgaatacaaattgattcaaacttgaattcattagggaagctatctaaattggttagattttatgctttcaaatgagttcctttcttagtagacatttgctaatcatgcactaatctcactgcagtgaaagtaattaattcacaaatagttacatattgcattgtgaagatactaatgatatactgtgcatgcaataattgggaaatgggctataaaatatctgcttaacaatatcaaatgggactggtcatttaaatgtgatatgtaacatttagcatatagaattattattcctgaaacgacagaggagagaaaggtcatggtcttttactaattctacttctaatcagcttaggaaaatggccttgttaggaggaaaatggcaatatactttcaagaattaagatatctgctattcttaataatctgtgtctgttggatcaaactaaagaaaagaagagaactagagagtgagaaaaagttaattatatccccaaagggacaaagagacatgtatgtggagaattcaattggaaatttccatttccaaactaactcaaagtcctgcagcaggtcatttttaaaatcaggcttaaaatacatatgtctacacccaagaacaggatattctttctgaatagctggacataattaaatgattattcttccttagtccctaaaaattggagtctaacacaaacagtaaaggataaaaaaaaataatgaaatctaagatgccacagattgctcaattcatcacaaaattgacaaacacaccattaattattggctctctggttttagatatgatgtgaagaaatacaataagtgtgctttagaatgtataaaatattgtcaaagccagaaatcaatgggtgtatcagttgggggtccagagaggagacaggaattacattagtaatttgaacaggaaaaattcttatacgtaattattaactagaaaacataattaactactaggaggagtaaagagacacctaaaaaatagaagattttgggctttcctaatatttgcaagtaatgtctcccattgcataaagttgtccactcatggacaggataacgcaaaagtaccatggcagtgagaagaccctcctaccaaactcaccatgtttttaaaaaatattttgtttcctgtttttaataattttaatatcttctgttatttacatgttatataatgagcatagagtcaactaataatttaattacagtttcagtaagggatatgcttattaaagaggcagatattaattctatcacatgctagcaggttaatagtgtgaaggtagggttaatatcctcaggtcacactgctacttcctggacattaattcctattcatataaaaatcactgtattgcaaagtctaatgacaatttttgacgttatcttctatgccctcattgcatttctccttctcttagaaactcttcctcttatactaaagattttattgcctgagagatttttcaaacctatttctgtcatcttggctaatgccaacatgcatttagagcatccatgaaatcagtgcatttctcattttctcaacattctactttccaacggagtcgaatgttaaggaaatccatttcacatcagtcacaccctcccatggctaatccaaggatattgccctcactgttctctcaaataatgaatacaaacattctgctgacatattattattcagttaatcaagtgtgacctccatcacctatccttgttgcccattctcaatttctcccattacacttttactttgaccttcaggcctttgtactattttttcttctattccatgaggccactcttgtgcaaatattttcactcctttgaatttttttagtgatatcaggaaagcagagagtagtcatagcttctcacctgtgtgtctatgtaccaacatgtgagttccaggtgggactagatattaatccccttagccctagcccaggacatagaaactggccaataccagtttctaggtatcataggccagctacctctggcttcaagaaggcttgtaagtatgtaacagatgtcagaaaatgttaccaatttttacttgtgctctgatgttaaaaaaaattgttggcaagcaattctttgaattaatgcaataattgtttgcttatgttcaactctactcataagccatgctctgcagtatctgttaaattctcatgctatttataaacctttcttagataccttagtatacttttaaatttctctgcactcctctaatatctaatcttgctaaaatacatcatcctttcaagagatgatttaaatttttacctcacagagacaatagaaggcagaagagaagcactccatcaaatttaggactcgtaatcttcatgtttacacacattttctcctacatttttggtactctctttttctttccgaaaataaatgtgatattactcctacacatgtggttgttactcaagcttgaagttttgggggattcagtatctccttcctcatctcttgcatcttcaaacttctgcttttactgtcttctttgatcggcatttaaaactattctagccttttctaccttaaaagaaaacagaaaactttcatcttacatcatcctcattctttctctcttccttcctttgatgccaacttcctttaaagatttaacttatactcattttctccatttccttaagtcaactcaatttcagtcacagaacaagtgacttctgcctttccctctacagaaattgctttttgccattgttacaggacatcattaaaggtaaatccaaactgcgatcttttggtccccatcttacataatctcgagatgacattgtttattgttgatgtctcttaagtgcactcctctcagctacacttctcactgttttttatcctttactttgtgtgtctctcgatgtagcttctgtggtttttctactcgtatcttaattattgacatgcctcagctttggtcatgggctctctttctcctctcaatttgtatacatacctgagtaaactcatacattatactggttttaatttttattttttagatgattgactccaagtttacatccttagctcagatttttcttctgtgcttcaaaatctctccttcaactgaaatatctgaacagctattgaaaggttaatttgggaagcccataaaatagtcagatttatattttccaatataaatcattatctttctcccaaacctttgatttctaatcctgtttttcagtaaataacaccaagtctatatagatgctcctgtcagaaaactgatgtttcttttcagaacctcactttcactaattaaactcaagtgatacacacgtcctgtaattttatctccatttacttcagtaaaaatatgaggttaaaacaattcctaaatactgtataataaatccactcttccttcaccactgcaactatctaatcctgattgtcattaaatctcccttccattacaaaaacagcgttctaagtggctttcctgctttgggtcttatctacgtgctaattcattcttcatccagcagcaaaacttctctctcttgaaacacaaatatgaacatgacatttggcagtgtaaaaccctcacatatgtctcaaatcctcttaaggtaaaagcccaaatatctcagcaagttttacaaggttctggagagtcttcacccttgttaggcctctaccttatgtcttgtcactttctttgcatccacacttagcagtcactcacatgcactcactgttggactctactcataacaaccttctctcaatctcctacaatatttttctcattcttacatctagagttttgtaattttaatttttttttgtttgtgggtacactgtaggttatatcatggctagggattttaatgctgttttcttggtgataaagaggtcactagcatcctggccaattcctgttactaactatatcccattctagatgagacttattttgagaaatcttctttttctatgggggcaaatctggattaggtccccctcctttgtgtcttcaatacttcctgttatgtatttgcatcgcatgataccactcatgtctatgtttaagtttactggtctgtatctcccactcaactgtaaacagaacagttttccctactattgaccatttaatactctatgcccggcactattcataatccaataaatatttactaaaagcatagtataataataaactcaggataaaatggatgataatattaaattgcattttacattatttagaaatcacctatacatacatttgtcacttttttatttcacagtttacggttaatatgacatttactatcttaaagacctctcttccttaagaaatggtcattcttttatcattgctggacatgttgttttagtttttaattataaatttgtctttactaaagccaaacaaaaggaatgtatttaaaatggattatggctaaatggatgaagtagttatcactaacttaaaaaattgcagaaaaatgtagaatttagaaaaaaaacaaaaacttattttaaaaatacaaataatttaaatccactctagagagcaagaaagttgttagtatataaactacccattagggtttttaactttcagcctatttgatatcagaaaatttgtttggaatatgcacttaaagtaaaaatacattggcatatatctaaacaatcagaatgggactattccatattataaatggaattctggaaaaaataatggtagtgttgaaatagtttttagatttctgtgaatgcccatctaataacaggcagatcaactagataataaaatttaaaacccatgaatggcatgcacaacaaaatttagtgacatggtatccccatgaatacatactcacatataccaacaacagcaactctaaaattattcacaagaaccaagaacaatgtgtcacatacatctgttcaactgacaaccaagggaaataatatggcatcgtatgggcctgaagacaagataattcttaaatagatgtgaagtattccctagaaagcatagtaaatcaacttgagaacagcagcatgattgaatgtgtcctctccaaaattcatgtattgtaaacttaatccccagtgcaacagtgttcggaagtgtaacattttgagagatgtttaggttatgaggtcttcactctactacatagattaatgccattataaaagtgcttgatgaggaattgcatccctttttgctctttcatcttctgaacctactagtgtcttgatattgactttccagcctccagactataagataataaatttctcttctttataaattacccagtcttaagtattctgttacagtacaaaatggactaagacaaatagtaagctccgaaggattttgtctgcttgtacaatgtgggattaaaacagataaacaaaaatatcttcagaacagtgcatccctataaactcacaatattgagctgcctcagttgtcttcccaaacagggctacatattggggagaaattgtaagaaatttaatagaaattgagtaggacagggaaaatagacattaaagacagagaagactagacaatagtaggagaaggaatcagagacctaagatatcttagcatgcaagcagatatacaccagaacaataaacaaacaaacaaacaaaaacaagagaagagacagattgctgtgaattgaagaaagctaccctgaattatgtctctttctaaacatccataaagactaatagtttgtgaaaataagcaaaagaaattatcaaaatcaactccaatacaaaattatttaaaagaaatggaacaatattcttaaagtgaatgaaagtttctaaaataataaaagcaaataatgaaaacattgtcaaagtgagatccaatctgcaatgtattactatttcaaaatgagctaaaacattttgagaaaataacctaagctatgaagatacaaaataccaattagaatactcagtaatgaggtcatcaaattcaaaaaagaatcacaaagtgaaaactttcagaaatgaatattataccaaaaagaacatgacaaaggatacatacaataattacgtaagataattatttgaaaaaaatcaagtaaaaaggaaattaagaaagagataaaaatgatttgagagaaataggcaaatattgaaactatgcaaagaagattcaatatttgaattaaaagactccctggaaaagaagcaaaagaaagaaaatgaacaaacattatataattaatgttttttatgaacaaacattatacgacattatataattaaacattattataattaaagaaaactttcctgaaaaagaaaaaggtttcaaactacatggaaagattaaagaaaatatagacaacactcagatatattctaataaaataactgcatttcaatgaaaaactaataccctttgggcatgtagcagataaaaaacagcaattgatttacaatgaaaagaaaattagattaacatcagacttttcaacagcaacatattatgccagaaaaaatgatatatttaaatacttaagaatatttaaactgtgagaaaaatagaaaatgtgagtcaaagattttacagagtaaaactgactttcaagtataaagatcacagacctatgatcatgaacacccaagaatgcaagaattatttccattagccctctctgaagtatatcctagataaataagctttaaacaaccaaaataagcagcagagatcaatatgagaataggtagtgtgcactgtacatctatctacttacagaacccaaactagataaaggaaagtgtattgtatataatgcctacaggctcagaatatagatatataataaaaattagaggaaaatgagggcaatatatgaacaaaatttaaaatgttacattgattatatttttatatatactttttaatattttttatatatgaaaaatgagatattctgattttgttgtcccttattttattgagactagacttttattatggaagaaaggatatacaaatattatgcagaagatgttaagtgtaagattatataatgctgaatttgaatttggtagctctggaatgaagtaatgaatacattgatctgtgccatatacttgaaagtatattttaaaaatgcgcacaactaaacactgccacctagaaatgaacacttgaattataaaagcaagaaagtgattctctgaaaatgaggagattggttagttttgcagaaagggaggtggtacgttgccactgggcacatggaagatgtttaggggtgaagttcgacttcttcccctaggtggtagttataagagtgcattaccttgttcatcttataataacttattaagatagtatttattttgtgtggttttatgtattttcacagtaaaatatgaaaataaaacggaattgttttctaactctagaaataaacaaaaatgaaaaacaggtaattccctttgagactacaatatgccgactctatggtaaatactggtcctgaactctgtaattattcctttcttcagctccacaggttcagccaacatagaaatctcggggtcatagcaggtacagcactgttttctcacctgcactgcatctcccaaattattgtcctgaatgaattccgtgcagccctgcccttcatggcataatcttgcctgtttctactcaaggtctcggtgagaccttgtagagaccatgtggcaaaacattattaaatatgaacgtctctgagtggctactgccgagggagtgcttaataattttacaaaagcaatattgttaaatccattttcaagttacgtttcatctaggaacttacacttcccttctagaagcagagtgtatgatattattccctctatagcagtgagaaagtgagtgcgaaatagcagcaaagcagtaatatcaatgtcaaacacagagcatcagatcatagcagagaaatgaacagccaagaggaggctgctttgtggggccaagtaacattttgaagaaagttttaaatgagaagtatctaggaacataattgactgctgagacaggtaaagacaggcctctgtttaaagagagaaatatgaccaactaaactgacatgtgcttcaccaaagatgatgggtgggacctcactgcatgcaaaaacagaagaaacgttcacataagattactccaaaaactagggcacattgtctaagagtttcggtaatttttaacagagaaacaaatgaaatggtattaaaagtcacatgatgtaatacaagtagtcattgtgtataatactgaaaatcactacttaataaaatgtatataattttcatatcatgttgtgagttctcacccactctacttgttatcttcagtatatttgtaggaggatttttaagttgagaacatgagttcttagtcactatcttgaacatttttgaagctcttagactgtgtttgtatcccaccaagagtttgggtacatttcttgaaaaccaagggtgtaataatctaaccacttctacaattcaatgagtttatcatttcacaaaacactgcctacatgcatttacacatattaatggttttaatattgccaacagcttaacacaaaatttcttcacattttgaaagtattaaatattttctaaaggatggaactactatataaacataaattcatttaacttatatataactaacttttaaacaattcataacaatatagttgctaatttatgtgtttttctatatagttttagaattactaaaagctttttaaaggaagagccagaaacgttaataatctgaggaagttcgggttaaagttttagatgaacccaaaatgttatacaattccatgttacagtgaatttcttaaatagtattgtatcagtcttttagttcagaaagctcttatgattccacctacacagaatactagttcctgcatctatggtaaatattcatataaatgcatagtaaggtaatatttgagtttctcacagcctaatatttctaaggagaattatagcaactcttggagaattgttaacatgtcaattctaacctctagtgagttgaaaagtttcatttgaaatgaaaattcatttgataggtctaaaatgcataaatatctgattatttcctggcaggcaactacagtaaaatctcacacctcaatttttccagatcttggaagtacattcatcaatgtctactgcagtttttatctgacagagaagaaaagcaagcattaaaacagtaaatcaagttggatttgaaaaaaacaggaagttactttacagtccaaatgacaactacataatttaatgataagaggtttgtaaaaccacattttatttttgctggacagttttaaaggtaaagatgatagatcatacatgctacttatacaaattaagttctccaaagaaaaaatgtctaaaaatttgaaataaattcagaaatacattgtatcactcttttattgtggcattttaagaatcttgtttttaggggacttaaaactaggaaaaaatattgaggtcatccaagtttgtattatatttctgttatcttttgaaatatcaaattataaaatatatcatacatattgacaatgacatggcaaaataatcagagacaaaattacatatgtccattaaattggtaaataatgttacaaacctttatagggtatgaggcatcccattgtttgatatatattctctcttggtactttaaaacaagtttgtgaatagctatcatcatcacagttttagaaatggaaatcctgggatatagagctaaacttatttgttcaggtttacacatctagaaagcaacaaaattatgactattttagttttgtctaaatccaaaatttatagaaattatcctcagagtgcattgataagcaatatatatgcataaatatatacacataaatatatacacacacacacacacacacacatacatatatatacattctctctcctcctctcatggtaatctaagaggcatgctgagtacttctactatcagggatctgggaggcagaaagagaagtataaagagaggcaggcagttgattaaatatgaatagcatgtattcattgataatgactatcagaaattagtttcctcacccaggtatcacctcccagatattcagactgctctttgaagctcagctcaaaccaggcagaaaactgaactgagaattaggaaatcagaaaacaggggccttagaaggaataacagtagtatagtacacactaaactaaagtcaacaatggggcaaaaagtcaacgattagtggggatatgggttacctgtagtcacgtctacacacacacagcatcaggtgtggaagcagtatagtctcatacacaactctggagtgcctgatgtactgctacgagacaggatctattagccctaaggttgagtgtgaacaaacctatgggtaatctataattatcacagtcatctatgtgtggttgtggcctctgcagaatgtcattttcacatgaggtacatgtttttactcaaagtatgcatttacaagatagctgcttgaatgaacgtcttagtccatcaccattaaagagagacaaacagtaaataaaatatttaaatcaatgttattggttgcattaacactatgattcaataaggtaagcccactaggcactgaagaaaacgctctaggtttataatgaaattgcatggtattaagagaaaatttaatagcagctaatataaacgcaaataaatgcattaagttagatatataaaacgaacattttctgaaacgctcaaacagaattacaacttcttaactttcagttttttctcaaattcattaaactcaaaattattttttaggttgttttatggaagaggcttgttgaacatagtcaaaagccttccttttgatgagattgtattcatttctagattaatgtcagatagataacagaatttcttataaacacattttaccaaaagtcaaaaaatcatggcaattaatttcatttatttgatcttaaaagtaagatgtctatcaaagttaaaaatgtgtcaacatatatttataagtgaacaacttctaaataattaaaaattactttgagataattttaatggttttagaaaaaataaatatgcttcttcctcagatgctttcagttgttgtattcataattaaacaagcaatgcttaatattcacagatgaaaagctgtcagaaaattatgccatcagaattcctgtaaacaaggtacttttgttaatttctaactgattgggaaagtagcattattgaaccataattgatttcctcttttctattttgtgcagcccagtggttgtcttgtgtggtgtgttattgtaagatgattgcttaatttgtggaatctaaacagcctattgtattctagtagtctcacatatttatatgccagcatgcactttatgtttgcagtcaggtttagaattttatgtcaactattatttcattatttatggtaaacaaatttcaaatttgagacattaagtatgatcagaaatattacagtagaaattaaataatgatttatttgttaaactatttttcttaatctatgccctgcagttcaattgtcaattgaggaagttttagaacacaatagcaaaataggaactgcagtaacaaagcaagattgccaagaagaaaaatgctttttaaattattcctttaaaaaaaagtaaaggtcaaaggagtgtgaccagtatctgatatttaaattaacctaagccactgaaggtattcatatgtatgtgaatgaagttccaaatgtagactgggtaaaaactccaaagcaataatcatgttggctacaataatgcatgcaaatcaaggtaattggtatagataataaataattgaggaatcaaatttaggtacattttccacggccagtaaaaactaagcataaagaacattaaaatagtttggttatttgtccctgcccaaatctcatgttgaattgtaatcctcaatgttggaggtggggcctggtgggaggcgttttgatcatgcaggcagatccctcatgacttggtgctgtccttgaaatagtgagtactcatgagatctggttgttttaatgtgtggaacctcccctcccactccctcttgttcctgcttttgccatgtgacatgcaagctcctgcttcacccctgccatgagcaaaagcttcatgcgtcctccccagaagccaagcagatgccggtaccatgttttctgttcagcctgcagaactgtaagacaattaattctcttctctttataaattgctcagtctcatgtatttctttatagcaatgcaagaatagcctattacaaacattaattgatttgattactaaagctgacagagtattgtgcatgaaattgatctcgatatcaagaagtctggtttcttataaaaagtgaattttatttaatagaaacattgagagatgcagtgttcaatatggtaatcagtagacacatggttgaacacttgaaatgttgatgcaagaggaactgaatttttaatttaaattaactttaatttaaatttaaaaactaattcatttgagatatttaaaaacttttaaatatggttgacaacttgatacatataaatatctattttcaaccttcagtttcatgaaatgtaattacagatcaattccaatgaaaagttatccaaattaagatgccctgtaaatataaaatacatgtcagatttcaaagactaagttagaaaaaaagcataattatttaaatactgttttaatagtgataacatattatatattgttaaacatattattcatattaactttacttatttttaatatagctctttaacaaattagaattgcatatgtggctcgcgtaatgtttttattggatagccttgagaaaaaatcaaaatctgcattgactttacatgtattactaagaatatgttttaggacaatatactctaatttacatatattttctctatcttcatacacatctgcttcccacttaccccacctcccttattgtttcccaaaaatcagaaattctgatgatgtaacctcccttattgtttctcaacaaccagaaaatttgatggggcttgaaagacagaagtgggataataacagagagaaaaatatcttagatttttcttttgtgtggtataatggtgcatttttattactatcattaattaacccagaatggcaaagaggaaaaggatttttgaattggaaccagtgaagagtcaaagaagaggaggaatgcaaaaattttcaggtggagaactctctgtctgtaaactctgttcccaatgaccactacaagatccatgttccctccaagagagctgagaaaacatcactacattcatcattcagaacagggtgagggaaggagccctcgacagaacacgcccagagttacaagttgtcctcagagtagtattattgccattaggaaaaattggccaactgtgagtacagtgtgaatgatctggaaagataaagagaaaggtagtaacaataacataattgttttcctggccatgtaggagtttggctgaagttgtccttaatgtgacttttttaagccaatgcttatttccatcaattttggtttcctactcaattctatttttatcagataagattaactcctatacatttactgaaattatacaacttttacatcttctctttcatggctaaagaatgaatctaggacttatctactgatattagatatcatcatttggcattgtctcaatatactgtggctcactatgggcagctcaaacactatattgcctctgcatcagaggcaattttgaattgatttgtttgggtttgttagtctcgaggaatctcaagatatgatttttaccaaaatgagtgtggtttctttccagctgtttgttaatttaaaaaaaaagaaatgaaaatgaaaactattagctaagttcctaaccttttaataaattggctagaaacacaatgtgctatttcaaaacaatgatattttctaatatttcataagcactaaattttgcatctttttacatgtactgatgccttagtccctcttatgttatttgaatttgatgaacaacctggtatctttatctatgtttaaaaatacatctcttcaggggagagcaaaagacaaacaaaaataattcccattacagtctcagcaggtagaaatgctcttactcaaaccacagacatttcttaaagcaggcctcacagctgtaatcttcaaatacttttattctaatagcaaggcataatgtggtaatttcaaatttgctttatcatgactgttttaaatggtgaatacatattttttctaagcaacagtatattattgaaatgaaaataatatatgtgatcattatgtgtcagatactgaaatgaccattttctatatctcagtagccccttttaacattccttctagtaaatcactatgatttctacttccaaggtgacaaaagcaagcttagtggggacccatagctaacctaaggcaacaaaacagggacatgttggagcctagagtcttccaagcctctgtttccaaactcatgcccttacttgttctgttagtctaattcttgtaatggccattatttgatattttattgtaaatttacaacaaatactttgctctattatataaaatactatcatttggaactgaaacttctcaatattatttaaagaaatcattcaacaaacagattttattttatcctacactatgttcactaaaaaactgagaaatataaattcattgatatgaatttcacttaaagagaattttgacagcacaaactttcacattgttttctttttgattggcaatatgaatttagtgcccaaagtactggttatttaaaaaaatgagattcattgatttttaatctacatttttctattcatcttgagattactaaacatgggtcacaattttaagaacatctaggaaaataagacttcttgtaacaagaactgctgaaaaccctttacttcaatttgacattttgtgctcttctaaatgtatcctaatgcatggtcatgctacaaaatgactatcattagggctgtcacaggccatggctgtgggaataccatgactgatgctaagctatcagcactgtcggtgcaaggtgtattctcagtaatttctcaaactgtccatggaaccaatttctactgatctctaagtcataaaactttacaattaccctgagttcattaataatgtattacagttctcattctcaatcacaatttcatcagatccatgtctcacaggaaggttgacaagtaagccacaaaattatccatataaatgtcaagatttattttcctaacataaatgatctaacctagtcaagcatagttaataataaaatcattctttctgagattaccattcacctgattgccatacccattttggccttatatctcaacctctctaatggtggaggttatggatatagtccacataaataaaccaattatttatgagtcatgttcatttctatattaaaaatacaaaaccatgaatacttatattattgcttattactcctctgtaataggcacaaaactaaattggtcaatttattccatgacaatgaggtaagtactaaaagggaaaaatatgttaaaacagtaattttagttacagatatctcaggttgctgttttagcaaaaatcataacatactctacttcaaatacagaatctcagaatatgtccaaatgggaaattaagtattaaggcactggcaaaattattgcattgaaaatgaacagaaacttgcttctacattgcatttttcctacactctgtgcataaaagtttattttgataatgaaggatatatgtaataaacagtttctgagttcttgaagctattccccccattgttacattactatcagcctgttttgatatattatattaatcatatcataattttaaaatatatgattttttcactgatatatgaaatcttaagtaacatattaaataactaattacagaaacatttattaatctaagtaaatgcatgcaatggactgtaatttatttgctttgaggcattttatagaagtaaacagatagataaaagaatgcagatggggtttcagaagcggcatattgataggcgaaatactatactatctttcaagactacaagtggagaatgttaatatattctgccaaattttatatactgtccatcttaaaaaaatcacattgtttagagtagtttccctcctgagaaaaaaacaaagttggtgacaccacttgacagctccactgaagcaggaaacataattgcattcatttattcattttctcagtattagactcacgaacctttaaaagggtggggtggggagtccttcaatagaagtccttcagtagaaccaagaaatcagtattctatgatttactacttcataaaggtaaataagtcagtgaattaatcaaaaatttaaacagtgtatttttctctcaattggctatacaacctagaatttatatctcctaaaggtaaattgataatataaaaatctataggtagcatccaacattatgactctttacatgactgtagaagttgtgatacatttagaattattgttagcaaaagtctatgtaatacagcatatttgttttgtttcctagataaattgatttatattcaatgatttgtctgtagcagataaaataaaatacataactgatacctcgaatattattttgttttgataactgttactttttcaaccctgttttcctaatcattatctttatttcctcctattaagaatactttaatcttactcattttctgtctgaacactgaaattcatcaatgagagtaaacattgaaccaaaaaaatattccttttattgagactggtctctaagtatgctttctattagagttttaattaaaatcactttcataatatacttttttatatttgtataatatatgatactatatttgattttcctagtattaatctgaaggtgataattttataatttgccaaatttttatattactctaagccataggttgacatgtatatttctcagatataaatgttcatatgtaccagaaatatttttaaaagacatattagaatatatatattttttaaataaaatatgctgaaaaatattttcatttctgaaacttcatttatctttggcaagagtcagtcagtatctcatgattaattcagggctgaacccaaacgacgttcaaattagcatgtcagcagaagaaataataacactatttgatactggtcttttcccttagaatcactcaaaaggttctctaagacagcacacagagtcctggttaacttctgaaaacattctttttcactgtaaagccagactattgttaatgacaattgccattaatttactatgaacttacatataagaataaagattctgacactgcattttccccaaatacgatgaacagtagaaaatcagtagaaaatattagagaaaagctatacttagaatccatgtaatctttagattgttaaatatctgtttcactcaaattgccaatttaaatgtgggctttcttctgaaacagtaaatgctactccaagaaagtaaaaccagtagtgaaattttattcattttactttttaaaataaaaataatatctgccctagagcttattttgtcaaaacatcttcttcactgtcgtgtatcctatggtatgcccttcctattctaagtgtcagagacaaggaaccaaatcaaattcctcatacccctggaaatgtatcaggtttttacttccctacaatcatctacaatttaaatgcaaatttaattttgtcagcatttcatgacattgaacgtagataaatgtctcactatctcagtgagtgttatgaaagtttaaaaatattcttgaaataaagttagtgttttagttggaaaaaactatagcatacagcatgctgaaacagaagaggatgtgcaagaagtgtgtagtagcatgggcatcattgtggaggaataagaaagagggtgtgttgctgggacagtgaaacacctcatcctgctgtctaaatctcaggctatattcctaagggagagcatctgggggttctccactgattgaattgttagaattctgagaatactggaatcaaatcttagaaaaaaactgatttttagtctgggaatctaggtcattagatgtctcaactggtgaacagaagaaaattataaataagaaattatgagtgatgagtgaagccagaagtcatgacaaaggtgaagagtaaaactaagaagtactggaaagttaatgaggcaccagacatctcaaacctttaatattaatcttttagtgaggctcagccagagctttcttgcttttatgacaacattcaatcagagagtaatcatatctcacagcatttgtgattgatctgaagtaaggatctctatttctcagtgttctttctcacttaattttctgtttggttttccctatgatttcatatttgaacctcctttcagtggaaagaacatctgtagtcccatgaattttctaatctgaaagggctacagaaatgaaccatcactgtgcttcaagccagccagaacaagatttatcacttgctttgtgtgtgatcttgaataggtggcttaaaatgaaataatgcaattcccagtttctgaaagtataaaaattaaataggataactgaaatatgcccagaaaaattcaaggtaacagcatagcttaatctccctcccttgatctaaattgtttgatgacttttttaaaaaaaatcttccagaacacaactcagatatcttaactcaaagttcaaggctttccatagtgtctcatccatctgcctttccaggtccacttttctctattccctttacgtagctttttgtttagtcaaatgggaccatttagtttatttttcttttgctatgtctgcctttgctcttgcttctttctccaactctatacttgcatagttatcctttccttcaaggaccagctcaaatattactgcacttctatatttctctcccttcccttcccaaaattaatctctcccttctctacgtctataaaaacatttttttgtcttctggagtacctggcttaatgtatcctcaccttctcctctttttttttttttttaaatccttctctattgtctcatttcctctatagttttaaatatgatagtttgaaattaatagatgatggcaaaaagaagactacagtacatggtgaaaccccgtatctactaaaaatacaaaaattagctgggcatagtggcacatgcctataattccacctatttgagaggctgaggcaggagaattgctggaacccatgaggctgtggttgtattgagccgagattgtgccattgcactccagcctaagcgtcagagtgagactccatctcaaaaaaactaaataaaaaaaaaagaagactacagcttacatttgtatcttagccaaagcagcttctttcttctaagctatgctactgctgcatatgtttggtcaaaattttaggctttcatggtttcttttttcctttttggggggatgtgtatagcatagatcacatatggaaacaaacgcaaaacagaaaatacaaatgggaatgaaaagggaatggaagcagagatattatttccaaaagcttaaaaggagaaataaggattgaattgttttaaactgaagaaaacatcatttatatagaaagagcaattagattatgcgatactggtaaaacgagtcagtggaattagttcacagaattatgaataaaaggtctgtctgcattatgtcttccttaaatctattgtttgttaaatttccaattatgtacatgagcataaacacacataaatacagatatatatgtgtgtggtggtgtgtgtgtatataaacatttgtaaatatgtatatgtgggttttttttttttaacggagtcttgctctgtcgccaggctggagtgcagtggcacgaactcggctcactgcacctccacctcccaggttcaagtgattctcctgcctcagccccctgagtagctgggactacaggtgcgtcccacaacacccagctaatttttgtatttttagtagatatggggtttcaccatgttggccagaacagtctcaatctcttgacctcataatccacctgccttggcctcccaaagtgctgggattacaggcatgagccaccgtacccagccatatgtgttattttttaacgcggtaacataatatccaggttaggatgtttaaggatggatatgtgaaatgtgttttccatcctctcacacactagatcccatatttcactttaacaggtatcatatttctcccttttcattattgcagatcatcctgaaagcttcatcacctttggtttggtttattttccattattccaccaaaatgactattttgtttaggccattggtgccctcttattgccaaatccgatgggtatttgaatatcttttcttagttttcctgtgtgcagcattcaaaattgtcaacaattccttacttcttgaattagttccacacattggctttatgatactacacagctgtgcatcttacctaactggctccttcttctcattcttttcactcttcctctttcacccacctcatattaattggaagactcagctgagtggtatcagatgtcaacactcatagcagttgagtgaatgagtggtgtagtcctgaagtggagagatctgagccatgggccagaatacacactaaacccctcatgtctattaagtgagtactaggcaccaaaaggaatatgtatatttgcttgaataataaatgacctctcataggcttccatttgtgattttctgatcacattcttcatattctatcattccatgcacatgtctaagctcaatgatatggtttgactctgtgtccccacacaaatctcactttgaattgtcatccccataatccacatgtgttaagggttggaccaggtggaggtaactgaataattaggacagttttccccatgccgttctcgtgattatgggggagtcttgtgagatctgatggttttataagagtcaggcatcttccctgtttgcactcactccatactcctgtcctgtgaagaaggcgtctgcttctcctttgtcctctgctattttagtgagtttcctgaggtctcctactaatctggagctgtgagtcaattaaacttctttcctttgtaaattacccagtctcaagtatttcttcacagcagtgtgagaatggactaatacagtaaatcggtaccacagagagtggggtactgctataaagatacccagaaatgtggaagcaactttggaactgggcaataggaagaggttggaacagtttggaggggtcaaaagaagacaggaagatgtgggaaagtttagaacttcctagaaacttgttgaatggttttgaccaaaatgctgatagtgatatgcacaagttcatccgtaagtggtctcagatggagatgaggaacttgctggaaaatagatcaaaggtcactcatgctatgctttagcaaagttcctgatggcattttgcccctgccctagagacatgtagaagtttaaacttgagagagatgatctaggttatctggcagaagaaatttctaagcagcaaagcattcaagaggaagcggggcatgaaagttcagaaattttgcagcctgaccatgaggtagaaaagaaaaacccattttctggggagaaattcaagcctgctatagaaatttgcataagtaataaggagcccaatgataatcaccaagacaatggggtaacgtctccagggtgtgtcagagaccttcatggcagcccctcccatcacaggtctggagggctaggaggaaaaaatggtttcatgggccaggcccagagtcccccttctttatgcagcctcctgacatggtgccctgagtcccagctgcttcagctccagctatggcaaaaaagggccaaggtacatctcgtgacattgcttcagagggtgcaggccacaggctttggcagtttccacatgctgtcgagcctgtgggtgcacagaagtcaagaactgaggtttgggaacctctacctagatatcaggggatgaatggaaatgcctagatgtccaggcagaagtttgctgtagggccagggtcctcagggagaacctctgttagggcagtgcagaagggaaatgtgggattggaacccccacacagagtccccactgtggcactgcctagtggacttgtgacaacagggcaattatcctccagaccccagaatggtagatccacctatgactagcaccttacacttgaaaaagctgcaaacactcaacatcagcctatgaaagcatccaggagagggtgctgtgcctgcaaagccacagaagtggagctgcccaaggctgtgggagcccacctcttgcatcagcatgacctagatgtaagacaaggggtcaaaggagatagttttggaacttaaaggtttaatgactgccctattagattttgaacttgcttgaggcctggagcccctttgttttggccaatttctcccatttggaatgggtgtatttacccgatgctggtatccccattgtatctaggaagtaactaacttgcttttgatattacatgttcataagtggaagggactttgcttgtctcaaataagactttggactttgacttttgagttaatgctgcaatgagctaagactttcagaggccaggcatagtggctcatgcctgtaattccagcacttctttgggaggccaaggcgggagaatcacttgaggttaggagattgagatcagcccagccaacatgacaaaaccccatctctactaaacaaatgcaaaaattagccgggtatggtggcatgcacctgtaatcccagctactgggtaggttgagtgaggggaattgcttgaatctgggatgcagaggttgcagtaaagctgagatcacaccactgcattctagcctgggcaagaaagcaaaaaaaaaaaaaaaaattatatatatatataaataaatacacacacacacacacacacacacaaacacacacacacactttgggggacagttggaagggcataaggccataattctgttttgaaatatgaggacatgatatttggaagtggtcaggggcagaatgatatgctttgtctctgtgtcaccacccaagatctcatcttgaattgtaatacccataatccccaggtgtcaagggcaggaccaggtgaaagtaattggatcatgggagtggcttaccccttgcaattgtcatgataatgagtgagtctcatgagatatgatggttttataagcatatggcatttccccttcttacacttctttctgccaccttgtgaagaaggtgccttgcttcccattcaccttccaccataattgtatgtttccttaggcctcacctgccatgcagaactgtgagtcaattaaaacttttttctttataaattacccagtcttgggtacatctttacaacagtgtgaaaatggactaatacactcaccaaatacagtaaggtctttgtggattagaaatatactggatttgactttatattctctacattgcaaagcagagtaccttgcatatagtatgtttttatttaatatttcctaaatgaatggaaacagaagagaagttaaaggataagtcatgggagcggctgatgcagtctctaccagtgtgtcataaatcccaaaatatttgaaagaaattatagtacagggatccacaacacaaagctgctgtcccaaagatccatttattctatttacttgtcaaagtaatagacaaagtaatagacaaagtaattgacaaagtaattgtcaaagcaattactttgacatccctacactgtcattttctggtctataaattaggggtagtaatactaacctgtcataaggtctgagaatgcaatgctctaatagggcctagaacacagtaaatattcaataacatttatttgttattaataaaaccttcatgaagttaatatttcatgtataatattctgtacctttttcttcctttaaaattaattgtacatgattaaacatgcattttttagagtataagaaataaacactaattgttaaattatatttgttcatattctggattaggagaaatttaattctcagtttgtattataaattttaaaaactgccaggcacggtggcttaagcctgtaatcctagcactttgggaggccgaggtgggtggatcacctgagatcaggagtttgagaccagcctggccaacatggtgaaaccccatctcccctaaaaaaaaaaaaaaaaaaaaaaaaacagattagctggacatggtggtaggcacctgtaatcccagctactcaggagactgaggcaggagaatcatttgaatttgcggggcagaggttacagtgagcttagatcactccattgcactccagactgggtgagagagcgagactacatctcaagaaataaataaataaataaataaataaataaataactgcttaataataaaaagaagttagataattcatacatgtattttgttacgattaaaaataatctgacaacaaatgagctgaatatagtaattatgaaatcaattttatggtttgttaaaatgctaaggttaatcttcacgtagtttgagtttttattgtatttatctgcttcataattttgattagtgtaaggggaatggctgtggcttctgtctggagtaggccaaggctgacatccagtacagcacgacacagcgggtttggagcagaggcgcacaaccccatgcactacataattacatttatgtagccattcggttgtaacctgtttgtgtgagctcatacctggctttgagccactgttgtctgtgaaaaatataactgcactgctgactctgtaggagagagaaagaataagtccacatcccacctgcctacggtccctcgagtgtttttcagctacccgccacccatctactgacttccctcggaccccagcttgggttgaaatctgaaaattaggttaatataacttttaatattgaaaatagtatttattatagcttttaatttatatttttgtgaattatttgacccaatctgtgtaagaagatgtacattagaatataaaaatacaattaccagaaaaataaaagataatttttggttctttcatgaaacatagaaactcaagaacgaaaatgaataaagctatattcaatccagtcagtcttgaattcatgtaaaatttttagtacttaacaaagttgcaaagattcatactattaaaacagaaaagttgtagaagtggtctaacaatgaaattctcagaaagttagaattgtcttgctttatttctcaggcattcctaacattatgatttctgtgacaaaaagtaataactactcatatatttaccagcgcctgaaaatcaaatgtgttataacatgaattatcatagaagtatatgactatgcaattgcaaatgcaaaaagtcatgcaacacactattttaataatataacaatcatcttactgccaatgttttcatttcactaatttcattgaatcttatcttctgataactgtttagctctttaattagatatcaaataattacacttttgaaatgcagccaggcatagttttttagttgccgtgatagcatatagtcatctttatcctgcacattttgtgttttatatccaagcacgtatctaattatctttctgactgaattgactacttacagcgcaggaagatctaacacaggtcatttgcaattgtgcagtcacaagtcacaaaaagaatgaaaaagagtgaagaaagcctaaggttcttttgagaaaccatcaagtgaaccaatatacacattgtgggagtcaaagaaggagaataaaaagagaaaaaggcagaaagcttatctaaagaaataataaccaacaacttcccaaagttttggaagcaaatgacattcagatttacaaaccccctaatacattgatgcattatcatcaaattatcagaagtcaataccaaagataattttaaaattaataagagaaaagtgacatcacatacaagcaaccctcataaaactatcagttggtttctcagcagaaacctttcaggcaagaatggagtaaaaggacatactcaaagtgctgaaagcaaataaaacacctaccatgaatattatccccagtaaacctgttcttcataaatgaaggaggaataaaacactttcccagaaaaaccctgagagaggtcatcaatagcaggcctgccttacaagaaatgctaaaaggaattctgaaagaatactaaacagcaaaatgaaagtataaaacttaatgagtaaatgtaaatacatagaaaaaacaagaatactgtaataccataatgatagtagataattctaatataaaagttaaaagacaaaagtactaagcataaccacaaaaatatgttaatgtatacacaatataaaataggtaaactgtgaaatcaataagataaagtacatgcatggaggtaaaagtgtagaaattttatactgtttgaatttaagttgccatcagcttaaaatagactgctgtaagacaagcatgcctcatggtaaccatgaagaatatatccctaaatatacacaaataaaatatatcagagtatgtcactaaaaaacaaatataattccacaagaagatggcaagggaaggaaatagggacaaaatacctataaaatagatagaatataagtttttaaaattttaattaaaagtcctcacttacaataattactttgaatataaatgaattaaacttcacaattgaaatacatagagtgcctgaatagatttttaaaaataaagatctaactttatgctgtctataagaaacccaccttagctttaaggactaacacaggctaaaagtcaagagatggagaaagatatcccatgcaaactgcaaaccatagagagcaggttagctatacttgcatgagacaaaatatatttaagtaaaaaggtgttacaaaaatatgttgataagttttatttagttagttcagaatgtatacatgtttgaaaacatcatattgaacataataagtaataactttcacaggaaacaaagaagattatataatgataactggtcaattcatcaggaagataaaacaattacaaatatataggcacccaacatcagagcacctaaatatatacataaagcaaacatgacttatatgaagggagaaacagacagaaaaaaatcacagcaggagattttaatactccacttcaataatgaatgggatatcttaacgaaaaaaaaaaaaaaaaaaagcaaaccgaggactaaaacaatactatagaccaacgggacctaacagacacatatgaaagattccatacaatagcagcaggataaacattgtttttaaacatgcacagaataatctttggaacagatcacaattgaggccacaatacaagtcttagtaaatttaagaagattgaagtcttaccaagtattatttccaaccacaaagaaatgaaactgagaataacagaagacaaactgaaaaattaaaaagaaaaggtaagtaaatgatacaatcttgaacctacaatggtcaaaaaagaaatcaaaatagaaattagaaactatctcaaaatagatttttttcttaaaaaaattaaaccaacagaaaaacttaaggcatgcagcaaaagcaatattgagggaagtttatagttataaaagcctacactataaaagaagaaagatcttaaacaattaactctatacctcaagaagctggaaaaggaataacaaattaagcacaaaattagcagaaggaaagaaataagatttgaagataaatagcctagagaaacaagaaaaaatgtcaacaaagtaaagagttggttttctgaaaagataaaattgacaaagctctaggtacatgaactaagaagagagactactcaaaataaaaaaaataggagatattacaactgatgctacagaaataaaaataattaaatgagactactattggcaattcctcaccaaaagattggataacctaaaagaaatgtataaattcctagaaacatacaacctactaagacttatcgtgaaaaaagagatagcctgattaggccaataacgaagaaaaagattcaatcagtaatcaaaaatttcttaaaaagccaaacctgcagaagtaaacagtaaaagggtggtaccagaggccgtagtattgggggactgggagatattagtcaaaggacacaaaatttcagttagacaagaataataatttcaagacatctattatacatcatggtgactgcagttaatatccatatattgtatgattgaaagttgctaagataatttaaatgttgaaagttgctaagagagtttaaaagttgtcaccagaaaaaaaaaaaagttaagtacatgaggtaatgtgtatcttcaataatgtgatttagccattctaccattatatataaatacattaaagcatcatgttgggcacaatgaatatacacaaattttacttatcaataaagtatatctttatctttctaatgaagaagagcccagtaccagatagcttcactggtgaactctaccagacaaagaataattaacattaattcttttcgttaacagaatgaaggataaacatcacatgatcatttcattagatgcaggaaaagcatttgactaaattcagcatgctctcatggtaaaatttctcaaaaactatgcatagacggaatttaagtcaacatgataaagactatatatgaaaagctcatggctaacataatattcaagggcaaaaaacggaaaacttttcctctatgatcagaaacagggtgagaatcgcactctcacaacttccattcaacatagtactaaatgttctagccagaacaattagacaagaaaataaaataaatgccatccaaatcagaaaggaagaattaaacgtttatctgtttggagatgacagggtctcatatgtagaaaaccctaatgatcccccaaaaatctgtgagaaatgataaacaaatttggtaaaatttcagtatacataatcaacaaatgaaaatcatggcttttaaaaatttagttttttaaatggtaagtataaattacatatatacttaaaatcagttgtgtttttatatataaacaacaaactaataatgaaattaaagacataatttataataacattaaaataataaaattcttaggaataaacttaaccatggaggttaaagacttgtacactaaaactaaaaaatatgatgaaagaaattttaaaagacataaatacatggaaagacatgctgatttcatggtttagaagaattaatattgtaaaaatgtccacaatcacaaagtgatctacagattcagtgaaatccctgtcaaaatcccactgtcactttttacagaaatagaaaaaaaaattgtgaaatttgtatgataccacaaaagaaccctcatagatgaaacaatgttgaaaaagaataagctggagacatcatactttcagaattcagatattacaaagctatgacaattaaagtaatttttggtagtgttgtgttagcataaaaatagacatatagagtaatcaaacagaatagacagcctggaaataaactcatgcatatttggtcaattgtactttaacaactatgccaagaatatacaatgaggagtgaaatgttttcttcaacaaatgctattgagaaactggatatttacatgcaaaataatgaaattggacccttatcttacaccctacaccaaaatcaactcaaattgggtgaaaaacttcagtgtaagttcttgaaactttaaaactcttagaaaaaaattatgaggaaaagctcttgacattggccctatcaacatttcttggatatgatgccaaaagaacagccaaaacaatagcaaatataaagaattatgactacatcaaagtaaaaatcttctacatagaaaaggaaatgatcaacagcatgaaaagacaatggaatgggaaaaatatttgcaaagcccatatctgataaagggttaatatacaaaatatataaggtactcctacaattcaaaaacaaaatcccaaataatctgatttataaattggcaaagaatctgaataaacacttctccaaagaagaaatactgatggccaacaggtatatgaaaaaatgctcaacctcacgaatcatcagggaaatggaaatcaaaaccactatgagtaattaatcgacagctgttaggatggctatgatcaaaaaacacaagataacaagtattggtgaggatgtagtgaaattggaatcttcatatactgttggtaggtatgtaaaattgtgtagtcactatggaaaacagtatgcaaaattcctctcaaaatggtaaaaacagtactaccacatgattcagaaatctcacttctgagtatccatccaaaataattgaaatcaggactcgatgaaatagctgtgctctcatgttcatttcagtattatttacaataagcaagatagggaaaccacctaaatgtctattgatgataaaatgatggtggatggtgaaaccaagtgtggtacatatgtacgattattcagtcttgaagaagaaggaagtcttgctacatgcaacaacatggataaacctgaaggacattatgctaagcaaaaataagtcagccacaaaagactcatgttgtatgattctactaataggaagtacctaaaataaaataaaaaaaaaaacaaagtacaatagtgattatcagatactgggtagaagggaaaatgggagttgttcattgggtaaaaatttccgttatacaaggtgaatgatttctagaaatctgctgtactacattgtgctcatacttaacaaattttccctgtaaaatattatgttgtttctgtgtgatgttaactaacacaagcacgtatttttgcttttgtttttaatttccacttttaaataggatcgtcatatctcaaaatgtcctaccaatatgtagggacagttatctcggaggtaacactcttttgtaaaatgcagataaaaggaaatgaaaaaagattctaaggaagaggcgcaatataagaatgcttttcttttccattgcagtagtcaggatatataactggatagaattgcctctgtttagagaaataaaaagaatatattggaatcagtaaatgcattttctttgagtaaaagggttagcgcacagatatttgtaactttggagatgtcactcctatagcctcggggttttagaagcaaattctgtgcttgagatgaatccagctgagatcctgtttctcttaatatgagaaagaatgacttataaaagaagatttaaagtacttgtgtaagctttgaactagtcaagctgaaacttaactcccatttcgtctagtaaagctcttagtgccagaatgttttctggttgtagaggataaatgacaatatgtaccagcagtaaattggcttatcttttggaccagaagagatactataaatggaagctaaatgccagttttgacaagttatgaatacaactcccaagaagccaaatacatttttaggattctgaacagctttttcttatgtagtaattagactctggtagaacagcaactaaatggtgtttacaacattacaaataaattttaatttcatccatatcatttcaccccttaggctgaagagtgatgaaacattatttatacttctattcagttctttctttttaagtggaggaagagctaaaggcaaaattcctataaacaaaaggaagctaaaattgaaatctgtaaggaaattataaagtttaaaaaaataataacaattttttcatatatgcaaagaatagcagagtacatatttatttctttgtatttgcagaaacaccatcaagctaagccatttgcaatgtaaatgtttaatctaaatattgtatagaccaaacaagaaatgaagattatgtatttcaaataaaatacaacaccagtaaagaatatatatctatatatatacataaacacacacacacctatctgtagttaaatgtgagagaaaagtatgtgttcaccaaattcaaacaccttaaataatctatatttataaattatatgtggcataggtcttagtgctttatgaatatacaataaatgctttgaatagatcaaatgcctacgaaaataataaagagagtgtcatcttaaaaggtgttctagtggcaatggatattttgccatctacatttatgaataaaataaaaatgtcatcaagattacatattgagattcattctttgataaacagcagggagtaagaaaatcatattctctaatatctggcacatatttgtattgctgtttcaaatagagagaagaataattaaaaagaaagaggtagtacattaagataaactttgctaaagaaatactaagtacctaaaaaagtagatgaatggcacagtattggggttaaacaacatggggatgaacactgcaaaataaagaattttgactcaaaacagtagattcagctaatataactgatggaatttccagggtaatgggaaatactcatattaaatgtgagattataagtattttgaaatatgtttaagtatgtgggatgggcatgaaatagagtatactttctactacattaattgaaatgtgtttttattacaaaacataaaaatattgtacaccaacatatctccggactgctgcaaatcagagggtttggtaattctcaataacttattttatcaaaggcaaaagacaagagatgatataggtttcaagaacaaaactggaacaaattgatcaacacttcatggcaaagatgaaaagactgacaaagtaagatgtagtgacaatgacatgtgattatccaattatctgttggaattctcatttacataaaaactagattgaatattcttgataagccttctcccagttgatatagagaagatactttagatttaattgttaccaattaagaactatttacaatgaaccagagatgaagggcacctaagaaaaaagtaaccctatgaccttttgtgcggacagttcacgattaccagatatgatgcaaataatattataacagcattctgaaaaataggcattaaaaatgttaggatttcttggtacaacatcatagatcacttcaagctaatggtcaggtttttgtccttaataaataaaagaataaaggtacaagctttttgttaagtctgaaaaagaatacctgacaattttaatcagaagtttttttaatgaagaacaaaaaaagagtcataaggcattctaagatgaatgcacattttaaaatgacattcaaagaataaaaaagaaagtcaaggaatctgtgccacatattgctataattgagtatcacatcaaataatatgatttcaatgataacaaagatgtttggaaaaattgctaaaggtaacaaaaaaaggaacaaaattatgttgctgtctaaacagaaaagaaaatattctatagtacaaggcttgagagactttgttatattttgttttgttttgttttaatataaaaggaacctgttgtcaaatgacttgcccaaggtcatatggttgttcagaaacagaattggaaaagtctattgctgacttcgtttgttttaccaaatcaaaactgcctctataaaagctccaaaaaaaaaaatagaatagagacccaaggtatatcataggaatcttaagatacatgaaagctgacaagaggaagtattaattggtcttgtttttaatcactcaaggaatgtgattagaaaggtagaataaaaagatgaaattaatatgacaatagatattcactccaatattcaaagatgaaatgagatacctttgggaagtactgaattattcctctctcaaaatattcacacttgagtaataaatattagtcagaaatgcaggagttgggattcaagaatcattgggatggtaagaataaataaaattttgtatctgagaagtcaataattaaaattacatgtcaaaaggaatgattctggggaagtggcaagcatttatttacctgagaacttaatagcttaatttcctaagaatttgagaaccgttcaagtaagccttagtttgaaggctgaggaacgaggcaatataatattgaaaacatttgaagtttttaaattagttaatgagccactacaaattacaaaccactgtgtgcctgataatatagttggtaccttgtaagtgaatgcaaagcaaatagatgaaagagcaaattaacttttagaaaaagtatttaaaaataaagtggtccttcttcattactcagcttttcattctaaatttatcaacaggccatatgacgtattatttgttttcattttcattactccacttaaaaacatgaattttgtttacatacaatattaagaaagaaacagccaaatctaaagcagtaaactacctcagataataaatagcatttattcattgtgttctgtttgacctttatgtacttacttcttggtttgtgagttgatgagagatctctaaattacactgtcctggaccaaattgcagagtaccttgtctgctttctgacttggagtcacagttcatcttgaccttgctattggtataagtatcagattgggtaatgaccttatttttttgctatattgcagtccctagttatccacttggcatttatggtcagcttttcatttacagcctggtgctgacattccccagacaatactgtatgttaccctattagcattagtgctcgctatccaaaatcatgcactaacataaatcctccaggtctcccagacacattgtgctgtgaaattcttatgaacttgaaacaatttaccagataatcaactgttttatctaggagtataccacatcattattcacatacctgctattttcccactgacatgaaacatgttttctttcaaaagtcaaaagaaaaattaattatattttattgtgtttataagagcaaattactttgtgaggcatagaaaaaactatctttgaaacatagcagtacaattagacttaagcaaatagcacttgtaagatttttgaagatatttgatttctattctatacctttaatgactttgagaaaatatgtgtagcttgcatttcaaccatttaaaagcaaaatgacttacattaatattaatttatatctcctgaagcatatcactcatttttaacacagcattatgcattgtcatatttattcgatgctaattttttaagtgacaatattctaaaagcaattagcaattttattgtagtacaaaaaatagacaaacccagtattcatttcatttttttaaagtcaaagaggctgaagaatatcatggctctttctactttttttatgtagctataaacaataggcaaatatttatacagaaatttaatttcctttaattaaatatacttcaatgtcctaatttatgtataaaatataatgataaataaaagtattttttaaactttaaatttttggggaaagtttaacaggaatgaatttcagttcaggcttgataatttcacacagagaaataaaaattaagttaaaatgctgaattttaaaactctgctggcatatcatgacagcttttcagggaaaacatctattttcctttaataagattatgaaaattaaagctcattattgtgttacaaagatatagtttaacaaatgctattaatttcattggtcttaattgttttattaggatataattatttaaaggtgacaacattcataaattagttttctttaaatttgttcaattgcagatgtgacatgacatgactgtacaaaagtgtgtggtttaaacactggtcacctaacttattaaggatctattttgtttttcttgttttaacatatggcagtagttctcagagtgtggtctttgaggttggcagtatcaccatcacctggaaacttattagaaaagcaaaatctctggcctctcatcctagctgactgaatcagtaactggggagagggtcaagcattgttatgtcttaacaagtccaatggataattcagatacacattaaaggtcaagaatcattaacctatgagttttcagctgtggtgtcatattagaatgatcagaggtgttaaaataaatacatgcataagtcttatgctataacaattgaaataaattatctggtgagaagacacagtacttattaaagaaccatatttctaatgtatagccagggctaagaaccactgattttacctaacatccaatagagcttttttattcctttttcctttctctggacctaagagtgttctttcactgaccttttcattcaaaaattactatctgatcaccagactctaatagtcaatgccaagtcttcccatttttgcctaacatcctgatgggacccatgctgttgacttattttgtattgtaagtgacatatcaatttaaataaactactatatccatacacaaataacattgtattagtgatttttaacaaatacaaaggtgacccacaaagttcactgcttctttaggctactcatcttatcccattagatcttttttccagtaagtatttagatgatgttatgcagtaaaaacgcattataagtccactgaatttcctgctcacttaataacctagcttgttcctactatgctactatgctatagcattaatagtcacccccagaatcaaaattattacctaacaatgagattatgaaaatgtaatgctaacatagaaatgcagtcaggtggtaattcttcaggcctaacaaactcccagtcatgctagggatttactggtcattaaaaatgtttgaatgtccagaaattttaagtatcagtttcttttatcttgttgttcatgactctaagttcagtgtttctcaaactgttgtgatacctaagaattaacaacaaggttgcattatagaacattataaatacagtactttatttgtgaagtagataattttcaaaggagtttatgttaataagatgcttaagtattaaacattggaagtgattacactatcatcacttccaatgtttttctaaagcaaaaatagttaacgattcttttctgaatgttacttatgaattcatgctttgtgggagaaacagattattttacaaaatgtcttataatgtgtccttcaatgtttagaatgttgtttctttactatatttaataaaatatcaattactgacacattttaatttacatctttcacataccatttctaaataacttcattgcaaacctcatagtatcaagcccacaatttgagtaaatgctaacatattttttgttgcttcaagtctctcttactcatcctaaatgcagatgttgaaaagtttttaaaatgtaagaatttttctcatcatggaaaaaattggaagtaactgttttactcaatatcttcaggtttacctacaagtttcttaaatgcccagttccagttcacttcttatcaactcacttcatgtttcttttctttctttctctcctaaaatgcatatcacgacctcatcttgtgtaatattgtgacctctcttcaaagtttgtatcgaatacaaaatcttataaaaattatgcgtttatttatcagcatgaaaccctaatcatgtagcctatcaaggttatattttctttatattttcctttaagaatttcagaatgatacacttttatcattgtaaatatgtggattcaaataatatattttctgaaaacacaaatatttagctttcaatgccacatttaatgaaatcacatactaattttgtggaagactgagatgttctaaaaagaataagaaatcatgaaaatatttctgcaggcaaacaaaattcagtctttccactagtctttccacacatgtgtgatatacatgtttttccatggttaaaaaaacatgcacactacacatgttgatataaaatgtttccttttaactattgttttgaaaaaaacttttgaataatcacatacaggatatatatgagtatgcaggtttgtatgaattttatgaaagacaataattactaaacatgcaaaaatcaaacaattttaataaccatgtatatgctagaaatcagctttgcctctactgaaacaatttcttcagtcttctactgactacattcttataatgttgcatttcagtaacttcaaaattatattgaggaataagtaagtgaaaattgtaattatataaaacaatctataatcataatgtagtggttatatcattatatacacacacgtacacacataaactatttttctgaaaaaccttgttttcctttcctaaaggaaacataaacatgcgttatggttttcatttaatttttatttaagtatttcttcgaccacgcattttacagaaaatttaaatgactatacatttttacatttctgtttatttgttggaaatagtcacatttgcatacattttattatttttgaatcttgacctaatcctgtctgtgaaaccactgcggtgcactatataaagggcaagagagatggggtgagatttgaatccctattccgtgaatgatgtctgtacttctgaatttcctaaatctgaagagattcagagaaaaagtcatgagtatgtgattcctctttgaggagacaacatgaacctgtaactggaggttaatttacatgctattgctagagcaggaaaattatatctttggagagattaattgaagagcataaatctttactcatatgtaaggaaaaagcagtttcctctagtagctaagaaagcaaaaaagatgaaaaagttgattcatagatgaccatggagaaagatagtgaagttaggaataccaacaaaggtgttagcaggctagttcttacagaccatacagcagcataataccattatgatctgaaaaatcatgaaaatggggctacttactcagtaaattctggaattgacctttcattggagaaaaattagacacaaagaaactcttacgcagtatggatagatgagaatattaaaagacttcaaaaaatcttgggcttgaaggtagtacgatctctagacgtatacttttggtttatttcctttcttttaacataacttcctttcaatagacacaatacatatattataaaaatttcttcctatgacccttattttttctttacttgtaactgaggctattttaatttcatgtaatgtgacattaccactgaggttgttttacttcctttttcacgtagtgcccttaaaagaagaaaacagatgtcttaaatacataattatatttgcctctcaaaataactttgttctgttgttatcactattttacacattagaaaactgatgttcaacaatgttacatcagcctacaaaaggcatacctacgtgagcattaaagctaatatttgaaaccgacactcttgtttatctgttatgttttcctgatgcatcgatcctagtataatcatgaagcgtccttatataactctggtaacacatttcttttgaaattggctttttaaaatattaatatagccacttcagacattttatgttcaccgtttttaaggtatatctttctccttctatttactttcagtctttcaaatagacctacataggtctttacatgtaaaatgcatttttgtagatactatatatattctaacaatgtaaatatatatgttgctatgaactgtgaagggtttgaaatgttacacatcatgcacaaatatttatagatagatggccactacatggctgggtttgagaaaaagaacttaatattatttatcctcacagcaaaatgaacaactgtggtaacatttcagtgctgctcctcacccccgctcctcccagccagcatcaacatagagtgatgtggtgagagtcacatgtagaaatatcttaaggaaacaccagctttcactcaataggtaagggatacaggagaaaaaaaaatgttttcagtgcttataaatggcagagactattcactttccccgattcctttaagggagtctttttggagaaacaatgggaagaatccttaattttaccttcgtcataaaaatacatttccttgggagtcagataaggcctttgtcttcagcttcaaatcttcaagagtctgggttgcatttttttttttttttaatgtaaacacctgggaagaaaactctccagctttcctcgaggactatttgcccacctttgatattaatgttattgttatataacacctacaatataattgattggctcttgggaacataaaagaaacttgtattatctttttaaatctgaacaattggctcccttggggaaacaaatggctgcgatctaacttttatggtgtaagaaaatgttcttgagaaaagtgagagctatactctaactttatagtatattataatgtattataatatattagattccatagctccagaggctgtggttttacagaacaactacaaaactaaaatccaggaaagatttattttcccacagtacagtgggtgtttttttttgtttgtttggttttgttttgttttcaatattctgacaatttctgccttttaatcaggctgtctcatttgttaatgtctaatgcaattatccacatggttggtttaagtctgccactttattttttatatactacttggttgccctagatattatgatttacatccttgattttttatagttcaattatagttaatgcaatatttcatgagaatatatatgaaaacattaaaatcttgctcattctttgttataattcttaaatgtatcacacatacaatcattataaatcctgtaagatgatgttatattcttgttttatacaatcatgtttttaaagaaattgagataaaataagaacaagggaaaatagtattttgcatttactagataattagcatttacaatgctagtctttctttactgaatatatgtatgactgttgacctggcacaattttcctttagctcgaagaacttctttttgactttcttgtaatgcaggtccgtttagagataaatgcctttagcttagtttaaaatatctctatcacttcttggttacggaaagatatttattctgtatagaatttgaggttgactttaaaaaaattacgcactttattttttttgagacaggagctcactccactcgctcaggctggagtgcagtggcttgatcttggctcactgaagccttgacctcttgggttcaggtgagtttcccatctcagcctccttagcagctgggactaaaggcatgtgccaccacaccagctaattttttatatttttagtggatatgggtattgccatgttgcccaggctgggatgcactttaaatgtgtgttcattttcttctgtctttcagggtttctggtgaaaaagacaactcttaattggatttttattaccatgtttgtaatatggcaattgtcttttgcagctttcaagaggcaattgactcttaataatttatgtttctcagcatgattcctttgtgtatagtctacttcatgtttgactaacttctgtctgcaaatttgtttcattaaatttgggaaagtccagtttatgatatgttcatatataattttttctgccctatgctttctccactctgttactaaaattatatatatgttggacatttgaataacatctaacaattgcctgagatcagtgttttttttcttttcaatatttattctttctgttcttcaccttgggtgaactctgttggtatacttgaaagttcactttctttctactctgccatgtgcattaagctcttaagtccacccagtgattttttttcaaatttcagaaattgtattttttttagctctagaacgtctttctccttatctcgctgagatttcctattactctgctgagaattttttatattaaaaacctattttgtctattttgtaaaacatacatgtaagataatctatacaaactatttttatttttttctttgatgatagttataatagccacttttagaatttttttctgttagttctaaacacatggttattttagggtcgaaactcttgattttcctttctcttgaacctatgctatgtgttcttggatttttgcatgttagtaattttggcattatattatagctattataaaagttaaattttagagattctaaatttcatcatttttctctaagtgttgtttctcttgttatagtagaattttttgtttgtttgttttggtaggattgaactgcaaacctttttttacttgggcggtagctcctatattatttcatacatttgtcattacaagagttgtcttgagtcttttctgcacgtgtgcttaaggtattagttgggcatgtgagaaggtaaagttttgagagccccccctttggctctttcccttttaaacatttccccattctttttaacaaatcctggtttccttacttcacttttacaactccttacataaaaaaaaaaaaaacacctttttttcatgtgtgtccctgtcacaactgtgagcactgcttgtactgtccttagacgtagtccaaagcccacagtgacagtaatttactctgcctacctacccttctacaggtaagcaaaaactctgctatagaacctgcctacttctattcaccctctcgtaccttcagatagttgcttattgtattatatacgtgttttataattttcttcagggatttgttcactcaattcctactgtgaaaactggaatcaaaaatgttattccctttttgtttaatgaaatagccaaaataagactagcctttcttctcatctgaagtgctcaagcaacttggtttataagatataaaacatctcaaactatgttcttggcatttttcctaatttttaagaattcacagcatctctattacacaaaacttcctgaaaccctttatatcatgttttgtgaagaagagcctcacatgaaaattgtcctagaaaaccagtttttctactatcttttacttcttacagtaattgcaaaattctgttctcttttcattccgtttacattgttcattcattaatcatttaatgacccgtaactatgttccagtagttgttaaattccaaaacaaaagaactaaccaggaagatccgaaccctgaattgtgttctttgaaagtagttttgaaaacaaatgtgtaagcaaataaattataaaacacttttaaaatggttattacacaagtaccaaaaaagctaggaaagtgaaggaaatttttacctctgttttaaggtggaaggtaaaactttatagagggcaaggacatttgaattcgttcttgaaaaatgacaagatgttttccaaataacatctgtggcatagagctttccagacagaaataagagtaaatagagataatcatttttccacgtatcatccctatttctctctgtggcttttttttaagccaaagatgcaaacattcatcatattaaagtacatattttaaaaatgtgtatctttttttcaaaataaatgtttttctatgtgtttgacatataaggtacatggaatggatgtagcattgtgtcaagatgcatgatgctaaactgataaaacttgtcctccatcgtcaacagtgcagtataaaaaatcattgaagattaaatcaattaatgccatgataaaatttatatattagaaagatagtaataactccggttatagcatagagaacaaatttggaaagagaaaattgtaacaaagcagaccatctaatgcttctgaagagtgattataaggatctgaactgcctcaatgataacaggtattgaaacttcagatcacattaggaaaatatggcagatggaattgacttggcagctaataggaaatatgtgcatagaaaatattaacgaaataagactccaatattttatttttagtaattacattaaaaaaaagaagacattttcaagatggaggaatgagttttatttagccattgttgagtttggcgtatatattataaattatgacttcttatatcatttaggaagaatatgtagacaacagaataacctgctttttattttttgtttgtttgttttggtaatttaccattattatttctcccttgtctctctctttccttaattctttaagtgtttcttaacccctgtttgttttggtttgttccaaccctagccctaacccccaaatttattgagaaaacttcctagcaatatagacaaaatatatatttattaatacaatgtatgtttattaattcattttcttttcttggatcaccaattattttgtcacaaaattctacataattggcacatcttacaaacctttattttggactgcctgccaaaatggcacccacatgggctgggtgaggtgactcaggcctgtaatccctccctattgggacgccaaggcaggcagatcacctgaggtcaggagttcgagaccagcctgaccaacatgatgaagccccatctctactaaaagtacaaaaatagccaggagtggtggcacatgcttgtaatcccagctactcaggaggctgaagcaagagaatcatttgaacccaggaggtggaggttacagtgattcaagattgcaccactgcactccagtctgggtgacaaagcaggactctatttccccccaccaaaaagttacccatgttaactttggttccatatactattccatagccacaattttcatctaatttcattatgttcatctcccagaaaaccttactcactttcaacttggagcttatttgctccagtatcaatgtgagatcttttaacctccgcttgagatatgagataactaagactctgcattttaacaacttgccaaacgcaggcccagagcagtttttctgatgaccatattaacttgctttccatcatagcatgctttctctgcagtcaaaaattgtgttattcttggcattttattatatattttctttgatactggatactaataatcatgaacattcccgagtatgcaaaatgacaacctaatcacaaaaaatcaaatataatcttttaaatcatttttatgatagattttcaaagctgcttaagaagaaaaatatcacctgatttgctgtatatatgacctacctttatactttctcaaatctcatggctaaaaaaagaaagtacaatagatagacctttcatctaattttcaacttgcgaccatggcctaagcttgtaataaacatcaaattctattaaaaactatgagaatgttaaaaataaaaacaaagaaaaacaaaatcaaattcctctgctctctctgctattttaaaaattctgaataggaaaaagatctacatagtgaaataaatgtgattcaataaatagcttacattacattgtgaattcctgtatgcttacatcaagttaatgcccagtaattcaattaaatgaacacaatttagaaggagagatttccttaataatgtagcagtgcagtttctgggtaaaatataaaacagtatttatggtcatttactcaaacctctactaacttcagtggatattactttatgaattttacagtatgacacaaaagcaagctcaatgaagcagctatttctctaccagttgaagataataaaatactttactaagtagtcatttgtattacagttgcccttcataaaatactggtgctgtatatttttactatttgcttccactcttatggtatgcaaatataatcattataccattttactgaagtgttcagcatgtttctacaccttctaaattggtgaaaatgaattgcgatagcatgcagtattaatataaaatgccaggaaaattgcccacataatataactctcacattataagatttaaaaatgtcagtttagctcttgcaaacctccttttagttgtgcacgtaagcagaaacatgaggcactaagtgttatatatcttttgaaaatggcccatctctctagggatcagaatagtaatactgcttgcaaaataatatttgcagaatcaaagagaagaatactaatctcagtgaaacctaaatgtattgctttactgctattgaaatttaggaaaaagacaagactctctctgtgaagaatacaatgagaaattgacaatctatatgatgagtaggtctatacatttccctttcaattttatagagtgtattgagatctaaaaaaaaaattgtataggtttattcctgagaaaatacagagttcagtcacataataatgcttttgaccaattttgaggcaaaatttaaaacgaggtagtatggatccttaagacaacctataaaattataagccatggtgcttcaaatggcagtatcttctagctgtattcaatacagaattttaatttttgaacaagaatatatttacttggaatgattgcttaacttctttcttcatgccatgttcttctttacttcttattcgaattcttatattgttgaatgaaagaaacaaacgtggcatcttttagctgtgtagggaattattgggaagacaaagcaatttactggttttgtttcactttttcctatgactaattttttcctgtaagtagctggaagtgagtagcacccacactacatgattgttaagacagaataagttaaacaaagagaaagacaggagaaaaactaaaatcagtcttttctaaagccagattcctctttgtaggtgtgattacagaggcactgtcaaatggcagctctgcaaagtactcttgcttattaaacgatggcactaagaaatcagcatgaaaatctttggtctcctacatagaactgaccttatttgtaatatctccatccaccaaatagggataacaaaacgtatgagaaacaaatataagaattactaatgaatatatttaatacaaataaaacattcagaaacctagaaatatccaacaaatgatagtttcactggtatcaaaaaagttactcactgtatttattctctccattacataaaaaatgttaaagtattctaaatacatgaataaaaatacaaagaaatgccaaatatatgtaactcttatgaaataaaacaaactatatttctttgccttacatttttatagaatatcatatttttttcttattaaaactcataagtagatttgaaaaaaaaaaaagcagcagcagcagcagcagaatctttagttccagaaggacttgaactgaaatcctggcattcttattctagacatttgggtaatctttccaaactaattttttttttttaaatttctccatctctaaagtgatatttcagggtggttactgagaaaatacagtagtattttctgtcctgtctgggatttagtaagtatctccagaagtggaaaaaatctattctatttttctccatagatattaatattaataaagaagataatactgtctttcttggataccattctttctttgtggtatgctatttctctgctttgaagttatttatccctctttgatgacagttctctacactccggagtcacttcttcaagtgatttcatccactattacaggttaacaaccaactgcatgttgattgctcccaaattcagatctctagattctgaatactcctatgtactttatattttaccacaattatacgccctctatttcacttacactattcatcaacttttctcataatgctagtcattcccctagtgattcccattaccctataaacttttctttggcaccactaaagttcatgttatcttttacccttgcatgttttcagtcaataggtagagctgattttacttaataaataatcctcaagctgttcctgtttctcggcctactacatcaacttgaattttcagtacctattacctgaaattctttatttggctgtatttttgcatctttgcctgcaaacttccacaaatacatactttgcacagttatcaggctgatcaaaatatcatgaaatgtggctgaaaagctcttattttttaaattatgaaatgaatttctatcaaatataaaaacaaaaaattttatacaaagtatcataatatacctttcctatgaccattgaagttttcaatgacctaatgtatatgtgcctatccatgttcatctttatcactcactgttttgcagttattttagcaatagcaaactgcattcttttctgtatgcttttgctcatgtccccacttcctgaaattatcttttaatcttgctttacttaatttctactatattctgtgtctcggatcagactagctaacagacctatcacatgctttgaaaaaaatgcctgacactatgttaaagggagaaaatttaaaaaatttatatattacatcttatcttttcattaggtacattcatagctaagccatgccttaagataatactaataccaattagaaatagtctattgaggatttttatatatctgaacccatgttcaggattttataggtatagccattaaactcaaaacagactgtggcagacatatcactattatccaccggaggccatccttaatatgcctctctgataaaagacatagattagatttcctcagagggtaaaattaagatgtacagagtttaggttacttgtaggacatcatataactaagtggtggatctaggagttcaccccacatgtttctgacttccaacattatacttcataacactgtggtgtaacttctctcaatgaaataactatgtctgtctgtctgtctgtctatctaatctatctatctatctatctatctatctatctatctatctatctatctgtttctgtcctcatgagtatttaaatgctggcttgacatctaaaacaaattagatagtagacaacactaaacagtaacattttggaaaacatacctggagtaatttaccctctccctacattcaaatttaaatattcatgaaaacacagaaaaacttatgagttgtttaaagtagaatggaaactaagcttagtggtctataatatgccaaacattcataagctcagtatgactctattaccaaccatagcaccctcctcttttacccacctacaataaacaaaagaagtcaacattcttcacgtctaattaacacattttccccatagtactctggaaagtgaggcatggatgcatgattcatggagggtgaattattttagtcatttaaggtgctttgtggctagaaggatggaaaaaggggatacaagtgctataagtggatcacttaaagagataatctatctctgtgggaagcctgtacagaatgagacactctctagcccaagggcaataactggcttctggagcaagatgctggctattgaacgtgacaaggaactgcttatggctcctcctgaccaaggctgtttctgtacctgagtccttcaggagataggaaagaaaactagccaggaaggtaaatgaagctgcttttaaataacaattctatgaaaacaaaacaaaacaacaacaaaaaaacaaaaacagagatggttgcatttacttccaagacaatatattttatatctacattaagcagaatagggtttgtgacttaagttgttatacaaaaatgacagttacatttacttttgaaaatctgtgtttgtgattatgaaacttgagtctatcaaaaaggagaatatttcctgccaccctatcagttactcccttcctcagtggtttaggggcttctgtgggcatttcaagcccttatcaatgtccaatattcctttcttcccaggtgcatggaacagtggcacttttcttttgtcttgaagttgtagccattaaactgcactggccagtcaaatgtgagtaggtgatatgaatcactttcaggaaacatttaattgccagactgcaactctcctgtgttctcttctccagcccaaaggctgccttaagcttttgaggtcacaggtttttaccatatcattacttagcctaacccaagtgaaccaaatgaacgaaccaaatgaaccaaatgaatgaatgaaaactgctttctttctagctggaactctttccaacatgatcccaaattagacaaagcaccttctaaagctatttatgtaccatcatttccataattaaaacaggtataggacaaacatgggtagatggtagaatttgctgtcatagacataaagggaaccagagaaaaggcattgaaagacattgtgatcagtaaatgctaagtgttgtgccttttcactctctaattacataaagggagtaatttacagactgcttcacattacccaaaatatctgtcccgcagtcaattgaacataaattttcaagaataagtccctcctcacatgaaccacagcaggaaataaaaagcagtaagaggaattagactagctgatttgaggaccaaaataccatccatttaatattagagagttcaacaacaaaaacataatatactttatgtttatatgaagaactgcatgtttaggttattcaagaaataggaaaagcagacaacaaaaaagaatgggcaactgaaagaatttccaaggaagaatctgacataaaaaagaattaaatatgttattaatgccctaggcactgatagatgtcctagagatagagctatgactagcaataccagatttgtttttattacatgaaaaatattttgaggaggctgtggaatgtggtgaattattacatctagaggcagaaggaggcaaaacaatgacataaaaaggaaggcaaaacttgaaccagatacttacagacaataactacaagagataaataaaactgatagtacgaggaagaatggggaaggattgtggttgttggtgatttagagtcagaaggctgggaaggtctctctagaagaagaaagttaactgagattcaaatgatatgaataatccagtgttttgaggttttggtctctgaggtgagatcacgttggcagcatttgaggtgtagaaagtattctagtgaaactgaagtgttctgagcctgagaagaattgtatgaaatgatgtaggagatgtgggctgggcctttttgtgacagatgctggtagtcacatgatgagggcctagttaggcttcatttagaaaatgcatccgaattatgaactactatccaaatacatttaaaatattctggtgtattttgtaaagttaaatacttctcttgttaattatgtctgtttagataggtcttgttaatgagacaagaaacacctgtgtttggcttgccatgaagaattatactggctgttttgacctctggaggaaggctgagccctttggcatcacatgtgtttgcagctcgtcaagctggctggatatcccacctctccatgccctatagctctgtctcggaacctgtgattgctgtgaattgtgtcatctgcacacagttcactaaccagttatgtatagactggttatgctacatttagtagtttgtgttttattctgacagttggaaagccacaagagagttttaagttggggagtaacaaataaatctataatttaatgggactaccatgcctgctttgtgacaaatggatcactagaaggcagaaattgtagtggggtgaccagtttgaaggatgttgaaatgactgcaaataaacaagtttcacaggttctttaaggaaaaaaaaaaaaagaaatagctgacaattctatgcccaatcaagttgtcattgagataaagttaacagaatgtttgttaatatataaaatgtttaaattaaatgttaaatatattaaataaaatctattgtaaaaataaagctctatgttaaagcaaaaggaataatggaaatggaatgaggggagaaaacataccaaataaatcaagtaaaatatcaatagttaagtttttctcttttcaattattatttctagaagaactagtttatgtattacttttatacacttaaagcttctagttaagaaattgctgctctaagacttgagcctctgccagtgaatgctactgtagcacataaggcttaggaagtgggcagcatgcttgggaataccattatcttagagacatttgcaaaagttcaaaactaaacatgtgtaagttacttccagtaaaagtcatcatcttataccaaggcacaaggagctaccacgtctaaaccttaacacaaagagaaacagcaatagaactggtgactgcagggtttcagaaaccaacaaaaccaatcatattatgattcaaatataggtaaacttgagtcattatcagatgttcaagcactgatggtcatcattcacccagatatacattctactcaatctagtattcccaagcacttttagggtcctccactggggtttgccacactctggtaaaaagaatcccatttttaaaatttcttagcctttttatcttttttttttttttgcctaaatcagttgttctcaaccctgaattcacataatattgaatcattctttgatattaaaaacaaacaaaaatagctaggcatggtggtatacacctgtggttccagctacttgggaggctgaggtgggagaatcacttgagcctggaaggtagtggctgagctgtaattgtgacactgcattccagcctgggtgacagaacaagaccctggctcaaaaagcaaacaaagcctgtaattctagcactttgggaggccgaggtgggcggatcacgaggtcaggagatcgagaccatcctggctaagaccgtgaaacctaccccccctccccgtctctactaaaaatacaaaaaattagccgccgggcggggtggcgggcgcctgtagtcccagctactcaggaggctgaggcaggagaatggcgcaaaaccggcaggcagagcttgcagtgagccgagatcgcgccgctgcactccagcctgggtgacagagcgagactccgtctcaaaaaaaaaaaaaaacaaaaacaaatttaaaaaaaaccccaaccaaccaaactaaaaacacaacactcacagaaaacaagcaaggaaacaaacaaatgaaaatctacctcttccccatatgaagatgggtttaaatcagaaaacatactttaaaacaacacctttttttaaaatagttttcttcagaaaacaagcttcctctgcggccttcttaaggctcttctcttacacatcacatatgtcagagacaaggactgacatggctcattatcaatgcttccagacattactctttttctttaaataagcaaaaaaaaaaaaaaaaaaaaaaaatctttggttcctttaagatatatattgtctttccataccagtgtgtcacacactttaatgcaaaccatgtggagtttgtattaaaatgcagtgcagactatgattcagtaagattggaatagacaagattctgcacttctaaaacctcagagggactccagtgctgctggtccatggaatacacctaaaaagcacaagccaatatcatcctctctttctgtgaatcacctcttcgccctcccattcttttgctcaattttagcctctcgttcacagacttttcttccccatctccttttatcaatcccaatgatataaacatctatatagatgaaataatctcaacctgaacatttttatattaataatctaacattcaatgatgtttccctctacttcaccttaacacttgtaccttatcaacaagaaacaagactacatttatatgtctattttaaatatctggttttcatcttccgttctgctgcaccatcctatgtcccatattcttacagttctcctgatattgtacattcattgccatcatttcctgaattcattatgtccctgagcattttgactctactactttctcagaagggcccttcttgtcattcttggtggggagcagaggcacatgagaatcctattctttctggtatctgcatgagcagtcagcccactaaccactgagcaattcgtttcatgtgaatcttgtcagtggccaagacacttgtgcacattgatcttgactgacccaaaagagtatacaccaagtaagggaacagtcttctctgtttagagatggggatgaaacttatacagttgaaaaaggagacaaaggaagagaacaaatggggaacatttgagtctctattttcattaagatggaattaggcatcagattatctaagtttccagccttatttcatcaaatcctaattctggtactaggctaattattactaaattttcatgtggtgtgctttgctaatcacttcttgtgttttcatgagtgtcttattggaaatttgtgaaaaaacatgtcaatcctatcaggacatgattttaaggtagaagctaaaaaataattcagaatattttggggggagtgagtgattagagaacatgtataatggagaatgatcagctctggagcatgtttactttagcagtgaatggcctaatctacaattacttgcatgtttcttagaacattttcttctctctgtattctactactctacagtgatacgtgtataataaattgccatagtgatttggaattttaaagcaattcaggttaggctatagtatctcaaagcccctaggtaaaatttaaagcagaacacaatttacttaggttattttcattttctgcttagtctcacctttacttatttcttattattagtcttcctgtttgtttcatatagctaatttatttttgtttgcaacctgaaaaaaaagaacactaaaactaaatttggaaaaaaagtcataaaatttcttatatcatgccttatgcctaatatatttaaaatgacttaagagaaaatagccacctatgtcttttagataatttgtaaaataaactttcatatgaggtgtaatggaagaggtctcatattgaatcttgaattgggacagatattaaaatatcagaatcccaaaaaattgttttaacaagtaaaacattaaataaagtacagaataacatatgcacagaaatgaatatactaaaaaagcaggtttttcaaatgtagtccagaataacttggctttcacaatatcacaaaaaggggatttgccacaccagaagaaaccattcatacatatcaccccacttgttttttcctaataataatgtttataattcagacaggtcttcaaagacagggacctaattgggcttatgcactggattggtagacataataaggtgaaagttatgaagagcgtgtcaatgagaaaatttgatagtcttgaaacgtaacatattaatttgcagtcttatctcagcaaaacaagtaactatcttattttttgaaattcgtactgtttatcataggaaaaaaaagtgtggtcccattaatgtttaacataggaaattatgttagtttcagttttcacacaccactgaactgtcttttgatgccatagtttgaaattataaaatgtggaataattaaacatttattgaagttataaaaagtgagaaaaaatataatttttgagtcaagttttcacaaactaaaactattttctgttttactcttaaatctgagtaaatcatctaaaatcttaaaatatcaattttagaaataaaatgaaaataataccttgtttgaaaatttaacaatgattatgtgagaaataatgcaacaacacgttgagttcagtgcctggcatagatatacatctatccatttattcagtaatatttgaacatagatattatgagcatatattaatatgaagacacaattagtcgtgatttctaaaaaaataaatacagataaaaatgatttttatgagtacttgcagctatgctatgtctatttaacttaaatataaagctcatataaataaagggaaacttgagcaactgtaattttaaattccaaagagacttcttgactaattgctacgtaaacatcctttcttcgactggggaaaaagtgaatgtacaaacattaaaaaaatttgttcaccctaatgttgtatcctaatacaaagcttgagctattatttttctaaagagatagttaaaaataaattacaaaagaggaagaatgaaagcataatgtattctgtaatacagttatgttttattttgtgttaaatttattttttgctgcttttaatataccttattagaaaatagaggaagtcacctcacattgccataaatgagaaaaagttgtaattaaatataattaattgaattaagttgcgtatatggacagaatatataaggacacttccccttccaccaggaaagcaaagaaataaaaggtcctttgaacagagcttgaccttctaagacagtttgtgataggaattcactgctcaaacctatgaaataattgcaattgaggaaggaaacaatacaagagcagaaggttgacaaaccagagtggctaatatatgtttattacttaatgttatgtcttttcaaaagtgaaagcagctttggtgaaaaacttccaattggtggctatttcttggctttcttaatctttcaccagctgacttataacacccacccacccacacacacacacacacacacacacacactagtttagtctcccaaagagaaaagtttatcatatttcgccaagaatttccctaaattctgaaatggtgaaaacagtcactttatcagaaggatgttcataatgttaaattaacatttaaagcaagccaggcctgtaatcccagcactttgggaggccaaggcaagcagatcccttgagctcaggagttcaagatcagcctgggcatcatggtgaaatctctacgaaacagacaaaaattggcagggctggtggcatgcacctgtggtcccagctacttgggaagctgaggtaggcggatcccttgagcctaggagtccaggctgcaatcagcctagattgtaccactgtactccagcctcagttacaaagtgagacactgtctcaaaaataaaaatataaaggaataaataaatgtaaaaaaaaacattgaaagcaaaagggactttgtagacctcctacacatggatacaaataagaatttatcattgagcttgatgttcgctttgtcacattgagaaaatttaaatattatttccagatgaataaatttgttgcattaaatgtcaatggtacactgaagcgagaatgtgatttgaactcaagagtctttagaaatttgtatcaaaagataatgtacatgcttaatttttatatgtaattcacaaattataaaatataatttgtcagaataaaaaatggagttttgtacttacatttgaggttttataattttattacaacttaaacatctccatgtctaatgaacaatatatgcattacttctcctgactacatcaatctgcattaaatcatagtgacagttgcattaaatcatagtgactgttacattaacagctaaatgcagatagttctcttcatttaggaacatgcttgttaatcagaattacacaaatcttgtacatctccagaaactaacactgacctagaacttaattgttcatctaaatgctctgtgaagtgtttgaataggtgtaatttatttacttagaaattaccaacacagatgctgtcccccattacacacctcttttgtattcaactatgatttaatggtttcttgtacaaaactagtccaagccaattaaaaagcaaataaatagtcacagtggagggtaaattgccttttctgccttcttgaagcatgtgtgcaccactaagataagatgttgtcaatctgttaaaatctccgtgaatccatccttcttcactgctagtagcaggaaagctttaacactttgaacaactaggaagggtcatttgtctaagttgtggcaaagcctaaggggcagaaaggccatagtatttcctgcaacacattaatctagactttaaaataatggaaaatattccaaaagtgtcactgttaaacacactgttgttggcttaattcaacttcctttttcccttcatttattcaagataaaataatgctgtacattttatttacaaacatgaagcaaagccaatgtcattaggattgttcagtgtagacaattcatctatagagtctcaatgaaaccagttgctaagcccccatctcaagtaacttaatgctgtcacttcctcatcaattcctttgtcccccgctgcccatttgcagttgtttagaattttgtttctgttgcctagaacaataatgagtattatgatgaagttatcaatgacagaaatttttaagcacattaattatgcagttctatttcaatgttaccaatgttcttttgataatatatgtctattatttctattttgaattgcatttattatagactaaagctgttgtaataaagaatccgaccaaaatttttgatgtttgatggcttacagcttctacatctcactcctccttgctctcctactccctcacatctataaaaagtggataagaaagtctgtgtgcttcctactttggcacaggtcagaagctcaaaccatgtaaaccccttcccctcctggccccacctcctaacaataaggatccaaagacaatctcccttcccttgcttttaggccaatttaggaggcctgccttcctctcttcagaaaagccccattatgtgagtaacaaaactttttgtgcgctcttggggtatgtgtggctttatcagtctctacatctgaaccaaactgtgggtaggaatctagcctgcatcttctggttgtatacaatggttttataatttacgtatgcatatgaagtacctggtaagattataaagcatagattcctaaaccttctgcaagtttgtgaattggacactctagtgagacaccaacaagtcagggttttgtttctttttgttgtttgttttttacagatttgtggcatcaacattttaccttttatacccatttcttggataaacttattaactctttcatttaaagtcttgctttaccttgtgcattattctcccactcttctttaaggcttaaatctttgtatcttcaatgacaataagactttagcacacgaatgtgctcaatgttacttctatctcagaactaatcaagtaaaacttgagaaatatcagcaacaataataaatagaaatgtcatcatggtttcttatgtcaatgctaactctaaatttgacaaatttctggtttctagcttgatttagagatggatcctaaataggctgcttgaattttccatcacgtctaattctttgttgcatgtagtttttaagtgccagttaataggcaagcacctgcctgaccacatcagcaacaccagaggcagaaggcattattaaaacacagatttttgggcccactccacagataagttggtgtagggcccacaaaaacgatttttaaagaagcaccccttcaggattcttatgcagtcagctaagtataggaatactagttagtaatgaatgtgttctggagcctcaaaatattttagagcaggaagctgccacttattgtgccaagttttctctccaactcttgcagcccagcatgtcaactgatgaaaaagtgctggcgttccaaaaagcctgggggatggtgctcagaaagcccctgctaggagctagattggattatctcaactcatacctctcagctaacaggtgacaccctgctgaaagctgttgacctgaggctcttttggattgtggtaagagtgtgaattgtgatccatcactctggagaaccctgatcagaggctattagcaatgcacctggtcttggcaattgatagaaaaaggaacactgtgccaggggaagcttgcgacaatgaaaactgtttcaaaattcttctttatatcagcaatcctaactctagaatcatcaaaatataactaggttttattgtgtgtgaaaatgtgataattccaatcaacacagttgtactacttaaatccttcagttagaagaaaaatactaaaaaaatactaaataaacgaacagatttttatgaattttatactgtaatttcccttacacctagtagggaagaatatttgaatttctagaaataatgtatgtatttatctacatataaaaataaaattaagactttacataacacccacctttaatcaacgtaacattttctgacatttatgcattttcagaaaagaaacaactagcctgcaaagcaattgttaaattttaaatgtaggcctccaaaatacaataaacaaactacagaaaacagaagcctatcaacacagtaaacatttgcaatggttttaatataaccataattataaactgaagaacagaaatatattaatggaaaaacaatttactgtagctgtgttattgtcctgaaacaggaagcctatgtatctaataataaggtggaattgcatcatgtgtaaatatataaaatgagactttttcaggcaggcattgaacacatgtttactcagacttttaatgaggtgtctgagagaatagcagtggtcccttcagtatccatttcttcattttcttaggcatatcatctcccaaatgaagagccagggtgatgggctaagacctcatatattaaatatgtacagaaaaaaatgtgtgtgcaactttcctctcactgtttgtgcagaactttctctattttatcttcctataaattgcttgtacaatactttattttatcttcctataagcaaaaacacagacagacatctagttttaatcaatcaaataataataataacttacatgatgaaagatcccaaaatggaagcaattgtctttctgaatgactttttggtaagtaaatctggtcttccagtaagaacttcccatggtcaaactattaagagatgaataaatatttatcttacccaaatcattacatttttgggtctaatttttacagcagcttaacctttaccatatccgatcaaggtagaaaaagaaaaatattcaaagttatatttacagagaaatctaaaataaatattaacagaaaggagaagtgagagattgagaagcaaaaccaaggatacccattgtcactacacctattcaatatagtattgaaaatcctagctagaacaatcaggcaagtgaagttaataaaaggcatcacaataagaaaagaacttgaactatctttcttcaatgacaatacgattttatacctagataacactaaaagactctgccaaaaagctcctagaactgatagacaacttcagtaaagtttcacagtacaaaatcagtgtacaaaaatcagtagcatttccatacacaaataaagtttaagctgagtcaaatcaagaatgcaattctatttacattagctaaaaagaataaaataagcaggaatacagctaaccaaggaagagaaagagctcttcaaggagaactacaaaatactcctgagagattacacaaataaatggagaaacatcccatggtcatggatcaaaagaatcaatattactaagatggctgaactgcccaaagcaatgtacagattcagcattatttctaccatactaacaacttgatttttcacagaatcagaagaaactattctgaaattcatatggaacaatagaagagcctgaatggcccaagcaatcctaagcaaaaagaacaatgctggaaatttcacattacccaacctcagactatgctacaaggctgcagtaaaaaaaaccagcatggaactggtacaatagacacatagaccaatggaacagaataaagagatcagattaagtcatacagctacaaccatttcatctttgacaaattttacaaaaataatcaatgaggagaagactccatattcaataaatggtgggtgctgagataactggctatccatatgcagaagagtgaagttggaccccctatctatcaccatatacaaatatcaattaaagatggattaaataaagacttaaatgtaagacctcaaactataaatatcctagaaagaaacctaggaaatatccttttcaatattggtcttggcaaagtatttatggctaaatccttaaacgcaactgcaacaacaacaaaaattgacaagtgaaacctaattaaactaaggaggtcctacacaacaagagacattctcaatagaataaatagacaacctacagaatggggaaaatatttgcaaactatgcatttaatgaaggtccagaatctataagaaatttgaagaaaacaaaaggcaaaaatcaaataaccccattaaaaaatggtcaaaggacatgaacagacacttctcaaaacaagacagactagtagccaacaaacataaaaaaaatgctcataatcactaatcatcagagaaacgaatatcaaaaccacaatgagataccatctcacaccagtcggaatagctataatcagaaagtgataaaataacaggttacctctgaggctgcagaggaaataaaacacttatacatagttggtggtaatgtaaataagtcactggaggggcagtttgaagattcctcaaagaactaagaattgaactaacatttgacccaacagtcccaatactggatatacactcaacggaaaataaatcattctgccaaaaagacacatgcacctgtatgttctttgtagtgttattcacaatattaaagccatgaaattaacccagggtatatcaacagtgtactggcaaaagaaaatgtggtacatatacatcatagaatcttatatagccataaaaagaaaaaaaatcatttcatttgcagcaacatggatgtagctggaggccattatactaagtgaagtaatgaagaaacagaaaaccaaataccacatgttctcacttacaagtaggagttaaacattaagtatacatagagataaaaataggaaaaaatagacactggagcctagtagaggagggaaagagaggagggcaagggctgaaaaactaccgcttgagtactatgctcagtaccttgctgacagattcattcaaactccaaaccttagcattatgcaatatacttatgtaataaatctgcacatgtactctctgattctaaaataaaagttttaaataagttacgttcatgaaataaaattaggaataaatattagcttgcccttcccatacatatttgaaatatttaataacaatgggaaaatagtttttgaagttgtaagacaattgactgcaattaagaaaatcacaacagggaatacgatgcagtcatagaaaagatcatgtcctttgtagggacttggatggcactggaggccattatccttagcaaagtaacacaggaacagaaaaccaaatactgcatattgtcacttataagtgggagctaaataatgagaacagatggacttatagaagggatcaacacacagggggcctatcagagggtagagggtaggaggagtgagaggatcaggaaaatgactatttggtactaagcttaatacctaggtgataaaatagtctgtacaacaaacccctatgacacaagcttacctgtggaacaaacggcacatgtaccctggaactaaagttaaaaaaaaaaaaagaaaaagtacatccccataaagactaaaaaaaaataattaataagttgtttttaaaaatagttttaaaatatgctaaaaaaactgtttattgtaagtggtaaaaatgcaattaactaactcaataagaaagaaaaaatacattgacagaaataaactatttgggacataaatgatgaaagacaaatttatttcttaagtttttataaattatatatacatataaactttataaaaaatatatatttggagtacaacatgttttggcatatacatacccagtaaatgattaatactgtcaagctaattaacatattaatcacctctcttagttacctttgtgtgtgtgtgtgatgagaagttagttttattggagaacaaagtagtcatttcccttgagcttagataagtcaataaaactataaagtaagtaagggggaaagccagaaacaacagaatatacattcttcttattgccacatggcacatactctaaaattaaccacataatcagatataaaacaatcatcagcaaatgcagaagaactgaaatcataccaaagacaatctcagatcacagcacaataaaaaatgaaagtcaagattataaaaaaatcactcaaaactgtgcaattacatgaaaattaaacaatatgctcctgaatgagttttgagtaaataatgaaattaaggcagaaatcacgaagttctttgaaactaatgagaacaaagatacaacacgtcagaatctctgttacatagctacaaggtagtgagggaaatttatagcactaagtgctgacatcaaaatgttagatctcaaagtaactacctaacatcacaactgaaagaattagagaagcaagagcaaaccaaccccaaagctagcaaaatacaagaaataaccaaaatcagaactgaactgaaggaaatggagtcataaaacaacattcaaaagatcaacaaatccaggagttggttttttgaaaaaattaatatgataggctgctggtagactaataaagaagaaaagagaaggtccaaataaacacacttaaaaatgacaaaggagttgttaccactgaccccacagaaataaaaataactgtcagaaactaccatgaacacctctatgcacacaaactggaaaacttagaagagagggataaattcctggacacacacactaccccaagactgaagtaggaaggagttgattccctgaacagaccaataacaagctctgaaattgaatcaataataaatgccctgtcaaccaaaaaaattccagtgccagatggatttacagccaaattctaccatatgtataaggaagagctgattcctactgaaactgttcaaaatattgaggaggagggattccttcctaactcattctatgaggccagcatcattctgataccaaaacctggcagaggcacaacaacaaagaacactttaggacaatatccttgatgaacattgatgcaaaacccctcaacaaaatacttgcaaatcaaatccagcagcatatgaaaaagataatccatcataatcaagtaggcttcatctctgggatgcaaagttggttcaacatatgtaaatcaatgaatgtgattaatcatatacacaaaaataaaagcaaaccccatgtgattatctcaatagatgcataaaaggctttcaataaaattcaaaatctcttcatgttaaaaactctcaacaaactaggtattgaaggaacatacctcaaaataatgaataatctatgacaaacccacagccagcatcatactaaatggacaaaagctgtaagcattccccatgaaaaccagcacaagacaaggatgccatctcttaccgcttctattaacaacatagtattggaagtcctagctaggttaatcagacaagagaaataaataaagcgtattcaaatagaaagaatgaaattcaaactatcattgttagcagtcaacataattctatatctagataaccccatagtctcagcccaaaagttccatcagctaataaacaacctcagtgaagatttaggataaaaaaaccaacgtacgaaaatcactagcattcttacacaccaagaacagccaagctgagaggcaaatcatgaatgcaatctcattcacaattgcaacaaaaagaataaaggacctaggagtatagctaatcagggaagtgaaagatgtctataatgagaattgcaaaacactgcttaaagaaatcagagatgaaacaaatgggaaaacatttcattcttattggtaggaagaatcaatatcattaaaatggccatcctgcttcaagcaatttacagattcaatgctatttgtataaaactaccaatgacattcttcacagaactagaagaaaagtagtttacaactcatttgaaacaacaaaaaaaagtgcccacataaccaaggcaatcttaggcaaaaacaaaaacaaaaaaagcaaacaacaacaacaaaaaacaccaaacaagcaaacaacaacaaaaaaacaaagttagaggtatcatgttacccagtttcaaactatactacagggcaacagtaaataaaacattatggtactagtacagaaacagatacatagtccaatggaaaagactagggagctcatcagaaataaggctgaacacctacaaccacctgatgttctacaaagctgacaagcagtgtgaaaaggactccctattcaataattttgctgggataactagctagctatatgcaaaagattgaaactggactccttccttacaccacatacaaaaatcaacacacgatggattaaacacttaaatgtaaaacctaaaactaaaagccctggaagacaacataggcaataacattctggacacagaaacaggcaaacctttcaagatgaagacccaaaagcaattgcaacaaaagcaaaaaagagacaaatgggatctaattaaacataagagcttttgcacagcaaaagaaactatcaacagggtaaacagacaacctacagaatgggagaaaatatttgcaaactgcaactgacaaaggtctaatatctagcatctataaggaacttaaacaaatttacaagaaaaaaaaacccactaaaatggttggaaaagtttgaatacacttttcaaaagaaggcatacatgcagccaacaggcatataaaaaaatcttaatataactgaccattagagaaatgcaaatcaaaaccacaatgagataccatcatattacaccagttaggatggctattatgaaaaagtcaaaaaacaacaggtgttggcaaaaattgtggagaaaaggaaatacttatacaatgttggtggaagtgtaaattagtttaatcattgtggaaagcagtgtggtgatttctcaaacagctagaaacagaattatcatttgacccagcaatttcaaaggaacataaatcatactaccataaagacacatgcatgcaaatattaattgcagctctattcataatagcaaggacatagaatcaacctacatgcctattaatgacagattggataaagaaaatgtggtaaatatataccataaaataccagatagccttaaaaaaataatgagatcatgtcctttgcagggacatggatacagctggaggccatcatccttagcaaactagcgcaggaacagaaaaccaaataccacatgttctcacttataaggggaagccaaatgatgagaactcttggccgcaaagaggaagacggaaacaacagacactacagcctccttgagggcggggtgtgggatggggagaggatcagaaaaagtaactattgggtactaggctcagtacctgggtgacaatctgtaaaacaaacctctatgacatgagtttacctatataacaaacctgtatgtgtgcccctgaatctaaaataaaaagagagggaaagatcaatttatcattaaaactgagatacattttaggaatggcaaattacattgtggggccagagtaccccatacatatcataatattttgggtcagggattatataagaataatggacaagatcttgggatactcttgcaactgtccagacctagaaaaaatgggaagttgttgagaaaatctgtgatcatatgagtgagtgataggagatttgtaagtttggaaactgatatatatatattttttcagattagagatgatttaggttggaactcttgcagtggctatagaggttgaatggtgagtgatgacacacttcagtaatttagactcataatgtctattgatgtcttattttggaaaattgatttgattcctagggaaataatagagaaaatctatttcaactatgggtgagatgctttaggttattttgtttgcaacggttggaagagtaaaataaatcacatcacctttttaattcttagaatatttagtcagttacattccctatgttatcctcaaccaaaaagttaacttttccaaagacaaattcattttatgaagttgtgttactttttattgaaaaaaaattaatgtcactgaaattttttttcattctacctcttatttaatatgcaaaaacttgttagtaattgagatagaagacctgtagtttaaatgttgtattattcctgatggatgattatgaatataggacttgactatatttcaagtttatagtttataaagaatgtagtttcagtggatttaaaatagatataaatatagattaaaaaattatttatagatggtttagcatgaaagttttctgctaaacacttacaagtctgttaaatatcacttcagttaacagtgaaatagtgaatctcattcatttttttttaaatctaaaatcagattccatctgtccaatttggtattttggcactaactgttatttgtgatttcgtttgatatggttcatctggaattttagtagtgaccattcattgtgatttgatttgattatacatagctctctgtgatgcttactggaacgcagctttataaatgcaaattgtcctgtatgtctcagttactctaaaattggatttaactatttggaaattgtgggccaagagaagcttcatgaacttcttttaaaaattctgtaaaacatggtatatagcaaatctatttttgaatcttttacatgtaaatttaatggaaacattaactttcatggcagaaataaatatgtatatatgattctaaatgattcattcatcaatatcagaattaaataataaagacaaataaaaaaattcctgtcaatgtggccttctccttgaattataagtcaaatgtattccatacagtacattgaagaatttgtacctatgttaacacaaaagtttgatccatagcatattcttcatgaataaaagaagtaagccatagagggatatgtgtaaattggatacatataaaagtattaggcaatataaattaatagtaaaatatgatcaaatttgaataaactttcttgaaaataacaaattttcaagcaggaataagtaagttatattttataatttccaaggtcattatagtacaaatcatattacgatcacttttttatagttagaattatttctaataggactatctgagctacttcgagaaaactagcaaggtctaccctgaaaacacttcagatatgtgatatttcaacatgtaataatatttataatacatatgtcagatcttaggtgatagactatttactaacataacaattaaaaacaaattacaaactgaatttctaacataaataatgaagattaaatatcctatgcactcacacatatattatcaaaacagtatgttactagacaaaaaaatatcacaaaattataatttttcttcctttttcgagacaggatctcatactatcaaccaggctggagtgcagtggcatggtctcagcttactgcaacctctgcctctggtgctcaggagatcctcccacctcagtctcttaagtgggaccacatgtgcacaccaccacacctggctaatttttgtattttttgtagagatgaggttttgtcatgttggccagcctggtgtcaaagtcctgggctgaagcaatctgcccacctcggccttccaaagtgctgggattacaggtgtgagccactgcacccagccaatttatttcttttttaattcaaaaacttttatattgagtactaaatgtatgcaacacattgtgcagatattcgagatacacagatgaacacaatcaaatgtcttctgacctctaaccttatagaagagtccagataagaaagtaaacatccagcaaataatcaccccaatgtataagtaaataaaactgacaaaaataaaaaaggatagctatatggttccaggaaaccccaatagagaaattcactctagtttctctgaggaagtaaagatttagttatgaaacagcattataaagcaattagcaggatcagagaagaagcagtgcggaaagaccattccaatcagaaacagccaaatgttaaaaggccctcaggagtttggcatcgtgaagaaatgagaccatttgaggtcaggttgagaggtaagactgtacccagactgtgggccatgataaagactgaccacttgatattaaggcaatagaaaagcactggagacttttaagccagagatggaatggagaatcagggagaagatcagatttgtagactggaaaattttgacttcagtatacaaaaagaagtatctgaggaaaagagaggtctggggaaagcaggaagccactaaattagctcatgtgagtgataatggctgctggatataaggagatggaaagaaaggcagagaagtaggtagaatcaataaatatttaagaggttaaaatatataggattagtactggaatgggtggcatttgtgtattgaaagagaggaaggaatacaagagatatttaagaggaacaagtttacaaaactaaaccatatgtttggttataaatatgttgaatctcaattatatttatgatatttacttggaaaacataagtaaacatttacatactaaggtatgggcttcagtgagataaaattttgtgtttattacatattggtgataatatcacaccttgggcagaaaagagactgctagagattataatgcctaaataaaaaaagaacaaaaaattaagaaatctttaaatgtaatgttttgtacaaaaagatgaaccactgaaaaagactgagaaggacgtttttaaaatatcacctgaggccaaggacagtaccgatatcaatgaaagatttcaatgaaagagactttttcaatgagaggatttgagtcctattgaggaaaaaattaattacttaaattagggaaaatagttaatatcattagtaatcacagaaatgcaaattgaactattaagatataactgcaaattagcaacagttaaatgataatatagaatgtaactataaaatgagtatcacaatcttcacatgtctgcttcttactttttttggaagcccagtattactttaaaatgtatcatgtaatctactaccagcgatatttggaacacagtagtaaaaataagaattattaaaatatattaagagtgtatatttggttccacgctgaaatggaaaaatgcatttattcctattatttctgctaataatggctaacaatcctggacattatttgtaaaacaaacagaaaactgaaagttggagggaagaagcaagactagctagtaatcctaggatccgagaaataacatattggtgagcacactgggttttctttatactttatatatcccagatcataagtgcttagaaaaataccttgaactaccaacaagagttcagataaaaatagcacccccaaatgcctgctttaaccaaacaaaagcaatgttgcaagacagaaaacgttaaaataactgacctgctctagccaaacatcatgaaaaattacattcatgaggccaacaagcatatgaaaaatattcaacatcactaatcgttagagaagtgcaaatcaaaaccacaatgagataccatttcacaccagtcagaatagctattggaaagtccaaagataacagactctgccgaagttgtggagaaaagtgaatgcttatgcactgctagtgggaatgtaaactagttcagccattgtggaaagcattctggagatttctcaaagaacttaaaacagaattaccatttaacccagaaatcccatcactgatatacccaaatgaaatataaattattttaccataaagactcatgcacacatatgttcatcgcagcactattcacaatagtaaaggcaaggaatcaacctagatgcccatcaatggtagactagataaagaaaatgtggtacacatacaccatggaatactatgcagccataaaaaaagaatgagatcacatcctttgaaacaacatggatggaactgaaggccgttatcctaagcaaactaatacaggaacagaaaaccaaataccatctgttattgcttgtaagtggaatctaaacagtgagtacctatagacacaaagaagggaacaacagacaccaggagcctatttgagggtgaagggaaggaagagggtaacaatcaaaaacctactcatggggtagtatgcttattacctgggtgaaaaaataatctgtataccaaacctccacagcatgcaattcatttctataacagacctgcccacgtagccctgaacctaaaataaacatttaaacaaatacagacccgctcccaccctcatcttcaaatgttgagtgggaaactagacttctacccatgcccattggaaatgatgcactcctcccgttcttagccagagaggtgtcagcagaggcccagtgaaaagcccaatatcccactttcactgctagtaggaatgtaaactagtttggccattgtggaaagcattctggaggtttctcaaataacttaaaacagaagtgacgaggtatgtcaaaagatgccatttggggaatctggaccttgacccctacctggagctactgactcaggactcacttcccccaccagcagtgtcagaggatgccagctaaaaagatgattttttaaaatatccagaatctcataatactatatctaaaatgtccaggatagaaaacttatgttttccaagtaaatatcaccacgaaggcaattaataaatgacaataccaaaatgtgacagattttgtaatgatctgaaaagaattttcaagctgtcattataaaaatccttcaacgagcaattataaaggtgtttgaaaaaataaaaaattagaaagtctcagcaaagaaatataagatattaagaagaatgaaatgcaattttagaaataaaaacataagtaaaatgtatttttctattttcaagttcacaggagaatggaaaaggcagaggaaagaattggtgaacttgaaaatacaaaaataaaatttgttaaaatgaataatagaaaataaactgaaaaaaaaatcatgaactgaacttcagggacctgtgggactataacaacagtttataagatgtaactttgtgtcatcagagtcccagaggaaaggagaaacttgagggggaagtttaaaaagtatttaaagaaataatggcagaaaatgtaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattgacaagaagaaaacaaacaaccccatcaaaaagtgggcaaaggatatgaacagacacatctcaaaagaagacatttatgcagccaaaagacacgtgaaaaaacgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatagacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccacaaaaaatgatgagttcatgtcatttgtagggacatggatgaagctggaaatcatcattctcagtaaactatcacaaggacaaaaaaccaaacaccgcatgttctcactcataggtgggaattgaacaacgagaacacatggacacaggaaggggaacatcacattctggggactgttgtggggtggcgggagcggggagggatagcattaggagatatacctaatgctaaatgacgagttaatgggtgcagcacaccagcgtggcacatgtatacatatgtaactaacctgcacattgtgcacatgtacccaaaaacttaaagtataataataaaaaaaaaacaaaatttctaaatctggcaaaagatattaacaactacagattcatgaatctgagtgtaccctaagtggataattctaaataaatccaaacacacatctattcaaactgaagtcagtgagtcagtctgtctgtctgtctgtctgtctatctatctatctatctatctatctatctatctatctagaaaggaatgaatacaaacatgttaactatatgagtaaaacaatttaattgacagcatatttctcatcagaagttcgggggcaagagtgaagtggcacaaaattttcaagggttgaaacattttctttaccccaaattctatggtcagcaatcctatctttcagaaatgaagacatttgtaggtgaagaaaaacactgagaatttgttataagcagatctactctaaaaaaatttttgaggaagtttggtaaacagaaagaaatgataaaagaatgaaccttggaaccccaagaagaaagacagtacaatatgcagagcaaacatgtgtaactccagtacactatcattaactacagtcctcatgttgtacatgattagatctttcaacttgttcattgtacatatttgctactaccatctaagatgatgggtaagttaatttgttcactatagtaattattttatagtatatacgtattttataatgtatcgtacccctcaaatatacacaagaacagttttcaaaacaatctaatatattttatttctctttagtttgaagcaaaagcttaaaattatctaatgggaatcccagtgtacaaaaaggaaatggttaagacaattacattataatcaggggaaatcaagagacttaaaaagaagttacagtttcaacacttcactcaaactggtaaaatacatcagtagatctttgttgtgatgaagtagttctgtacttgactcaggtggtggttacaggaaacatgataaatggaatagaaatacaaaacacacacacacacacacacacacacacacacacacacacagagttccaatactaatttcttgatttcataatagtactatagcagatgtaactactgggaaaagctggttaagggccacatagaatcactctgtaatatctttgcaacttcctgttactctatagttattccaaatttaaaaaaaaaaaactaataaaggacattagttatagggagctcagacatagctgaaggtcctacaaagtggaggccaaggagacatactgaatatttcagaatgttgccaagctttatggtatttttcctgacttctcatctaaaactatggaggctagaagatagtggagtattttaagtgtcaaaacactttaaaaatgaagcatattgattctgagttctgaaactgcccaaaatatcttttatgaatgaagcaaattaagacattttcagataaaagaaactagcagaatcaatgtaactacttttgaaatatatgtgacaccttcttccaacatttaacatacacctgtccagaaattccatttctacatatttatccaggaggggaaaaatgtatgtttatgaaaaagactcatatataaatgctcatgataaacttgctaataacagaccaaaacagtactagtgtccacacacccgagaatgaatcatatgctgatatactcatgcaatggaatactatgtgggagtaaaactttatgacttattaggacataaaacaacatggatattccttaaaagcattatacagactgaaagatttttttttttgtaccacaggatatagtatattactgaatttatgtaaaattctataccaaacaaatctaatttgtggtggaaaagagcttcaaaacagtggtcatcaatgggatataaagggcattaaaatgtaaagaggccagaaaaaacctcctgtgatatctgtaagtatatagatttattataaccaataatattcaagttgaaaaaataaaattattcgatttagataacaaaaatattattttgggaaattaaaacacactgttgggatttgtatataaaacatttagcacaatggaattaaaacaagataaaatgatgaaaatgacaaattgagatgtaatttaaggattctatcattttctcaatttacggttttgttatcctccaagacatagcttctcttcacattgtctcacttgtcatctccattagatatatttcctctgtgctgcaactgcatcctatggattcatctaccacagtatttcctttttgcatatgtctctgttactcctctagaccagagaacgtggctcatttatctttattcttattgctatcatctggcacagaatctgcctacagcaagtagtcattaaaggatcagcaaagcaattcacaactaccaacaattaagtagaaaattcttttcttccttttttttcctattattgtacaacagtgagttcctcagtattgggttaaatgaagttcacaaatgaaaatgtccatattgcccagttaatacaaattattgaaatgggttgacacaaataacttctgaataagtaggaagttgtgtcttatctaaggaaaatcacactcctctcaatgcctgctaaacttttgtcatggaggaatataacctgagcacttcagagcttcagattttcaagagaagagacatatttcagcttttttataatatcagctcaaacttcacatcttggctaaatatctgtgtcacatatattacaattctattctagattctgatctgagatacaccactttgtgatctatgctacgtaatttcttagtctcaagtaaagagtacggaaaaagaaactatgttagaaggtattcttattgtgaattcagtaagctcacctgagcaatatttctttagactttttattcaacttagaaacttgaaggatatggttatattacctttgaatggaaaaatttaaagagagaaaacgaatttggttaaaccagtgatcagttgtaaatatctaacatctgggttcttgatccaaataatttcacagcattcgcaggaaatatttgtgcttaaaaacttaatacaaattgcaaagcaaacttttacaaaaaactcttacttttttctctgtctccatgatcataattcattgatttaaaattgaacagtatatgttccatattagaataaatttttttaaaaagggattaattcactgtgtctactcataatcacagaagaacagagttattttacccattagtttacttactttttttttttttgagatggagtctctgtcacccaggctggatggagtgcagtggtgccattttagctcactgcaacctccgcctcccaggttcaagcgattctcctgcctcagcctcccaagtaaagtagttgggattataggcatgccccatctcatttggcttgttttttgtatttttagtagagacggggtttcaccatgttggccaggctagtctcaaactcctgacctcatgtgatccacccatcttggcctcccaaagtgctgagattacaggcatgagccacagagcccatttactcaccttttgaaacacacacacaccattcttcaccttaataactacctccttttattttttattacacagaaaacaaaaataatatcccattggaaaattgttcacagattttattcacttaatatctagtccactactactaatttatttgatattaatatttaaaaaacacaaaatcgaagaatattatgaattttttcaacatatattgttactattttttctttatgccactgttttatgataataattatatataggtattttccctcacattttatgtaaagttactagtggagttatacattaaaactttacagatagttaagtttattgaagccctgtatctttaggtatttgtgtctaaaagacatatagatggttacaatgaaagatgcattattgtattttagtccaggtctgtcagactatgtaagaggaaaaaaaaaaaggatgtggaggaaagaaatgcctaattaatataagtgacaattcagggattggatgatgcttaaagagagatttcataatcaatacataatggcaatgtcatcaaacagctagaaattaaaatctgacaaatttgacaactcccaggaatctttgcaccactggtatttattcagtaatacacagtttgatcctaagatattcatcattgcttcctcgttcttgccaaaattttcaaatttatataataggagtttttctctgcaggaaaaaagacctctgattttataatgcatttcagaagaatattagtgatttataatcaacagaattggaatatatccattccatataggaatatattactgaactctaatatgactaggtttaaaaaacgtttttacattttggatactctattccattaagtataatttaatttatatttactctttatatatgtttatatcctagaattatactttaaattcaacttttctatgaattcagaatttatttcaggtatcaataggaggaaagttttgactacttttttggtcagtttccttatttttaagagtatatttaaagtaaatatagcactattttgttgagttaagcatataacataaagtaacacttgaaaaaaatactttctgatatttatttaaaagataatgatctctaagcaacgtttagcttatttgtaagaaaacatttttcccccaaggccaaagttcaaaatcacctcattaggaaagaaaataactgacataaacaatcgcaaaaacaaaaataataatgatccattgaatactaattctcttacacttagaaagaattcctaatagttcttagggcatttcaaaaggaaaaatgagaaagaagtgagaacaggatgtgaataaatcatggaaatattctcatcatggtttcctgttcttcctcaaaattaaaagaaatcaatattaatttttctatgcaccagggatgatggtaaattctttaaacacattttcttcaagtaatccttgctttcttcaagtgatggttgctacgtaattacaattgaaatctctttaattattatcctagtgttttctttttgcatgtatttggttattttgttagaaaactattggtttcttttacaaaaacaaatttgcttcaggcagacctgtcaaattttacattttcttccttttttcttattcagacaatcaagagatttgtctcaagggtaagtctaaaggaaacaggttctgaaaatacttattctttttaccatttgaagagttccatttatcagtttaatttttattaattccctaatatgaatgattcaaaaacgttgtcaaagtaagtatatgggtgtcttttttctgtgatctacaatggtgacatcatttaatgctacattatttcatgtgactcattgtcattgtgtcctgtaagctttggaatagtgcattctactttttgttgctttgtatatatttgtactttttgtatggatttcttctttgctctaaaaattacctaacagtatgttttttggtttttaaactgcatttatatttttggtaaaaattgattattaatttctacttttattagatatgactaaagatggtgacatgagcatatctaattattttaatctataaataatttactctgtagccaagcacatgacaaatatttgtaaatactctccaaacaccaaatatatgttctccatttgagggatacatgattaaatatgcacacacatgtcatctctgtataaatattaacataaataaaataaataatggaacatattttttatatttatcatttcaccagaatatttagtttataagagggatattagaattttcgatgaaaatgttgcttatcaagttagctttgcattgctaaaacttcagtatttcttccaggcagttatttgcaagatacaagttcactattattatatatttcccttacatttttcttatgattacataatgtctcatgtcatatatttaggccctttaattctaaatctaatcatatcttgatattaatgttgtcactccttcttggcccattattttaaacttttcttatactttaataaatttgtcccttctaaatagaacatagataggttttgcttctaaacaaaatacatgattacctgttatattagtctgttctcatgctgctctgaagaaatacccaagactgggtaatttataaagaaaaatagtttaattgacccacagttccgcatgactggggatgcctcaggaatcttacaagcatggtggaaggggaaacaaaaacggccttccttacaaggtggcaggacagagaagtgttagaaggggaaatggtatatgcttggaaaactatcagatctcctgagaactcactcactatcatgaggacatcatggggaaaactacccctatgagccaatcacttcccaccaggttcctcccatgacacatggggattacgggaaccacaattcaagatgagattcgggtgagcgcataggcaaaccatgtcattccacccccagcccatcccaaatctcatgttctcacatttcaaaacaaaaacatgcattctcaacagtcctcaaaggcttaactgattccagcatgaactctaaagtccaagtccaaagtctcatctgagacaaggcaagacccttctgcctatgagcctgtaaaatcaaatgcaagttagttaattccttggtacaatgggggtacaggcattgtgtaaacacacctattccaaatgggagaaactagccaaaacaaaggggctacaggccccatgcaattctgaaatccaatagaacagacattaaaccttaaagttccaaaatgatctcctttgactccatgtctcacatccagggcatactgatgcaagagataggttcccatggccttgggcagctctacttctgtggcttttcagggtaccgtgcccctcctggctgctttcatgagttggcatttagtgtctgcagtttttctgggtacatggtgtaagcctttagtgtatctactgttctgggggctggaggacagcggacctcttctgacagctccagtaggcagtgctctagtatgcactctgggtggggactctgaacccacatttcccttctgcactgttctagcagaggttctccatgaggtctccacccctgcagcaaacttcagcctggacatccaggcatttccatacaccctctgaaacctaggcagagtttcccaaacctcgcttgacttctgtgtacccacagactcaaagccacatggaagccaccaaagcttggggctttcaccctctgaagtaatggcccaagctgtaccttggccccttttagccatggttggagatgaagctgctgggatgcaaggaaccatgtcctgaggctgcacggagtggggagccctgggcccagcccaggaaacatttttcccacttaggcctccaggcatgtaatgggaagggctgctgtaaaggtctcttacgtgccctggagacattttccccattatcctggtgattaacattctgttctgttttacatatgcaaatttctgtagtaggcttgaatttctcctcagaaaatgggtttttcttttcaattgcatcatcaggctgcaaattttctaaatttttatgctctgcttcctcttgagcactttgccacttagaaatttcttccaccagatatcctaaatcatgtcttcccaagttcaaagttccacagatctctagggcaggggcaaaatgtcaccaaaatgatttgctaaggcatagcaagagttacctttgctccagctcctaagaactcatctccatctgagaccacctcagactggacttcattgtccaaatcactattagcattttggtcaaaaccattcaacatgtctctaggaagttccaaacttttccacaagtttctgtcttcttctgagccctccaaactgttccaaactctacctgttacaaagctgcttcctaagaactcaactccatctgagaccacctctggctggacttcattgtccaaatcactactagcattttggtcaaaaccattcaacatgtctctaggaagttccaaacttttccacatgtttctgtcttcttctgagccctccaaactattccaaactctacctgttacaaagctgcttccacatttttgggtatttctatagcattgccccattacctcagtacctatttattgcactagtttgttctcacactgctatgaagaaatacctgaaagactgggtaatttataaagaaaagaggtttaattgactcacagttacacatggctggggaggctcaggaaacttacaatcatggaagaagcaaaagcaaaatgtccttcttcccaaagcagcaggagagagaagtgccagcaggggaaatgccagatgtttacaaaaccatcagatctcaggagaactcactatcatgagaacagcatgggggaaccgccaccatgatccaatcacttcacactgggtccttcccatgacacatggggattatgggaactacaattcaagataagatttgggtgggagcacagccaagccatatcacctgtcattatggggggaaatagtgtgaacacttttatctggtattatttctttttatattattttatatttactctttgttttactttttttccccttttttctttttcttatttcaggaagatttatcaaggtgtagattttctggttaatttaggagttttaatactcttttcaattttatataaaagcacatatttctgatcctttatatgaagatgacttattttctaccaagatatctatgcccaattacatccacactaataagatggatattttaaaataaatcactcccctacatgtaggttatgtggttttgttatattaaccccagaataccagtatatttattttctattatgtctttccttattcaagatttcttttccttcacttacattactcattttcaaatagtctgtcattacaggagaatctatttctcatcatgtttcctttgttcttcatctgccatatattgatttgtagactttttcttattttttatcatttttaatatcactctctagagcattttgttctaataggttagtaactaataggttactagtggattatttttcctcatattctttacataaattttaaaaaattttgatttttatctcccaaatttattgtttaataatgtttaatacttattgattattaccaattctatctatttgctcccttgggtattttggtgttcctctttgtttagctaaatgctaaattaatttattttcactttttcttatttaataaatcatatgatcagggctctgaactttttcctaagtgaaactttggcagtattcacatctaatcttcaaaatgtttcttgagtttacaatatttgatagaatctgttgctgattcattatggaaaaacatagaatattatgtattttttagtatgacatttttgacaatgattacataaaataagtttatgacctatttactcaatttgatactaaaaaaaatatggaaaacatttgtagaacatcaaaatcacatgcagacattctgaaaaatgctccaagcatcagaaaaagtaatgactgtgtaattgtatcgaaaactctgaggcagagattaacatgcaggaggttattagagagggcttttagggtcttcatctgtagaagatagggaaggagagataattgggcagagggacaatttcagttctggtataatccgaagaaagtttttaactcaacctgtaggaagctttgaagctagaatggctatttaagattgtcaagatttggggaactaagtgactcattggattcaggctgcctcagaaaataaatgtgatactgctctgactaggtgattcttgaagaaaattgcatgcagaaagctgtctaacagcattccttctagtaactagaagaataagtataagccctcagtccatcacaaatagtaatagtttgattagatagtaatgttctatagcatgtttcattctaacgtgctattttgttttaaatatacaaacacatatatatgcatttaattgtactttgtttacattttcagagattagctatgtattttcagtcaacatataatacattatatttttcttatttaaaatatttggacatagtctcttaataattagattataggaagtctaatttttcaggaaaatatttccagtgttaaatttgttatttaacttatattactggttcagatatttagaattttcctcccactattttattgatattctataattttgttttgatttaatttttaacctaaatgacatttgtaaaatatgtttttattaaagagatcaatgttagtgaaaattacttaataattaaattatataagatacttgtattactaatagcaaattacttgcaaaaggccacgaaccagcataatatttcctaatgttgttcttcatagttgcacccattgcctcatgtcaccatcattgtcatagatctctccaaggtctaggacaaagaaaatgattgtgttgctaagaaataaaattgggtttgcattctgttagataattatgctggcctatgttcttctaggcaggaactgtttcatttctctccatactttacacacctagtgttatgagaggaattttgtccaccaccctaaagatcccagtgttgaagctctaacccctagtacctcaaaatgtgactttatttggaaataggactttaaagaggtgattacattaaagtgagaccacaacagttggccctaatccaattggtctttataagaagaggaactttctacaaatacagaccagggcacatgcacagaagggcaatcaggtaaagagccagaaagagggtgaccatctgcaatccaagcagagacttaagaaaaaaataaacctgccatctttgatctcagactgccagcctccagaactgtgaaaaataaatctttgctatttaagccattagtttgtggtattttgttatagcaaccctagcaaactaaggcagctagtatagtaaagagcatacttaggtcattttgagtactttacttccactttaatagttcagccatgaaataaaatatataaatatatgaatcatagataaaacaatgtaaaataaaaaatgataattttaatattattcattaaaatataaataaatattttcatggctttagattttatgtaacatacaccctgatgctgctctagcaattaattaacaatatgacttcatattgttaattaatttcatgccaataatacacaagagcacagacggcgacacttgtattagaccaaaaaaaaaaaaaagtcaaaaactgcaacttgcctcccgtgttcatgtccttgtgtaatctctaccttgaatattgacaggacctgttactggcttttaactaatgagaatatgctacataagattgtaacatccatctcgcgagattaagctcttctctgctggcattgaaaatgcaagctaccatattataagccaccatatgggaaggccatgcagcaggagctgagggtggccatgttcagttgacagcattcaggagctttcacctcaaaggatctcacagttccagtcaatatttttatgcaaggaagagcctaagcaaaggactcaattgatctgtaccggacttcttacccacagaaattcagagatcataaatgtgtgtgtgtgtgtgtgtgtgtgtgtgtgtgtgtgtgtgtgtgtgtgtgttaaccactaaatgcgtggtaatatttttgtgcagcaatagataaatattatgcctatcttcaaacattatatgacatgttttgctaaatattttagctgggtacttatttttcaccatatctacacgaaggctaattttcttctctattctagagaaaattttcttataaacgttatgctcagtgctgccatgttctttatcaatagtatcattatgatttctaatcagccttctgtattctcttgttaactgcatactgacaagtgacaagggtgatcatcagtgatattttggtataaaatctaataaacagattgaaaagcatctctctggatttctttaagcagaatatagtcatgtaaaaattctttagactgttaatgtaatcacatctttaggcatgatttgttgcactctctggctttaaaatatcattgttaagtagataagactattatggccttctcttcacaagtgacatttatattattaatagatacattattatcatctgatatcattcaaagtgcctccatttattttgcaattagctaataattgtctaacgatagttctattaatactaactacatgttatgccactcagctggtgtccatcatagattgcctttggattcacctattcatttgtaggtcttaaatccttcacaatattttaagctctcggaaaagagggctcaagtcttttgaacctcacagtgccaactcctaccacatataagtagatattttacttacatgatcatgtgattcgataattcattaccttcaagaatcttgaagcatttaaggaaatagaaaattcacgtaggtacaggtgaaaggaagaataaactgccttaaaatggacaaaagtagaaaaaatttcaaaagaaaggagcaaagaaaaggtggaaggaagaaaagaaaggagtgagaaatgaaaaaaggatgatatactgaaaaatagaaaatgtaagacaatgtattttaatagttttatacaatgaaatgcttggtgtattaaaattaatgctaaagtagattaactgtgaagaaactgctttactggataattactatgacagatccgatataaagtaattttataattatatgtttaataattttaaagatcacactctgttatttgataattattaatatatctcttctaaactgtaatggttatatgagcaaagaggaagtgagaagagcaggagaacttttaatacttaggataatctttgagtagtcccttcactaagtacatttaattacctccattaagcatacctactgcttgattactagagcagattattttttccaactgaaatattaaaaaaatggacatgagtctcagattttcagtcaggatatgtaattatactgataggaagggtaaaggtgatttattttcatatttaaattagacaagccactcaaccaaaattaatagttaataaggaattcaaccaggtcacattatcaaaaagtacaatattagttttttatattatttaaaaacaggaaaaattaaaatgccataagttaattgacaaatgggtttagaaaggaaaataagctcatataatacatcttgaaatgtggacaatggaacacaggcatgctacatttcccaagtatttaagttattacacataagcaaatgcactcaggaattttacatcattttgaatcttcagaattacagaagggtagcatgcctttgtagagaagggtggtttttatttcaggtaacattctatcagcattaccactgacaggttagtattgcctgcactttatctagattaagccttaacataactctttcatcaaagctactacactgacatgtaggtgactgattctaatggaattagatgaaaagaagacaaagaaagggctgtcgtgcccacaccaagagctttgccacccaacatgtaccattatttcctttaaagctttcaaatttgactttgaacaggtttcaccaaatacaacactgaagcaattgctattactgatcatgccagagggattagtagaattttctcctgaattatttctttccaaagggggagtttgtagattaaatgagtcttggaaacgtttgctgaaatgtatagattcattttatgactagctttctagtcactgtcttgtgggttattaaccctataaaatgaatattttgattaactgtcctcatttttaaaacatttgacatgaattgttcttggaaattttagtgacagcactcaatatgatttcctcagttatttattcaacagaaagttgtctattatgtaaaaagcattgcagtgtagataaaaattaagcaagtcaaagcattgactaagtaattacattgtgtttggagacatgttagcagtttgactctgctaaagctttggctgaatatgtccaaaggcaggaaatgccactagaaagtttccagattataaagatccttgcataacatgccaaggcatttaataaacagtgagaatacctttatatatttttaacagaagagtaacaaggaagatctgtatttcagaaaatcagccaagcttcagtctgtagattttaattgctttaacttttaacttcttttcaaagagaattaacacaagctaagttggtgacagcagcaatggtgaagggaggaaggagagataatagaaatagtcaagaaatataattaatgagacctagtgcctaattagatttgattgcataagaggaggagaaagtaaaaatagtaataagactgcttcagagactcccttggaattatagtgtattccagcaacaattaaatcctaaaaagacccagagtacttttcattcaattcctatgctgtccaatttctgggactgacagctgtcaaaattttggctcctttaaccatatcccgtattcttgtagtcttagatctttggcccagatatatgactataaattatatatcctctcatattgttcctgttcccatattttctggacttcctctttccaagtccaacttccttcagttccctttcctcctaaaatttcccactgtgctctctcagaactatattcctcagttaacaaatttgaccatataatcattgctgaatatttcaattaaattttggctgttcctgagaacaaattatcttactgctaccctctcaatttaagggaaatttcctccacattcctcagtcattaggactgtgacatgaggatggcattccacatactctactcataattatccagaccatttccctctgatattatccaaaatacccttgctctttggtacttaaacttagtcacacacacctttttattcctttctacatcatctaccaacatcttcatcagtctttccctggcctcccattctttgcttctgcttctcagtttctcatcaaagataatggaaaaatctacttggattatccctctgacaaattggcatcccagtcccttaacttaaactctagtgacattttcatctattctattttagccactcaattctaaaacaaaaaataatgaccttattcttctctagaactgctcaacctctacaaactcctacatctgttatttgactcagttctcaattttcttagcaagttactcttttaagtgttttgacttcattgactccttaaaatatctccattagagtgtcgatttcttagtttttctttaatagcacctattctattgaaatattttctattatgggtttaaatgatcttgggaaatgttaactcaactaataggcctctgtgattacgtaatctacaccactattaaaataattataacaacttggatcatacaatgtcttgatgtaaacgatacattaggtcatgttatggaaatgtttactagccattgaatattttaatcttatttagaatctctaatcaaatctatagagtttaattatttcccagatttttctatttctatacttacctaccactgacattattcttatctctgaattttaacctaagttatttgacaaggtagttaattattgcctactcagtcatagaaatcaaaattcaaacataaaaagatatttgttgtaagttttactgttcttgagatcagagaagctattacaattaatagcataaaaattactagaaaagtagaatttttagataaaagaaaaatttagttctctaaactagtctgggttagaaaaatgcatgaaaattatatagtcatgtaatttcttaaaatattatatctattttgagcaaaatatctgaaagttttctttaagaattcctttttgtttctattataaattatttaggaaaaggttatatttttatgacaggttttttccccccatattataactttaacatgttttctttgatataaaaatataaatcaagtaccattatatttatatgtcattaaggtactgttcttgagcctatatcatgtatagcgtattgtgcattattttttctggcaaccataatctagaaatgggctatagaatgaaattcattaatgctatgttatactagaaggcacagaacataaagtaaataaatcttttgtaatatcataccaaccttataaattgctttaagggaataacaatctataggggtggtagatgattttctaatcagatattacacaatatacatcaaatattctcattctgtagtatttaaaataagcagttgtctacaacatacaatcaccagtcacaataaactattcatgcttttgtagacccccaatttgataactgcataaaacaaccaaatattttagaagaagaaatattataaggaatgtatatccaagcttctgtggttcgaccaggagctattgcctgaactacacctccttagttggactgaacaattatggaatgtgtcaaaataggcctaataatttatctcaaaaattaattaataatcaatgataaagctaaagagttttaaaattaatgcccagtaacattcttttacaatgtgaaacaaatgtaattcttatgtcatagtcatattcttagatgccatgtcttggctcactagtgttttaggccctttgcaaagaaatatgtttgtgttgataacagaaagtcaacatttgtagataatttcctttttaaaattagttgactaaacttgtcttagtttagttcaaatatgctttatttggtggcagagaaaaaggacagggtttaaaaacaaggaaattattcataacctgggtatctctaaatgaaagtattgtaatttcaaagacatatgtttcaaaattttattccagttaaaataaaactgtattatggtaagtcctatttaaaattgtaattttatttcagcacaaaagatatacacccatagataatgcaacactttctgcctttatgaatttgcactgcggaatcatttctaatagaaacaattccaaactattccaaaaatgcaagttctatgaagcattctgagtcccaaccaagcatgcaaccaacaaacttttagcattgcactgagagggtttttttaaatattgctatttttttgtttgtatttttaatagtgagaacatgccacaatattcctggaaaaattctgagcttcccttcttatcttgctcttttgggatctgtcttttatgttggaaatctgtctaaaacaacacataatttttgcccctctattcaagtttaagtataacagattaagaagccaattggaagaactctacatctgggcacaatgcattaattattgagatccattatagatagcttgtatagccaatattcttattacatgtgaacttctactggccaactctgtagaccccttctggttctatcatccagtgacctggcagtgggcattctaaacgttaatgtagaaagagtgctctaggtatgtcatactacctaatacttccgttttatctcctttgtgtttgcatttaataggccaatgacattttggcttaatttttgtatctattgtcttttatatgggtcagggagggacatcttttagactgtacaaagtcaggaggcccacagaatttaaatgtttttttgagcacacgttcaaaatagctcttcgttttcagttaccagtaacctctatcaattaccaagcttttcctgagttttcccagataagtcaaattacttcccattaatatctacttccgtaggttcttaattctgacctctctcagcactgctaagtcacttaacaactctccatctactctatactcactcatattaagttttggtattgtagatatcctggttttgtcaaagacagaattgtgtttcttttccttactttgtagctttgaaagaaaaaatggtgtaaatgtcattactccactatcatgaaatttgaaacaattagaaataacagttggagagagagaagagagggatgtaagtgtcattactgcataattttgaaatgaacaattagaaatgagagtaacgaagagtcaaagttttaacttcaaggtgattgatgggacatgggaaatgagttacaatgggacgtctagaatatttcccaccactgttaatatttctgccacaatttgattttttgtgccaaaatttttctcatatttgttgctctatatgtttttaaaaatcagtacagcgttttttttgtttgttttcttttgttttttaacctcagcatttatgaaagctaactatggtctactggatgtaaaatttggagagctgggtttgagttccaaggttgttattctctggtcatgtaactttcagtttttaacttttcctttctttatctcagttccagattactggtataggaaatgtattagagagacatttttaaatgtcctctctaaaatagtgactgttttgaatactttgcatattgtttttaattcttcatgaaacctttaatgtaactgctatattctattggttttgaccaaattatctgagacataacttacccaaggccataaagctatacaattatagatgaatatactgataaccttcaaattttcaaagttgggggcacttatcttttgtttgactacttggcattgttggcaaccaccccattgaattttatggccctaattcttggccatttcttctccacactttttgtagatgtctctgatgtttatccttatatttcaatattttccaagctctttactcagcctttcgttcatcccacgttaaagatggcatttgaataaattttttattttcccttaaaaattatatttccttaaaaattctagccaagaattctctgatatgcacaagatttgtatatgtaaattccatatacctgtggatatcacgagaaattcaaaccaaatgtctctataattatatttattatattttcccccaaaactacctatcctgttcctggttcccaatttactatttactgacatctgaggcctcaatttttggtctcattcatctatttatattcttatatctccctaccttctatctcttctcatctacactctttttctacatctacactgatttttctaagccacaaagttttcatggtataacctacttaaaatctatgtcttgacacaaattttggtgtatattttatactctttagattatcatgtaagtcttttcattttatcttcagtaagcaataaggagttggctactgcttaactttctggtcacttcctatgattcccccagtatacttgttaatctgtctaaagatattgttttactgtctaaatgtttcctgatccatttttctgccagcatgtaagtttctttctatgtgatattgctattattcatcttttaaaattcagctcaaatgtcatccatttcaggaagatttcccttaaatctcctctctactttccatggctcttttttgatattcccataggataatgtacaagcctctctcagagcatgagcctgaatttattgcaaaattatgcatttttgccttgcccatttcctccaattttatttatagaatcttcaatgctatgtttatagattcacttatagtctcagaataattcttatcatataataaacatacagtaagaaaatttcaaagaaagaaaaacaaaaggaaagataaagcatttgattcattgtctttctattaccaaattctaaattgtttccccttcacaatgctgccttacttatctcaaagagatgttctgacactgacaaaatttatgtgaaagcattttacaaatacagaactatattcatttacaaacaactaataagaatatgtattgtgaagcaatatgtagtaacagaaaaacttgaaatacttggaagtaaaagaatagagatcaaatctcagtatcctttatttatgcctgagtatacttgccaacaaaattaggtcaaacattctaaaatccagatggtttctgtataaattgaaatatttttagtttccccgcctcctcacatggtccataacctcaagtaatctatgtgaaaatttggttaaatagcaaagcattctacaaatataaggtcttacttatggttaactattaaacatctgaaacaggcaaaccattgcaaggaatacacagttacagaaaaaagtagtgtgttttaatggaaagagcatggactttggagtctggcaaactaaattctacttcagccagttaccaagtgtatttgactacaacacttggtctttaatctcagtttctccatgtataaatggagataacaccagttctgtccatttctcaggattctatgagacaagtgacataatccatgggtcagcttttgaaagcaatgattctgaatgcagataaaataaaatattgttattttcttgagcttgaaatacaagaaataattagaatgcgtgagatagagaggaaaatcctcggtaacactacctgacaatgagcagttctaagtttttattttattttgggaaggtaattctcaattcacatcagtcatcagctttaggcctgtgactgtaagtctacattttgatattttaatattagacacatatagtacattacatacaacaaaaagaatataatgttataaatttccatttttcaattaactaattctgattaccactttatggctattttattttattttatttttttggctactttaaaactattacataaatatatttccatgtcctgatagtttttcttatattattaagaaaaacagtcctgataatcctgataatttttcttatattattctcattggtgtttaggtgctctgtgccctaaaactaaaaattaaaatgagacatttctttttgaggacaagccaggacttgaaaatgttttgttttgtgacaatctccatcatccttggcctatccagtgaaaatcacacgtgacttctcttgtcactgcaacaaggcctcctgttctgtttgtgtgtgtgtgtgtgtgtgtgtgtctgtgtgttcccaaccaaacacatatttttcatgctcttgtttttttccaaaatacattcatgttatcagaaatctaatcccttcagtactaaattgccaaaatttaggggtcaggagtctgtgtcactgcagaaataatttgtggttctaaagttctcatagccatgtcccaaatctgattttcaaaatctctttatgcacctcttgagttctccattattttagagctttttcaaatgtttatttactttttaggtaactttaactacttttattctctcctatgtattttaaaattcattttcataacagatacaaaactttagttttgaaaacacagttcgtaaggtttaagaaaatttccatccaacataacatgttgtaactataaaagagagttaaaatagagctgaattaccattttttcaaagattaaagactctagaatgaaattaaacactgcattaaaattgtccatatgtttcttacatgaaatatgttaaaatttaattttcttgttttacaattctaaaattggaaatgtctttgtcactcttaaagaaggacattctgggccagtgtactagatcaatggtgaggggacgagcgggtgggtaaagaagtgagtgtaaaaggcatgtctttattgacaaagaaggattgccaatatagttattctacttcaggtatgtagagcaaggataaagcatatgggccaaagctcatccgattcctgcttttatattatccatgaattaaaaattatttttacatttttttaactattgaagaaaaattgaaaagtagaataatatttctgacacatgaaagctatataaagttcaaatgacatggtccacaaattttcattgaaacccagccaggctcatttgtttatgcattgtccatgacagttttcacactataatggcaaatttgaatagttgtggtagataccagatggctccaaagcttaaggtatcaattagctggcactctgcacaagtttgcctggttcttatcagatgcatccctgagactaaaacaagtgttttctccatttccccatattattataatacagacagcagcccctcctgactctagcttaatcatacatgagcagataactgaggaaaaatgaatattacaatattaactgaaataattgtgagttgtttttaaaaaagattctcaggggaaaaagtatacatttatacatttgtaaactgcatatttgcaagactacaatcatttaaatatgttaactttgttttatggcttggagtatgatatatttcggcaaatgttcacatgcacttggaaatcatgcgtatgttatataaattaatttaggtcaagttatttaaatgtgttgttccggccttctgtatttttaatgattttcaggtctattgatctattgattgctaagagaagactgcttaattctacgattatacttttactgcatttgttatttttttcctttcagtttcattactgtacactttccttttcttactatatgctttccattttctctgcttctttttttatcacctctcttgacttctgatttatgaaatattgttttatcattacacatttatgtgaatgtagacagatctagatctatctatctttattatcttgaaacatatatactatttacactgttttagaaaatctgtattagatctctagggctgtcataacaaaacattacaaactgggtggctaagcaacagaaatcaattgcctcatagttccagagaccaaggtgccagcgatgttggttacttcggagtgctgtgaaaaagagtcggtttcacggttctcctagcttctggtgatttgctggcaatattcatcactcattgaattctcgatgtacaaccccagtctctgccttcatcttcataatgtgttctgtcttgtgtgcttgtatctgtgttccccttcttataaggacaccactcatttcaattaggggccaccataatgatctcattttaacttaattagtgctatgaagattgtgcttccaaataaggccaaattcttaggcaatggggtttaggaattgaacatataactttaggggtacacggttaaacctataacagtagctatcctagtatacacaaaacaaaatgcttggcaaataaattctaacattaattggtactttttttttctaacacagttcatgcaagtatgtcaaaataccataactccattaagctaactcttgacaaatgatgtttttgtaaatgtttatctatattttaaatctcacaggggttattttttatcccttagctttgcatatatttaagttttctttgttttttttttttaatttatttgcacatcttcaagctttcatctcaaattatctcctgtttgctcaaacaatatactttaaattttattttagagtgtgtctacttgtaataaattcagaaaatatatcatatggttatccttgaaagatatttttcttaaaacagaatcctatttttcagaaatcttctgtgacatattcaaaatattttatcatcttatgaattccatttcttcatatgaaaaattagttgcatttcttacttttattcattaacagttcactttttctctttttaccctttggcttcttgtgagattttatttccaagacctaccaaaagaaaatcctcagctacattatacttaatggtgaaagactgaagttctccccagaaagattaggaacagaccacaacattgtactgaatattttttccagggatattagggaaaaaaaagtaagacaacttatttggaaagggacattaaaactatctctatggcatatgacacaattttccatatagaaaattctaaggaatagacacacacacattcacacacaaacttagaaccaagagtgggtttagcaggttcacaggatgaataatcaatacatgaaaatcaataatatttctgtacacatgcaataaacaatccctaaatgaaatcaagtcccattagcaacatcttcaaaaataataaaggctaatatttataatggtaaaataaatataatcaaaagtaatataagagctatatactgtaaactacaaacttcactgaaaaaagttaaagaagatctaaacaaatggaatgatgtcccgtgttcatgaattggaaaattcattattaaggtggcaaaaattcccaaattattctatagtctcaaagtaagccctactgaaatccaagctgattttttttagacattaacaagctgatttgaaaatgtttgcagctatgacagagtcacaaaatcgtccaaataatcttgaaatagatgatcaaatttggaagacttgcactttgtatttttaaaacttaccacaagaaacactaataaagacaatctttactaacataaatgtagttataaaagatccatgatggaattgtgaatccagttatatttcctcacatttatggtcaagtaatttttaacaaggatgctaagatgattcaataagcatagaatatccttttggtattattttgtttatccacatacaaaatactaaagttggacccttatctcacattatacaaaacaaattactacaaatggaccaaatagttaaatataagagctaaacctataaaacttttagaagcaaatctatgaatacaccttcatgaccttggattaagcaatagttttttacatataacaaaatcataagtgacaaaaaatattaacatattttatgtttcaaaggacaccatcagaaaagtgtaaagacaacccatagaatggtagaaaatatttccaaattatatcttataaggaaccactaattcagtatatagaatgaactcataagataacaataaaaaggcaactgtctcaattaaaagtggacaaggaatttgaagatacagttcttccaaagaaatacataatataaacagtcaataagttcaaaaatatatgatcactatcattagctgttagagaaaatgcaaaacaaaaccataacgaaataccccttcacacccactaggatgacaacaattaaaaaaagatgtaacaactgttggtaaaatgtggagaaatggaaccttgcatataccattggtgggaaggtaaaatggtaatgcactttggaacacactttggcagtccttcacaatgtttaacatagaggtatcatacagcatagcaattttatcctaagaaaaatgacaacatatacccacacaaaaatatgtacatgtatgatgatagcccaaatgtatcaactgatgaatgaataaacaaatgtggtagatgcatacaagggaatatatccaacagttattttaaaagatgaatggattgtggatataggctacaacattaattaaccttgaaagtattatgttctggaattaaatagtggcaaggattgcacaactttgtgagttttctataaatgggtatattgtacacttttaaaaagtgaatttttatggtatgtgaattatgtctaaaaatacttttaaattaaagatcactttctctttggttttctgcaattttgctatgaaatgcccaggggactatataggtacatggatacacagatatatagatggattaaaagatagaaggataggaataaagatagataatttcaatcttgctcctgccttatagaacttctggaaactgacttgagagtacctgtttggggcaactattgattattatatctccgaatattgcttctgtgacattctttatcactgtgtcttttgggattccaagtgcctgtattttataccttcttcttttatgctctaacttgatctattttatatattttccaactgttcagttgcttgaggttcatttggtataattatcaattcccataccttcctttttagctgtgtttttttggtgttatgtttctatattttgtttgtgatttgtttattgctttgtttcgattttagaattttcacttgatatttttacagcttgtcaatcttaccatttcttcttgaacagagagaacagttattttaaagtctacctcaaatgcttgcagcccttggggactgctgtattctctatttttttctactagtttttgttcaaattgtcctttttccttaaatctatggttatttctcaatctgttagtgacatgacattttttaagttgctgatggaaagcatgtgaggcagggaatgaaattatcttttcttatataaaaagtaaatatttttacatttggcaggcctggaagttcagtagcagtccagtaccaccaaaatctaattgcaaaaaataagatggcttgaaatggtcctgtagttcatgagtcttagtcgatttagggctgccataacagaataccataagctggtggcttacaaataatagaaatttatttctatttcattctggaaattgagacttccaagatcaaggcaccagcagactcaaggtgtggtataggcctccttcctatctcttcactgtctcttccctgtaacatcaaatgacagaagaggcaagctatctctcttgggtctgttttgtaaggacactaatcctattcatgagggctacactctcatgacctaatattgccttaaaggctccacccaccctccaataccatcatcttgggggttaggatttcaacacagaaatgtagagggtacacaaacattcaggtcatagtaccatgtaaggatatatttatgttcaagtcattcttccttttaaattgtggccactttgaggttttcaacttctttcaagacgggattttactaggcaaactttttaaaattttgtaccagatagaaaatatcccctctcttcctcaattttttaaagctattgagtttttaatctcacaagcaactttttcaaaattggccaaagagatcatggctgatatctctggatatccatcttcttacattgctttggtgaaaattacaaccattttacctttaccatgttttaagacatatcaaaacaattgttcagcatttttaattgttctaagcaggaaaagtgatctatgagaaatcattccctattcctgaacatttactttatgtactaatgtacttgtattgttatgtgactgagtccaagaagaaaggtttttgggataattcatatatatgttttcaattattttccataatgaatctgttttcatgtagagaaaaatgtattctattatttttaactagttgattatctttcatgaaattagattggaaaaggccaagagctgagttggtgcactatattagtaccacagggaatacccaatgtccacataaatcacacctaagctgtacataattgtgcaagataacacaagcaaatatgataatttgtggcattgataaatagtttgcataaatatttaattgctatatctaaaatgtttaaaaataaaaatacaaatatatgtattacgttctatttttaaatgtttacattttaattagagatatcagaaaacacagtataacctctaatttccttggatattccattttccagataaagccaaaataaatcagccaatacaacacatgctttttcaattatggtactttttacaagagttaaaacaattatttaaatgtaaaaaattaaacataagactgtgtggaaacttttaaaggcaaaatttttttttgggtgagagcaagtctatatatactgacttctacctaactacagtatccaaacttatgctaaataaattattttacattctataatgatcctcaaattttgagtgcacttacactcttctttctaatatatgtaagtcttttaaggatgttttactaaattgttacactaaacagttggaacaacttcctttggtactatacacattgagaagagattcaatgaaacacactaagctctagcactgaaaacaaaaattttaatgtgtattgccttgaattgtatgcaataaaacagaagagaataagcacagattattgtagtgcaatcttctaaaaatgggaaacttactttcacctgcaagaactatttttgtgataaggtaatgatggtgctataaaataattatagggacactttcctgagtgagtcaatttagagaacagctaaataagtcaattaccaaagaaccccatggtgaagatgttggatttttacaggttttagaacacacatacacacatacaaatacagatgcacacacgcgcgcgtgcacgcacacacacacacacacagagagaggagagaaagaaagaacccattgaatgatagaaaagaacatccctgaaatgaaaggtacatggagttttttgtcatatagaaaaaagaggttgattttaaaatgaactgacatttttgaggcgaatatattatactataaaccattttcttgaccacaaaaagacgtactaaagtgggaatgaaaatgaaagcatggccaaatgatctagctctgttgacatcctatgagtctaagtggtgatctaaatttcaaagaatttattacaatttctggaaataggccagttttctgccaacttaaaaggtcagaaaataactactaaacttattggtacaaggtttccaaaatgtctaagccaaaaatggtttcaatagcataaatactaaaagtagcttatttcatcttatttaaatattattaaaatacttgaaacctgaggaagcacagttacattttaatacatcagccaaatactatggcattaagaattgaattactactaaggatcaaggaaatagaaatcaatgacatctaagatgaaaaattaacaacaaaaatcatcataaattttctcacttatttttaaagttatttagaaatctttgaatatccaataacaaaaatgagaaatttgtaagacacaataagattctccaaatgataacagttttcaccacatttttctcaataattttatattttaagtggcaactctctcccttgacttatgaaaccgtcaactactttctctcctccaggcaactccaacagacaatgaataatttactcataattctaattaaaaactgaatagaagctgcacagcctgtgtaagttataaggcagtgtactaattatctgttacttgaattttaaatagttataggcagctttaggaaagcatgtatagaattagcaatccaaaccaaaccagtttcctgaaaacactgttgagatattactgatttcctaattattgggtcttacatgccttctaattacccttacaatttatatcctttctttttccatgaaaatacataaactatagtcatctactatgaacaggtaacacattaaataatccccatgatatccatgcaagacaatgattcttgtattaattgctgatcttcttcagaggctaaacctttacttaacttttcaatgcttacatttcaacttttatgtcacaaagtccagtatgctattcatacttatgaagttaaacagaaacaaagaatttcaaatgtaagacccaaaatgccagatgcatatttgtgtatatgtggtaaaacccaacactgaagtatatttctttagttgtgcgaggtcgtttctggtgctaaaatggaactggtgatgacaacagttcacaccaagaaaaaacaatcaaaactctgccacccaccctaccaagcaaacactgctcacaggatcatttgacctcatttttatatgcattgttcattctacaggaaagataaagctggcaaattccaccagaggaaggtaaactattttttaaaatgtttcttgacactgtaattctatacatgactgaaagtatttttaaggactgagaagaaagttattcaatataatttttgttgtattttatttaattaaaaacagttgttttaacttacttttaattttaccaagtattatataccatgaatattatgagttaacagaattttattaatttagaaagtagccaatagtgccatgttaggaaaatatatgatcatggaaatttcccagaactccaaatgtttagtttaactttggcataaattttagaggaagaacaaatagtaaactgaatttaagcagggtctccctcttatagagaactgcaatactcattgaattattccttaatatcacaattaagttgataatttatttttatgaaagtttgtacttttgattaaaataatcataggataaatcagtctatgatttcatagaaggtaaactgagttacagaaaatctttgtctagccttagccttttaagtatattagtaccttggaaatcctacttgaaagtcagctgatatggaaaatatgcccatgcaaacatcatctaaatttctttctcaagtgaaattttgacaaaggggcatacatacaccaataagaatgctgacaaatagcatatgcaggttcccaaagcctatgatattggccattctgcttcctgaagagggaaagataaattcaaagaatatatttacctatttatgtttaatttattgaatatagatgctgttactgtttttcttaaatgtaaaacatgtaccaaatttatattaaaaattcattattttatatttctaatatggcaatcagctattcaagtagaaaacaggaaggaggatacagctgaacagttcataaggacataaaacagatttgtattttgttaacagtttccaattttggtccttgcaaacttgtttaggaaaaatgagagaacactttgataacatggtcttgagaggtctatattaatatcacgtcaaataatacttattgagagtatttttatgttgatcttagataagagaatagtatcttgagctctgtaattaaaacatagaagacatagtatgcttgacatgtattatcagaacatgaaggaacccagtgtggtcaagggatcaaatttgtgttgcactggtttggaaagcaatatgagccctaaagcctggaaatttaaaaaaaaaaaaacttagagccttatataagaaacatgaattttaattgaaattctctactttagaatgtacagctttatcaagaagataataaagaagagattaattagcttgtctggattctggcagcagattccatcatgttggcctaagagttgcaatggataaccttatcccatcttaaattacggtggtgctgtgatagccttacatttgttatgctataaaaaatattaaacttcagtggtttttcatgtctgtagttcttttggaacatgcttcccgaaaatgatgatggtttatagatcacgttctgtagaactgtaaaatatttagcaggagtgaatgagacagaacttcttgctacttcactgtaaatctactaacctctctaaaatatgaatcagaagaataaaatataaatcaaaatagaacgggggactcaccaagtattacaaaaaataatatgtattatcaaacaccaataaattttccctgacatctaatgttggtcttacatttattaaaaaatgtaacctttgaagtacaactttacatgaaaacctattttaaggaatcataaagagaaggcaatgatgggattatataacaatttttcatttccatatgagaatataaattattaagcttatcatttttctttttattttagtaacaaagacattactgaatgttgccaacagatttaacattggcaaatcatctgacatacagcttaatctcctatgatacaatatatgaatatatagatgtaattctgttgtatgaacaaaattgttatagcacattctggaattgattaccttgaaactaaagtaatagattagagttacttgaaatttagttgcatagtaaggctaaatcttaaataaatatgctacaattacattgacagaataaaagatttttactaaaatttcatacatagccttaagtgtatgcttgagtaatcacaacgtatatatagcttttttcttaaagataacataaggactctgacttcataaagattgaataaaatgagaaataggacacaccaacccacatgatacaaaataataaaagctacaagaaaaaaatgctataacagggacacagtttgggaaatttttaaagcaaacttcacccacaaacccaacagatggtaaatctacatctgtttacacagcttataatgaccactttcttatgtagaaaaaaggctgtgaaagagaacataattttatataaagcacactccacattacatttatatggctgtaaatatggcctagaactttccattgctcatcattgtccacaaatatttctcactcttttccattaaactaagcacaagatacatcagttgatagcactgatttctaaatacaaatttcaaaaatatttgtaatttctctgtccacctttgaaaaaggaaattgccattagactttaacattctacaaattccaaaactctttatgaccagaatagagtccccaacatttgcttaagccaatcactgatgatttatgataatttaaagtcaattgatatgtcaacagtagttggaaaaagtttgtgaataataccaagaacaaaatgtcttaaaagattttagaagataattcgatcttctaaagtttcatctgacaatgaattttaaaaccagaaaaaaatagctgacattcatgttagcaagcattttttattccacattctctatgcttgactgatccataaattgttgcaaatcatctaagtgaagcactaaatataaaaagatgagcactggaaattttcataagaaattacatttgtatgtattataatatgataatacatatcacatttaactcatattgcaactaaatattaacagaaattttggcagctgttaaaaagttcaaatattcactcatgtaaaaatatgacatctatttttttcttaaactaagattattttttgttcatggatacagatacaaataacctctctctaaagtcactccttatatagtatcattcatttcacaaaagccagcctgaacatgtcacacactgaaattcaaaaggttttaatgaaaaagtctcttttattttttgaaacagtaccattgggatatctgaaaagggtaatacagttagagagactgtgaaaatggttctatcacaaacaaaaatagtaggtcaagaaaaggaaaggatgttttaaggtaagataatatcattcattgaatttggatctactgagtttgaagcattgatagaatgttcaactggaaacagttttcagacatttggaatataatagtaaggcaagcacaggagatgtgcttaagctatagtaaaaacttttagatactataccagtcatagttaaagttacaaactatgcaggatatccaaggtaaataatgaagacagagaagcacaagaaaagattatttgagcaaagcatatcatttgagtggtatgagaaagaagagataaggaaaccttactggaataagtggtgctctcaaaaaaattaaaatgaagaaaaataaagaacaagaaaagagtgttgtttgtggtcataagtgaccagacaggaaattattcataaagcatttctcactggttttataaatgagtaacaaatatgaataaacaggtataagatcctgaagtgtaagtttatatatgaaggtgaagattttaacaagtggacttgagatcatggatcatgatgaaataatatcaataatggtgaatgacactgagtcaaaagttttgtgtgataaaatattctaatttaataaaatcaacaaacaactgactcaatgaatatacaagaaccataacctttgtagaacttactaatttacacacaaggcataggtatgcttagttagttgtgcttgttaccaaaatgccaatgagatgtttattttcccccaaatctttactgcattatcattaacaaataaaaattgcatatatttcatatatgctttgatgttttgatatatgtaatacattgtggaataattgccacaatcaagataattaacattcttcacctcacataattaagtgtgtgtttgtatgtgtgtgtgtgagagagagcacttatgatctattttcttaggacattttaaatccacaatacagaattgttaactatattctcattgctgtacattagattttcagaaattattcctcttacataactaaaactttttatcccttgaccaagatcttgccatttcctgatcctctcagcttctgggaactaaaattctactcttcatcagttgtccttgttatgcatagctaaatgtatacttaaaaccaacattgtaaagcaatgtagaagtcaggaaggagctctggtccctgtatgttgacttcccagacgaaaattagaaattgacacagaaatagcaagataatttagtgaatagtaaagattcacaacacaaaacttaggttataattttacttttatataatgacattttatttaaaaaaaactataacaatagtaaactatattgaaataataactttctatatacttttcacttaaatcaaaggccttacttgtctatatcaacttccattcttcatccacataaaatcctgggatttaagtttctccaccacttaaagtctatgtgaaaagtgaggaagtattttcaacaatccaaatttcagttccttgtctataaattagagatagtaatgtctatgcaaagattttaagaattaaatgattatataattttgcaattatttttttaaaatttgaaagcttacctaaatggtgggtaacatcatttgaaattatttgcattaagttgcagtaaaatacatgctaattataaataactagaacatgttaattttaagaaaattaaaatccttcataattgtgaaataatggaatttttaggtatatgtttttcatatgtcagttcatatcattatcatatacctttgtattctggtttttaacttagcactatgataatttaagtgttttccaaatcattacttattttaaaaagtgtcttaatgcctgtataaacataacattaatttgtgagtgtttcaattaactaagggaatttgtaatttttaacttagcattttgagtactttcagaattttttataaacaagactatattcaaaaatctttgctggcaactaatttgtctgccaagatttcattagaaaaaaatgtcaagaagtaatttagccaggttaaaaagcaatcacatttcaaagactttgatgtaaattatcaaattggccactagaaataatttgcgattattcatccatttgcaatttgaggaatagttcatggcatataccctccgaaataaaatgggcattatgttaatatctttctaatgtgttagaataaatattctattttattattatattaatttgccaattaagtgtttgtcatagcagttgagtcttttactatatttcaggattgtttgtagtttgtaaacacgtttagctatacgattatgctatatatattcttttgtatctgtctttttttagcaagtttgttctctttccaattcagtatctgtgtatgtgcatataggtacatataccctcacatatacatacataattattttaagtctgaattgcattcagagatggctttaaccagtttctctaaatggacaaatgaacaatttttttttcatgttggcaaattttatacataatctacatagatcactgtctttttttgttaatgatataattatttggagtcatttccatgaagagtaattagtgagtttaaaacatgtacctatgttacttgatgttactcattgtaaaaatgccttccagagacgttttagcaatgtatagcaccagcaacaatgcatcatgtatgagaatgattttttttctccacagatcattcccagaattagatttcagtttgttagtccctttcacttttgtggggcactaaggagttaaaataaaattgacaaataggtttagcttgcagaaacagacaaatgggtaggtgggagtgaatgttccaagaaatggggtcaactgcaaacagcttactggcaccccccgagtatcctgccacaggccctgagctcaccagctcacatgcacccaagcatcttgtctgtaagcattcagactaagcagcatgaccttataaaatttccctctagctcctgcctctttgcagacagcagagagccttctttttactatcttgcctgttgctcccttgcaacgtactgttcccttttctctaataaatctgtctttctaaacttgttactgtcttgggtaaattcctttactacccaggcgccagcctctgacagttgaccatgacaactttgtctaattttgactgaagtaaagagaatggggggtggagacaagatggacgaataggaacagcttcagacgaagaaggccattacataatggtaaagggatcaattcaacaagaagagctaactatcctaaatatatatgcacccaatacaggagcacccagattcataaagcaagtcctgagtgacctacaaagagacttagactcccacacattaatagtgggagactttaacaccccactgtcaacattagacagatcaaagagacagaaagttaacaaggatatccaggaattgaactcagctctgcaccaagcagacataatagacatctacagaactctccacccgaaatcaacagaatatacattcttctcagcaccacaccacacctattccaaaattgaccgtatagttggaagtaaagcactcctcagcaaatgtaaaagaacagaaattataacaaactgtctctcagaccacagtgcaatcaaactagaactcaggattaacaaactcactcaaaaccgctcaactacatggaaactgaacaacctgctcctgaatgactactgggtacataacaaaatgaaggcagaaataaagatgtcctttgaaaccaatgagaacaaagacacaacataccagaatctctgggacacattcaaagcaatgtgtagagggaaatttatagcactaaatgcccgcaagagaaagcaggaaagatctaaaattgacaccctaacatcacaactaaaagaactagagaagcaagagcaaacaccttcaaaagctagcagaaggcaagaaataactaagatcatagcagaactgaaggaaatagagacacaaaaaaaaacccttaaaaaaatcaatgaatccaggagctggttttttgaaaagatcaacaaaattgatagacctctagcaagactaataaagaagagagaagaatcaaatagatgtaataaaaaatgataaaggggataccaccaccaatcccacagaaatacaaactaccatcagagaatactataaacacctctgcgcaaataaactagaaaatctagaagaaatggataaattcctcgacacatacatcctctcaagactaaaccaggaagaagttgaatctctgaatagactgataacaggctctgaaattgaggcaataacagcttagcaaccaaaaaaagtccaggaccagatggattcacagccgaattctaccagaggtacaaggaggagctgttaccattccttctgaaactattccaatcattagaaaaagagggaatcctccctaactcattttatgaggccagtatcatcctgataccaaagcctggcagagacacaacataaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccgtatgattatctcaatagatgcataaaaggcctttgacaaaattcaacaaccttcatgctaaaaaatctcaataaactacgtattgatgggacgtatctcaaaataataagagctatctacgacaaacccacagccaatatcatactgaatgggcaaaaactggaagcattccctttgaaaacgggcacaagacagggctgccctctctcaccactcctattcaacatactgttggaagttctggccagggaagtcaggcaggagaaggaaataaagggtattcaattaggaaaagagaaagtcaaattgtccctgtttgcagatgacatgattgtatatctagaaaaccccatggtctcagcccaaagtctccttaagctgataaacaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaagatacaaacaagtggaagaacattctatgctcatgggtaggaagaatcaatatcgtgaaaatggccatactgaccaaggtaatttatagatacaatgccatccccatcaagctaccaatgactttcttcacagaattggaaaaaactgctttaaagttcatatggaaccaaaaaagagcctgcattgccaagtcaatcctaagccaaaagaacaaagctggaggcatcaccctacctgacttcaaactatactacaaggctacagtaaccaaaacagcatggtactggtaccaaaacagagatatagaccaatggaacagaacagagccctcataaataatgctgcatatctacaaccatgtgatctttgacaaacctgagaaaaacaagcaatggggaaaggattccctatttaataaatggtgccgggaaaactggctagccatatgtagaaagctgaaactggatcccttccttacacctcatacaaaaattaattcaagatgtattagagacttaaatgttagacctgaaaccataaaaaccctagaagaaaacctaggcagtaccattcaggacataggcatcggcaaggacttcatgtccaaaacaccaaaagcaatggcaacaaaagccaaaattgacaaatgggatctaattaaactaaggagcttctgcacagcaaaagaaactaccatcagagtgaacaggcaacctacagagtgggagaaaatttttgcaatctactcatctgacaaagggctaatatccagaatctacaatggactcaaacaaatttacaagaaaaaaacaaacaaccctatcaaaaaatgggtgaaggatatgaacagacacttttcaaaagaagacatttatgcagccaaaagacacatgaaaaaatgctcaccatcactggccatcagggaaatgcaaatcaaaaccataatgagatatcatctcacaccagttagaatggcaatcattaaaaagtcaggaaacaacaggtgctggagaggatatggagaaataggaacactttcacactgttggtgggactgtaaactagttcaaccgttgtggaaatcagtgtggcgattccttagggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccaacaaggatagactggattaagaaaatgtgtcacatatacaccatggaatactatgcagccataaaaaatgatgagttcatgtcctttgtagggacatggatgaagctggaaaccatcattctcagcaaactatagcaaggacaaaaaaacaaacaccacatgttctcactcataggtgggaattgaacaatgagaacacatggacacaggaaggggaacatcacacaccggggcctgttttgggtaggggtaggggggagggatagcattaggagatatacctaatgttaaatgacgagttaatgggtgcagcacaccaacatggcatatgtatacatatgtaactaacctgtaggttgtgcacatgtaccctaaaactaaagtataataaaaatatatataataataaaataaaaaaacaaatccaactttaaataaagggggtgttaaatgttaaaagaaaaaagagaatgaaacttatttttaaaatttgaacacaataggctattaatgaaactttatttaaatctttatatttttccaggccaattttaaagcttttaaaagttttgtttttttaattctgtgcccatttttagtaaatatagtatatttttcttaatggttcttaaggttttacatcataataatgcaaacatttctccaaatacttgatgtttagtatttccacgtcactgcatttagtgcattttcatgattttttaaatttccttgacatgttttgtatttccttgacatatataatattattaaaacacacactcaatcataatttaaatgctaatcctcacaaatctattagtctcaattttgtttaattggttttttttgtagtagatatataattttttatagtgaattacatcagtcttttctgtttacttcttttatactttgtaaggaattggataagtctcaaacaagacagttactcatcattctgggttttttgttttgttttgttttttgagacaaggtctcactctatcacccaggctggagtgcagaggcacaatcttgactcaccgcatccttgacctctctggctcaagtgatcctcccaccccagcctcttaagtagctgggaatacagtcacacaccaccacgcctggctgattttttgtatttttttgtagagacaggatttcctcatgttgcccatgctggtctcaaactcctgagctcaagcaatcttcctgctgtggccttgaaaactgctgggattacaagcaagtggcactgtgcccagcctctattctgttcttctttcatctgcatttatgtttaaaatttcaacttttaaaatttaatttttaaatgttgagaaataaaggacagtattttttcgtatagttattacctgaacatttattaaatgattatttagcataatgccatatgttctcattcttaatgtgtttgtaatctctcaattggttgcattttccatctgtcaaaaggtctcacttaaacattttaagctttgctgagtaccttttaaaaagtgtaaaaagggtgatacaccacaaatttcaccagaatttttaaagtatatattcctatttataattccaaatacaatttcggagttattttgagtttctaaaggatcttctttaaattttatatggaattttgatgatgtgataaaagtgaaaatacatatcttatagtactaaaaagtttatttggaaatacagtatgttctccactcatatccttcttccttaattactttatcaaattttgtgtttgtgttaccagttatgatatatttcttgtttaatattttttcttctaattttatatgcttttaaactattataagtgtactgattttattatactttctacccagttagtattttatattttctatttttgattctcttgaaacaaatgtgtcatatagatggagacactgaagaaaaaaataggaagattaggattagggaaaggttagggaaaaaaagtgtagttggtattttcttccataatcaatgagtgaaataaaattttctcaagcaatgactgcattgttacctcatcctcctccccaaacaaacattttaagctgaaatacagtgtgtctatactgcacttcaagaaatactttagctggattaatatctcaatggaatcggaattccatggaacataattatatcatttgactaaagtaaattcatagtcttttgttgcactgacttgtccttagtttagggttagttataaatactttcagaatatgttatgaatgactttaaataaattgataaagtaaagtcgcataaaacatcgtgatgtgttttaatctgtttgtgctgctttaacagaataccacagactaggtaatttataaggagcagaaatgtataggctcttagttctggaggctgggaactccaagatcaagcggccagcatttgattagagccttcttgctatgccataacatggcagaagtcatcacatggcagaaaggcaaacagtaggagagagagcaacaggagtcaaacttacaaccatgataatgataacagcattaatctattcatgagagccaggacctcatgactagccatcttttaaaagtcccttctcccaatactataaaaatggcaattaaatttcaacaagagttttggagaaaacaaacattcaaaccatagcatgattcaaacaaataaacagcaacaaaccgagaacaaatatataaatcctgattttaaatttaaaaatcaacaaaaggctaatgcataaaaataatcattgtaattccaaataaatacagattcaaatataaaataataacattaataataacatatttttaaaactgaatttaaaaataattaagaaaaataacacctaatgctgtaagggttttgttattcagtctctggaaaaaagtctaaaaaccttctggaaagcaatttggcttcacaaatataaaacctcaaataaatttatatattttgacttatcaataaaatctaccccatttctaggaaatgtattattaaaatatgataaaacgtttggataaagatgtgaagacactaatgtctggcacaacactatggaatgtttattttggatagatgcatagctacaataaaatattttgttctagtatgtaataaaaataaatttgaagtgggaaattttcatacatattgtatgtaaaaaagaaagaaaaaaaaaactatatgtgtgattgatctgaattgctcataatttcaaatgttatatattgatataacatttcatttttatcatgaagaaagatgcacatagatccactaaaatattaacagtctctagattttcagattctagatatttataaatcattttgatatacttattacatatcttatgaagactagagagtagagtacaccaactttgtgacatcatgtcccacccaaactagaactttttcaatacaagtgttgaccgaatttatgcaagtagaattcacattcagaacactcagactcacatattcagaaatatctatggcagccattgccaccagctctgaaatcttagtttcagagcagcatccagttttagagagctgagctgaaagacatttagaaaacatctattgcatcacatttgttctacagatttgaaaatatggatcactggagtttaatcaatttattctaaacacaaaatattgtaaccaatggtagaattacgatcataaataaagcagcataatttttcttggctgtttccagcgtgtaacctaccttactttaatttcaaagaagccatgaagactatgacatgagtgctaggctctgttatatttctaagctatgtgttcgttctttttgttttttcttaggagaatggcactgtattttgggcacagttcatcaaggaaaaacagttgtcttaagcaatggattttagtgacggctagttgattgttacctggctactatttatagtatgttcttggttttattatgtgattttatttaaaagttacatagaaaataagaatttaaagtagaagtcccagttttactatgtccatgatatacactcagaacattgatattctctttagaaatgaatatttaatctccacatccacttttgtcagaagtaagttatttaattgccaagcactttacaaattacttctcttcacgtattagttccctacaattcccgaactataaacacaggtataatactaacttgctttctgatattgcagataagaaattaagtagataatctgtcttagatattatctattagctaacattttcactgattattggggatatattagataacttaactttgttcctgaaattatttgagagaactttacctcaacaaaaattgaagatgggaatgagaatttaatgttctttaagaaaatattttgtgctcctgccaatttgtgagagttaaaatataggaaagatcacgtttcatacgaaaaatcacaattcactacttcctcttgatatgggatatatggacaaaaattactctttaggcatgtagaggtctagtgcaatggtaatgaaataagtgggatgatagagtgtgtctgagtctattggttttaaactactcctgggttactggtaactacatatttgtcactaagcctatttaatacagttccttaccttggggattgaactatacaacacatgagtgagaaatacagactgaaatgacaacaaagatgaaatgatggagataaaagtactttggaaatgagatgatagaattcactaagaattatggatcatttcaaattcataaacataaatatctactttaaaacattacaattcatggaaagcacttatgtcacttaaaagattgggcttcagaacggtgtcgcctcttaggttaaggtggcaagtgtaaaaagtcaccatagcatcacagtacttgaagacatttaaatggaagtattagttgataccatgagacttttaattttgacatactattgtctttgatgatattggatatatttcttccataaataaacaggttttgtttaaatggaaaatatgctgaggcaagtagaaccccttttttatatttcctcaatgagaaactgtcttagcagccaaagtaacagcgttcactattattgcctcaagggttgggcagattccaataggctgggaacacaggcactatttggggttgtatactcaagtttagacagaagcagtctggtcacatgaaacttaatcttttaaagtgttatttaaacacattctttatagtttaaattgtaccaaatttattctaggcacacacaacatttattcaatattcaatttacaaatagaacttatgtgatttcttagtatagttttttggttttatattttgagtaaattttaagaccttcaaacaagagaaaaagccatcagaaatagattactcagggtagggaggacatcaaagaatagaggttaatttaacaatttctagatttcttcttacagttttttaatgtcaagtattaaaatagcacgcattttttcaacatattctagcctcaactgattttagaaagtcaaactcatgtcaacatgtcattttatagacatagaatgggaaagaaaataatagtacagccagagtggcaggtatttcctgcaagaatatgaataattccaactttttcatgcagttttcacttctatttgagaatcagggcttattctgttattattttgtgtttgctatgtattttatatagtgttgtcagttaagcaagttaaataaatgcaactggtcaaactgtgaagactcagtaataagcatcaaaaataatttagtttccaagaaaaagcaaactcttctttgtcaactgagagacatgtctattgagaaagcgtttcattcaaacttgagaaaaagtttggtaattatggctaccatttactctgaaaacttattggaattggtatattcatataaaaatattgctaattttatttttcccaaattaatttttgcctttgagattcacttgaaattaaagtaacttgaaactaaactatgttctttttccttctaatttcactgtccctatatataacaatggcttttcttaagacattagagtagcattccttcgtaactgatgacttttacattaaactttcatgtaaaattatattcaaatttgctttcaagtctctttttaaaataactgtttttactattcaaaaaataaatcatagtgaaaggttaataaagtatatatactcatatcaatcttattagaaacacaatggaagttatatcaaatattttacaagtttctcaattcacattaacctagctctagaagtttcttctgttctcaattcaactggaagataattgtcttgactaggaaaaaatgctaataatgagactgtcaatatataaactataaaagttaatggaaataaaaaataatcttaaatgcataaaatactaatgaatacaatgttcacaatattagcattaaaagtggtcttattttcttaaaaacaggtttgtgttgtaaacaaaatacaaggaaatcttctattaaaaatatatgcttgagattcatggtagcttaaatttatccagggaaaatattttacaatatgtctcagtggtagtcagaataatcacctccaaagatatttatatcttaatcctcagaacttgtgaatgcgcatgaatgcacacagcaaaggagaattaaggttgcagatggaattaatgttctaatcagctgactttaaaatacagatattattctgaattatctggcaggtcccaatgtaatcacacgggtctttaaaagtggaagaggaaagcagggaagaagttagagtgatgcagtgtgaaaacttgatcctttattgcatgcaaaaaaaaaaaaaaaaaaagatgaaggaagagggccaggagccaagaaatggggacagcttctagaagatggaagaggcaagaaaacaaattgtttcttaggggcttcagagggaatgcagccttgccagtatcatgactagcccagtgagacccattttaatcttctgaggtacagaactataaaataaggaatttgtgtagttttaagccataaaattgtgtaatttgtaaaggtaaccatataaaattaatatagcttctatgaatacctctatcttaattatatagttacagttttaattttttttataatgcatatcccttgaaaagttgtaagcaatatagcatgtgcttaagaggcaaaaaggtaatgtgaaaattttttaaagtataatttattatatatttatgatagtaatttgcaataatgtattatatgtattataaatcagtgttaatgtaccagtctatataaatatctatatgattaaactattccttattcaatatcaacttgcccactgtaaatcacactagtatgctgttgattattttgcaaagtttcgttcatgatgttttcaggtggataattcatgcttacgtgtcatatcctcctgtactctataaaagaaataagagcagccacagcacatgtatcactctatggaacatattaataaagttctcaagatcaatgctgctgagtgcttttttgcaggagcagtttaatgttagtataaaatattgccccattaaagcacagaagacaataaaataaagcaaaatcagcataaataaaatttattaattatgtctcagtgattggaccttttcttttacgttaaagaaggtttacaatgacagcagcgtatactagaaatgatggagtccctatttatccctggtaatgcaccttcttagatcacagttggttagttgtcatcacttaatgtttataaagagctctaaaattgaaattactccctaagtgtcgagtagcctcatcattcctgaacaatcctaatgaagaaaagcatatgtgaccattttgcaagcctcttcagaggaaagtgaatatttaccattgaataaaacaaaacaggaaaacaaacagataaacataagagcaaaagaacaaagtcaaaacaagttgcagaccaatgtagaaagaaacaaaagtctgtgcttcttccgttcaggttcctcgggccagagacagcatgtaggtcatgctgtggttgatcacaagggccacagatgatattccctagtgtttgcaagaacttcctttaaagtactattaataatatagagaaaaatgagaaataagtttagcatgatcattagtatgcagtgtatgtgagtgatgcaaccatcatatacaagcattataactttcgtgggcctattttcttatgctctatctctctgtgtataaaacataaaatatataaatatgtttatattttatgtaaatttatatttatgtttaatttatatatttatatgttatataaagtattttcatgtataaatatatttcctataaaatatttatatattatattttatatgaaatatatgtaatattacctaggctatgttcactattttacattcatcgttattcattgttatactcattttttctttggtttctaagatacattaaaatttgaaaatataatgggcctataaaattttcatgacccctaagtgccgtacctactgtgtctgacgaataagttgtctctggtctttataaccatttgctatctaaaagtgtataccttcagatgtccccaattttatatttgtgataaattcatgttgataagaatatgggcatgctgattacctaaaattcaaaatatgaataggcccagtataaattgtttatgtatatgcattcaagcactagtgtgtttgttagagctttcaaatctgtttccctcttttaatccaaagtgttccaaaacatatttgaatataatgtgtattttctaaaaatattccataatctgcatgtatcacatcttaacccaacaagtaaacactggaaatgactactaatcagggcaagacatgcatgataacatgtaggtgtgggttattactaatacaaaaattctaggaactttcctatgtactctgtaggatgcgaatgagggactgtaaaagtggagaatgacaatctgtatgctaattctgaaacatttgcattgagaagaatggcctgggaaaattgagctaaatctattcccgccttagcaaaattcttcatgaatgtgaaatgctataggttagttaggtaaactagaagcttctacaatcttgtctacattccaagataatgcagtatgctaaatatttttctctagactgaaaatatttctttaaaatgatctgtaattttagcttcctacaaagtcagccttactttctctgaattagaatgattatgtgaggatctgttaaatttatatgtttagttttgacaaaataacacctacctgctaaagaaaattgtaaaaagcgataagaatagtgaatatgttaaatatcatttgacctaatgaatattggttttgttgtggcaaaagaacaaaaaatggaatgggtattttagaccacagtaacagccactcctacaacagataaattactattatttgattttcagcctttgattgtcttttttcccaaagaactcagaaaaatatgctcatatatcacctgtgtaaaataggaacaaattatgttctttcaactgtgaatgccaatcacacacagacatttgcaaatttacatgagatgaaaagcaatttcacggcaatcagctaaaccacaataaaaattacgcatgcatcacagcattgggagagagagaaaactgtgacttgccaaaagaaaatcagcttgtacattactctggccaaccagtgccaataccctgaacaaggagctatctctaggcaaatgacactgtagattgatatgctaacttacccttcaatacagcatgtatgtatctggggatgcagagctacaaagaaaggttctgaccctgtgaaaacaggtgatcaccatgctgccttgtgccatttacaactgctaactagaaataatttggtctattttcagtggttaacttaagggtaatgcattgtattcatttgtacttttttttttttcaaattttaaagacttccaaaatatctattgcttttgaaatctactcagtggccattcagctgtttaaattgaaatggccaatgtaaggaaagaaaaagattaaatatattcaactggccatgataaatacaatccaggtcctttggtgttagaagctcagtatgattaaactgtttttaatgattaggcttttgatttttacacataaagaattcttaatcatgattttttatcataaaaaacaaaaacactcaattagaaaaaatatggatagcatttcccaggatagggcacgttaacaactatttctttccctatagctttttctactctgtgtgtgtgtgtgtgtgtgtgtgtgtgtgtgtgtataatgtgtggtattctcttaaaatttgcctttctatacaagttcacataaaaaattttatgcaccaaattttatatctttttcaagaaaaattgtaacttcagcaaaacaaagattaaaaaatgttaataaaggactataattttttacaaaaaaggctaagttcatactgtactaaacatatctttatcagaagatgtaaacatactgaatttgatgcaaatgtgaattttagaaacccgagctcttactatttttagagtccttaataaatatctaacagtctactatggtttgaatgtagtttgtccccactaaaactaatgttgaaattaattgccattatattggtgttaagagatagggcctttatgagatgactaggtcattaaaatctcaagagagactgggttagctcttgcaataatgaatttgttctcataagagtgatttttggcttattgatccataatatttatatatatttggggtacataaaatattttctcacatgcttaggaagtgtaatgatcaagtgaaggtacttaggatgtccatcaccttatgtatcatttctgtgggttgggaacatgttaactccactcttcaagctattttaatatataaaatgcattgttaactatagtcaccccactatgctattgaatattagataaaaatcctttcatttgcaacaacatggatagaactggaggtcattaagtgaagttagtgaggtgcagaaagacaaacatttacgttctcactcatctgtgggagctaaggaattgatctcatgggggtaggaagtagaataaatccttaacaggttaatttcattattacaacaattcaatgaggtagttatatttttattctattttgcagatgagaaagctaaagtagataaattttaagtaaatgctcaggttcacagtgctagtaattaacctattcagcatctgtacctagaaagtctactgccagagtccacatttatcaccagtttactgtaatgcctcttcctttgtaaccctgaaaattacttatgagaaaacttggctagttttcacccatatacctatataagggacagacatcgatgcgccttttcaaaaaggtgaagtgggagtacagggccagagaaagataaatggaatcatggagtataagtgatgatgccatttttttttctactggaagtttgaagtaatcttggaaataagaacaagttctgtatataagctaggtgagagcttccccaaattcccatccattcatttattgttcaacaaatatttattgagtgcctacatcaggcactgtttcagaaatttagagcttcgtaaggaacaaaaatctctgcctctatctagtatatttactagttgggaagagagttaagtaaacaatataatacaaaagagataataacagtaaagaaaacaataacaattgccaccctgaggtaaaatttgggggatgctcagagcctgagtacaaaggtgtcaaccaaaccacccgaggaccaatgggatcagtgtctcaggacaccagtaagtggatccaattgaaatgcctgcaataataacatcgttttaacttcttggtaaaccaaggttttcaattaaaggttggtttggggaaaaaattgcctttccttatgaataattcaaatggatttcctttgaatttaccaaaattcttcatctgatgagataggattttttctcttttcgcccataaactttgctttatagattgcttagggctactgcctaaataaaaataaattcctgttgcagtatggttttaatatgttgaaatgtattctttaagttgaagatctctgtagttcatttgtcaatgcaacttttctgttcaataggagtttttaaaaaagaaaacaatcaaacaaacaagaaagaagtttacttccttttgctagtgtattccattactacagtttgatatttcaagtggctcatgaattagaaaaacggtctataaaatcaacttataactatctacctgaaagaaacaacagaatattcatagtcacattctttttatgttaaatttaagttttaaaaattaaaatactaatgtattatttataatatgtataaaatgtgatataataaattccagcaactaacttatacttttttgcctagccattccaccccttgtgttttcctccatttatgctggaagcaggcttcatgttcctttgcacaacagcaaagttgtgtcaggacctccagcagaaatcacgttcatttaaacaagtttctcactttgtgttaaggcctttgtccattgaagggcctgtatcccaagtgtgaggagggagaattccttgagaacagcgaagcaagcagaaggggtcctcccgaccctagagaaaagatccagacccagggaattgaggagaacaagtgacccgggtccaatctcctcaaaatagtttcggttgttgttacagtttaaaataccagggagaatctcatgtttgccagttgtttttttttttttagacctggattaccagtagaacactatattaaacctagttggtttatattctcaaagaagagaataggaatatagtctatgggtttctattttttcctactcatttaattttattacaaaggctgtatgttagttgatatgagggatagtgaaacaatttttaaaacttctaattgtaatcattcacatttcaatgtgatattgtgttaagtatgactttatgttagctataagtttgacctggacctttttgtcttatattaaggatttgtgctcctgctctaaaataattggaatggattttaaaatttcttgactttcatatacttttagaaattactacatatccttttgcttatttgacctattggcatgatgtattagtagagttgtttttacaattccatcatcaacttgtaagttattcttctggatatagcgtatcaatatatttcatataagaatgatgcatgtctattcataaaacatcagcctggatttttcattcttaatgctgtggttttacttttgtagttgcttgtgaatctctcttgataaggttaaatactgttttaacttaaaaacaatcaagttaacatacaatttcattgtcatattgcatacttccttttcccttctttaaaaagaactcacagtgatgttatagccatgtctgctgaatgtgttaaatggaaagtagattgagaaattttgaggtagttgaacatcagaacattattcttactagatgcattgaacagagagctaagtatattgctatcttctctagcacttggctgagagcaaccaagcaatttttcattttacttgtgagcacaccatgaacacaccacctccatgtatcactaaaccatgcaaaagcctctgttattcatgcccaagctggcatagagataaatttgaaagaatattagtgaaaaatgctgcttcataccaaacagtattctgtctctgtgtttaaaatgactttaaaaaaataaatcatgcaacaggaatgtctccaaacacagacttctggaataaaaattgccaatctcagagacctagctccaaggaatatcaaccagccagtcatccacctagcatgaaatggaaaggacattatttcaaccttcagtggataatgaatgccttgacacaacctgttttgaaagataattggatatgtaatttgctaaacatactatctacaaggcaataaaacaagttatcccatttatattttttgctatttttctttgtcagtttgccataattttgttcacccataaagctattatttcccaaacgagtgctactagatctagagatggtttctaagcaagtgaaattatctgaaatgtgactaactgaacttcactctttaataggattcacttaaggaatacattatacttttcatgtactcaagctcaaataacctttaccattcccatggttttttatatgttcttccagttaccacatattatttatagtatcatattaagaaaatataaattttcttacacatgcaattgaatatgccccgtccccctttgggattgtttgattcacttatttactcaacaaatcttcatcaaactcttaattttcactcattcaatcacctgcatagggcaatcattcaatcaacattcttgagcacttatcttgtaccaagcattattaagcccttgggactacagcagtgaagaaaacatacaaattcactgcttttatgagacttaaattctggtgtagagagacagaaaacacacacataaatgtatttgatgtgctgagaagtactataaagaaaactaaagcagtaagagcacagcgaatgaaggacttttagtgatggtggtattattgtcgtttgaatagactcattacaaattatctctctgtcaatgttacattggaggaagcacccaaaggaaacaagggagtaataattgcgaacgttttccattaagagggagtggtagggaatttataggtgtgctggaggatagcagaggccagcagcctcaccaaactggagtcaacaagagtggctgcaatggggtgccagcagtgagttagtcaaagaaagataacatcatcaggctctgtagaacactttttggaaggactttgaatttaattccatgtaaattgcattttaaacaaggcttttccaaaggtcattctgtagctttgtggagagtaacaacagtagatgcagttgtaggcactgttagaggtacatgagaggcagaatacaggacggtattgaagaaaatagactctcctttcatggagtttactctctgatgtgggggcatataataacgacgctaaaataaatatgtagaaaggatatacaggttagtgataaataccaggatggacataaaacggattggtgtgattagacaaaaggtggaagctattacttctttttgcttgattaaggatctaataaagacttatactcaatctgagaccagagtaactaaaaagagacagccatggaaagcccattaaaaaagggagttctggaaagaggaatagcatgtgaaatatcacttatgtgagagcagaaaggtggtcagtggttttgaagaggaagttcaatattatgcgaactggagaggtggaggcaagatcatgttgggccttatcagccacattgatgacattagatatatagtcatatgtcacttaacaagggggtatgttctgagaagtgcatcctttagtgatttcatcactgtgcaaacattatagagtgtacttccacaaactgagatggtagagtctgtaggttactgtactgaaaactatagttaagtgtttgtatatctaaacatacctaaacagaaaacatacagtaaaaattcagtatagaagattaaaaactgctatacctgtataaaggacttaacataaatggagcttgcaagactggaagttgctctgggtaagtcactgagtgagtggtgagtaaatgtgaaggcccaggacattattggttttataaacactacatttaggctacattaattttttttctttcttctataataaattcatcttagctaacagcaacatttttactttataaacttttatatatgttttacaatttttggactcttttgtaatgtcagcttaaaacacaagcacattgtacagctctccaaaaatatttaatttatttatataggcttttttctatttgtagtaattataactttttagtacgttttgttgataactaagacagaaacacacacattagcttagacctacacacaataaggatcatcaatatcactgtcttctaccgccacatcttgtcccactggaaggtgtgcaggggcagtaacatgtatggagttatcatctccttgatagcaaggctgccttctggaataccctcgaaagatctgcctgaggttgttttatggtgaactttttgttataaataactagaaagaatatactctaaagtaacaataaaatgtatagtatactaaatacataagccagtctcacagtagtttattatcattgggaagtattgtgtactttgcagaatggtatgtgttacaattttgtaagattggcagtgcagcagggatttttttttacacctgcatcaccacaaacacacaaataatgcattttcctaggacattaagattgatacaatttcactatgcaatacatgggaccaccactgtatatgtggcatatcattgactacagaaagaagtgagaagcccctggaaactttaatgttaagagagcaacataatctgacttatgtatttcgattgactactctttgaaaaatgtattttcatggaagtgagtagcaagaatgacattttggaaagctattaatccaaaagggggatttggttgttcagattaggtggtaaccttgaagatgaaaataaatgaacaaaattgggatatcttttggcagcagagacattaggactattttatggatttgattggggggtgctgaggcaagagacatcagagatgtctcctaagtatttggcttgagagaatgtgtgaatagggaaacatgttatgatgtagaatggcctagcgtagcacatgagcatggtgttaaggaagcattatttctccttggggtatggcaaattagagatacaaattagacatccagtagtcccgtcaagtaaacaattaggttgcttttctaatctgatttagtttaaaggagcatctgagatctaccccaatgagatgctttcatgttactgctgttaaaacaattttatcagaatcctcagtttttataaattatccttttagcatataatataaatatttgtgtaaccatggacttggatgatgcttgttttacttgagtgggcttccactgcaaagtcaaaacctttagccaaaacttcaaaacaggaggtgagtcaaattggccattctccaatgacctgtcagaagtttaagaaattctttgagaagaatgcaaagttttcctactcaattgttatgacatatttttgaggcttctaatatttcattcatatttaaccgacagcagcgaagtactcagtgtatttaaaaataaaacccaaactgaccgaggtctcagactttaaagcagcgtataatttatttagaaaccagacagtgccatgaaaccactagatgctatagagtgtctatcatagcaaatattatataagtgatatgtacatgagatgaaagatgtagataacattattctgttcaagaaagttaaattgacttaaaaatactgaatcatctgagttccatcttggagagatagtaggattttctaagaaaggagaaacaggagtggtaagctgaatagcagaaacaagagcataagcaaaacaaggaaatgaaaataaatagatatttgcattacacctagtcatcatttgaaaggcaccaaggatgcatggaggagagtgactggagatgaggttgaaacaggaaacgtcctagattgcgaaaacatgttggagcattctacagagtttacattgaggatagtataaatcatggatgagtataaacagattatattggggttttagagagaatactctgttatcttattttgaatatgatgaagtaaaggacaagatttcaagaagtgaatgaaatggctcaagacgataacagtgagatttaaaaagacaggaaagaattgtgagaaagatcaaaactagagttattacaacttcctaagtgaatgttttgagtgaaggaaagttaagtgtcaaagataattctgaagctctcagcctgtgtgactgagtgaattgtggtgttcctcaaatgaagatggaaattctatttgatgagggagtagtgataaggcaagaaaagttctgttttgaaaatccaggtggagatgactagtaactagatagaaatgcaatctgttgggcaggagatcaatatttaagccagagaattaagagtcattagcatattcaagaaagtggtaattgctggactccatgaagtccctatgaataggttaaattgagaaaagatctttcagcataaaactctgaggggtgggggctttccaaggagaggcagcagaagccagagtaaattaaaagaaagggacttgtcagagagacaaaagagaaaagaagagatgctaaactaagaggaaggtgatttttaaaaagaaagctaagaattgacacgaagtacagttattgtatataaatgtgtatataccatgacccatatttcttcattattgaacactttttactttcatttgagtattgtcatccctctgttctttaaattgctctaacatctttcatatttctcgaaattctaaatattaaaaaattgcttagccacaaaattttctcaagcttcctgttcatatctgcatttaagaaaaaattaaatagtaataaaatcaaataaactgaacaaatagaagaaaaattagggaatagaaacagaagaaaaactgtaattcattttgcctgaaaatgagaataaaaatgtattctaaagactgtttttcatgttttatgtaaaaatgacagtttttaaagttttctaggggctgtctcttttaagatattagaacatagtgatactttattttgaatagatgtattatggatgatacataaaaattagttataactatctattgacgatatattgtttactacaatagaataagaccacacctgagcctaaagaaagttctcagtttactataggtaaaatcttgctatgaaaggtgcacataaagattagaggctttctgtggtggaggggaaacactgctggctgcagaaaaaaatatctgacataacatttaaatttaaaagcacaaattattgacttagtatgttaacataaatgaataaatgtcttctaaatgctttgtcttttactaaattccagcattttattactaaaaggacacatatacaataagtagtaaatatgcctgatatattttaataatgtaactaatttcctttataaattagttatagttttaatactcttctttatgtgctctaagtggctccattggctaggttaatcattagaggatgactaaattgaaaaatctttctacaaataacgtggtgaataatgtcatcttccaccatcttatgctaatgtataactaattattatccattgctgccatttctgaattttacataatttgttcatttagtgtgagctatctaaaatatatatggatttcaaatatgtattttatgccatggataaagtttatctctcttattctgttttgtcctataactatttcaaagcaataacacctatatggtccagaacagatgtcattgcttgtggtctggaggtcatgaacattgctaagccacacaaaaaaatgattttgtgtgtgtgtgtgtgtggttgtgcacagtatctcatgcctgtaattccagcactttgagaagccgaggcaggtacatcatttgaggccaggagtttgaggccagcctgggcaacatggcgagaccccatttctacataaatacaaaaataagctgggcgtggtgacgcacacctgtagtcccagctactcagggggctgaggcatgagaatagcttaaacccaggaggcagaggttacagtgaaccaagattgcaccagtgcactccagcctgggtgacagagcgagactccatctaaaaaaaaaaaatgtattttacaaccatggcttacatgctgagacatatataatctctgatgaataatgtatcatgctaattttatttaaaatattaaaactcatattacaccactatcaaagtaataaaaaataaaggaaatcgggtattctgtatattgacacaatatattttgctatttattctgatggctgatatttaataatagaatgggtacaaaataacttggaaaattatacataatattacatatatataaattcagaaatgtcttgtctagctgtttgtgaaagctgtgaagcatatcttccatttccctgagtagtctgttggtggcctggacaagttcaccctcatcacagcttgacccctagcggctagaggacaaaccctttggcctggttccagttccccagaactctagcacacagtttgggatgtatgaagatgacatctgcggcctgatctccagcaggggaggagtccacactgtcaaaacatagagaaaggtatggtgatgaggaagctgggtacccctcccttctttagacctgactgaaaagcttattgcctgacagctgtggtttctgctgcaggaaatctcaccatcgagatgcctagaatagctttgtgatctgggcacaaatggttttgggtcagactaacttgtagggccagttgccagagtggatgccagagggagactcaccaataagagggtgtatgagttggctcttcctctgagccagctctgtggtgcaggagaggcacctccaaccctttctggagggtcgtccatgaggcctgagagcttccactagacacctgctaaggttggtacttgcacctgcctcagagagcctggctgccagctcaccagacccagtgccgcacagctttgccctctcaagccaccttagtggcagagcacaggatggaaaccctgagagtccaggcactgcccatcaccagaaatatcccagtactactcctgatcaacaaaggctatgtaaaaattccactgccaccaccacaattacctcttgcctggaagtatcatctactggctaggaggtcaaactgcatggcccatcacaactgctgaaaccagtttataccatttaactggcttttagccaaaattgtcacctacttgctggtagggtgagctgcacaacccaacataattcttgcttacagcagtgtgcagtgctagggaactagatatgcaacccaagccctgtacctcaccatctctgtaggagacagtgagcctgaccacatacacagcatattgctaccacaacccacaaaaaaactagcacttaagaaaacctacactactatactacactcaggctatctataaccaaggaatttatacagagccttggccccataaacgcaaagcaaaggactctacctgacatgtgcaacagtcacactctcaaggaggaagaaaaaagtcatgtaaatgaaagttaatttaaaaataataaatgacagcatctacatatgaaaagaaaccagtccaagaactccagtacaacaaaataacggatattatgacacatgttatggaccatcctggcttcctagcaatggatcataaccaaaatcaaaacattgaaatgaccaaattcaaacaaagaatttaagatatgcattgtaagtaatctcagtgagattcaagagaaggttaaaaaccaactcaaagaaagtggaataacaattcatgagataaaagacaaaatagatatattttttaaataactggaaataaaaaaaaactgaagaaaatttaaaacacagctgaaagctttaacagtagagtagaaaaaagcagaagaatttcagagcttgaataccagtctttcaaatcaatatggtcagaaaaaaacagtaacaaaaaggatttcagaaagcaaacaaaggctttgaaaaatatgggttatgtaaagcgaccaaatctacggcttataggcattaatgagagagaactagtaaaactatgaaaaacataattgagaaaataattgaggaaaatttccccaatcttgctagagatgtagacattcaaatacaataaatttagagaatacctggaatatattatacagaatgtacattaccaaggcatacagtcataagattatacaaagtcaacatgaaagaactaatcttaaaggaagctagagagaagtatcaaatcatctgaatgaagaaaatgccatcagactacagcagacttcctagaggaagccagagattgaggccctatttttagcctccttaaaaaaaaaaaaagccaagaattttatatcctgccaaattaagcatcataaacgaagaaaaaataaagtctttcccagtgaggaaacactaagggaatttcttccagattggacctataagaaatgctcaaaagagttctaaacatggaaataaaaggacaatactctccatcataaaagcatatataagaaagctcacacattacacaaagcaattacacaattgagactccaaggttactagctaacaaaactataacaggaataaaatgaaacctcacatatcaatattaacattccagttaaatacccttgaacttaaatattaataattctacttaaatattaaccatgtacataaatagcctaaacattctacattccagaataatatattctggaagaacatatttatatattctggaagaacgtatttatatattctggaagaacgtatttatatattctggaagaacgtatttatatattctggaagaatgtatttatatattctttatatattctagaagaatatatttatatattctagaagaatatatttatatattctagaagaatatatttatatattctagaagaatatatttatatattctagaagaatatatttatatattctagaagaatatatttatatattctagaagaatatatttatatattctttatatattctagaagaatatatatatatatctatctccaactgtcggctgcctatgagagaacctatagggggtctaatggctagacacatatatactcaaagtaaaggggtagtaaaagatatagcacacaaatggaaaacaaaagtctgaatgactagccattcttatattaaacagacttcaaagaaacaacagttaaaaacattaacaaagaatggcattatataatgataaaggtttcaatacaacaagaatatttaactattctaaatatatacatgcatccaataccagagcacccaggtttataaaacaatttctacttaacctaagaaaagagattaatagcaatacaatattaattgggaacttcaacacctcactgacaacactaaacagctaatcgaagtacaaagtaaacaaaccctgacttaaactatactctaaactatgtggtcctaatagacatttacagaacattccactgaacaaccagagggaatacatttttctcatctacacatggaacatttgaccatatgcttggtcataaagcatctctataaattcaaaaaatcaaaatcacatgaagtattttctcagattagagcagaataaaagtaaaaatcattaccaagaagaactctcaaaaccacataagtacatataaacaaaacaatttgctcctgaatgactttcaggtaaacaataaaattaaggaagaaatccaaaagttttgaaacaaagaaaaatggaaacacaacataccaaaacctctgtgatatagcaaaagctgtgataacactaaagctaattgtgttaagtccctacatcaaaaagagaagaatctcaatttaaaatcctaatgtcacatctcaaggaactagaaaagcaagaggaaacaaagtcaaagctcgcagaagaaaagaaataacagatatcagaagagaattaaatgattctgagacttaaaaatgatacaaaagatcaacaaaatgaaaagttgtttattggaaaggataaacaaaatcaatagactgctagatagtttaaccaaaaaaagacagaagactcagataagcacaatcataaatgataaaggtgacatcacatctgatacatgccacagaaatagaaaagatcaccaaagattagtgtgaacatcagctgtatgtgcacaaactagaaaacttaaaggatgtaaataattcctggaaacatacaacctccgaaaattgaaccaagcagaaatgtaaatcctgaacagaccaataatgagtaataaaattgaatcaattaaaaaaaaaattataaaaataagcccaggaccaacagattcagagctgatttttaccagatgcacaaacaagagctgctaccaatcttactgcaactattccaaaaatttgggaagggattcctccctaactcattctctgaaacaagtatcactgtaatactaaaatcatgcaatgacaacaccaaaaataactacagaccattatctctgacgaacatggatgtaaaaatcctcaacaaaatgcaagtaaactgaatctgacatcaaaaagatgattcatcatagtcaagtgggttttattccagggatataagggcaattcaacatttgcaaatcaatgaatgtgatccaccacatacaccaaattaaaaacgaaaaccatttgattgtcttaatagattcagaaaaagtatttgataaaatccaacatttcttcaagatgaaaaccctcaacaaactagcaattgaaggaaaatacatcaaaataataagagccatatgtgacaaacccacaggtaacaatctgctcaatggggaaaagttgaaagcattccccctaagaactggaccaagaaaaggatgttccctctcaaaaatactattcaacatagtagttgaattcgtagctagagcaatcaggcaaggaaaataaataaaaggcatccaaattagagaacaggaagtcaaattatctctattcactgatggcatggttttataactagaaccccctaataactccaaagtagtactagagttgatacataaaggcagtaaagtttcaagattcaaaatcaatgtacaaaagtcagtagcatttccatacactaatgacattcgagctgagaaccatataaaaaactcaatcctgtttaaaatagccacatgcacaaacaaaaaatacctaggaatacacttaaagaattaagtggaagatctctacaagaagaactaaaagacactgatgaaaaaaaaaaattgtagatgacacaacaaattaaaagacatctcatgttcatggattggaagaattgatattgttaaaagtaccatagtgcccaaagcagtctacagattgaatgcaattcctatcaagtagcaatgtcattcttcacaggattagagaaagcaattgtaaaattcatatgaaaccacacaagagcctaaatagcaaaaacaatcctaaactaaaagaacaaagccggagacatcacattacctgacgataacacatactacaagggtatacgaaccaaaagatcaagtactgatataaaaataaacacatagatcagtagaaaagtgtagacaacctaaaagtaaagccacatacctacagcaaactgatctttgacaaagtcaacaaaaataaacaatagggaaaggactccccatttaaaaaatggtgatggaaaaattggctagtctacgtataacaatgaaactggactatcactaacagtatatacaaattaactcaagatgtattaaagatctgaatgtaaggcctgaaactatagaagtcctagaagaaaacctaggaaaaccacattggcctaagcaaagactttatgactactaccctaaaagcaaatgcaacataaacaaaaatagataactgggaattaaactgaaaagcttctacctaacaaaagaaataattaataaagtatatagaccacctgcagaatgggagaaagtatttgcaaattatgtcaaaccaacaatcccattaaaaagtggacaaaggaaatgaaaagacatgtctcaaaagaagacatacaagtacctatcaaacatatgaaaaatgctcaacatcacgaatcatcagagaaatgcaaattaaaccaaattgagaaatcttataccagtcagaatgggtattattaaaatgtgcataaacaacagattttgacaaggatgtggagagaagaagggaacacttataaacagttgagggaaagtaaattaatataacttctatggaaaatagtgtggggatgtatcaaagaactaaaactacaactaccatttgatccagcaatattacttcaggtcatctacacaaaggaaaagaaatcattatctcaaaaagatacctgcacttgtctgtttattgcagagctgttcaccagagcaaagtcacggaatcaagctatgtgtccatcaatggttgattggataaagaaaatgttatatatctaaaccatgaatactattcagccataaaaggaatgaagtcatttcctttgctgcaacatggatagagctggaggccattatcctaaatgaataacttacaaacagaaaaatcagtaccacaccttctcacttatgagtgggagctaaacaatgggaacataaagatggaaataatagacaccagtgatgcccaaagtggatatggttggaggggattgatgcttaaaaaattacctactgggtaatgtccaatattggatgatgaatatactaaaagcccaaacctcacccttatgcaatacattcaagtcacaaacctactcacgtgcatcctgaataaaataatattgtaagatatattactcataattcctcaaaaataggacttaaacataaaacataagcccaacaggttgaaaatacttgcaaatacaataataatctacaactaatttgatgttattccagtgccttactgaatggcatcagggcttctgaaagtaagccctatttttgtttcctgaagcactttaaggtaagattgtcttttaatatgcaaaataataaaaataattttgatagttttcacaaaatggttgtgaggaataaatcaggtagtaaaatgtaatagcagcaaagcccagtgtgtggggaagtttttttttttaatttttacttcctatgtatatttattactggactctcagtaaactgaactaatcatagtacttgaaaaaactccaagctttctgctatattaaaagaaaaaatatgtgagaatgaaacaattatttgctccacaaatcaggatttattaataccatttttatcccccacttaatgatcccccacttaatatagagtaatataaacacaacaaggaatgtttattttcatatccttgagccctcagcttgattttctggcccaatttaatgttttatgcatttgttaatctgaaaatattatttaatatgtattatgtgtcaggcactgttataggcactggaaagagtttctaagatgatggaacatacatgtttgtggggatgacatagaacccaaaacatataacatatactttcaggtggaggaagtgcaatgcgttacaagaaagcctgctaagctttctgagggttactggagggagcattgtacatactatggtcagggatcaccaatctaaggagctaacaatttcagagacctaagtaatgttgaaggaagtagccatgtggagatatgggagaagtgcattacagacaaagggaacaacacatataaaagccccaggtgggaaataggttgactttaagagagtaagaaagtctgtattgcatccagcacaatgaacagagaggaacagttaggagaagagaaataagagcagtgggaagtaatgaaaacatgtagagcattttaactttgtacagagactgtagttgagagttgacaaaatattaaattaatagtgaaatggatcaaattaatgacagctgagaagaaaaggaaaacagtgatatatgttaccaaacatgaaatgtccaaaacatgaagacataaacacaggcataggattgaattctaaaattttaaagtgctttagaattgacaaattacatgcgaatgcgtaatatgctaagtctcatgagtttcacaggcataatgtttcagtcttgactcttgtgaaacagtgtttgttggagttgattacatgggaactttcccattggaatcctatttgtctctttttccttagggggtttaaataatgacagaatagaggaaagtctgaatcatggcagaattatcttcccacttacatatgaaggcataatatctggtaaaattgattttggccaatgatgacgtttaataatttcatttaagataaaaaggataattttcaaacaattaaaacaaagactgcagttactatgctcactggaaaatagcctcatattattaaatcaattggcatgatctcagttgtggaaagcttggaaggggacagcagcgttgtaagtacatggcaaagaaaataaataatagtgtattatagaggaaaaccacatgaaaggaatcatgaataaaaagataatgggggtaaatttaaatgtaactgacaattgcaaaaatagaaaatcacttgtagcatgaagaacgtagataattttataatatatttaatgagattttaaatttctcagtgttaagttttagacaaagttttaaaataaatattttataattcttgattataatggcctcttgactagcaagtccctgcatgcagcctttcctgatgttttaatttacctataaagtcgtacaaacacacacacacacacacacacacacgaagcaaacgaacatggttactgaaaagtgagagataaatatactagtcagtgtctaactggaaaaacacaaactattcctaggtaattttaagaggaaatgtaaaatggggaagtgtttacacgagtattagcgatattaaatcctgaattaaccaaatataaaaacttcaagaaaacctattactcttacagatgggagaataggagaagtattggagttacaggaaccttgaagttcagagaagtaccacaaattgaatattcatatctcctaggaaagggcttgtgttggtgctgctgatacctttaagcatctctattattttcatattctaacaggaagtcacttggtaaaagaatctgaaaaatgtagtttgtagaatcccaaccaaaactgctatcacagagaaaaatatagaagactagctttctatctgagacataacatgcaaaccatctattggcatactgttagaaaaaattttgatggaacaggactgttaagagactgtaggtcttactttataaataaaaacaagacaaaagctttatatatatattctctgactcttctctaactctgaggtataagatatagtcatccaaagtactgactttctaactctgattttcaaccaaatattcttgcatctatccatacccatttagagagagaaatttccagaaatcagaggagcagacaggtagagtatgacttgtccttgtgaattgtgttctggtaaacagagtagagagaaaggaatatctgtaggaggggcagaaaaaaaagcccctatagctatccaaacttaggattattatttttgtgtgtgtactccaaggtacacacaccaaaactagaatgagaggactattaattcactctgtcttccatatgagaataggctcgaatatcactcagaggaaacccaaagtaggttaaaatttcatccatatatgaagtcttttgggtgaggtaaaggcataatagatcttagcatctaaattatggacaaataagtacaaaattgaacaccactgtgattatggaaaacaccattgtgtttactgtgaagcaaggaaaacaaaacatagacatagagattcagaaaattatttatgccagaaaaaaaaaatttaaaagtcaccaaatagtgtgaaacaaatacataagaaaggctggaaataaagttttgtaataatgccattaaaatggatggagatgggaattttatcaagtatgtggacaatttgagtactatacaagaatacaaacaaaatgatgagagataaactgacaattggaaaagaaagaatatggtggtctaacataagaatgaaaggtattttccaggaagaaattaagaattgaaacagaggaagtaatcagataaaattttttctttaagaagaaaatagaagatatctgggatctatacagctgaatctaatattttaattacagctaaagaaagcttgatactttttggcccactgttttcttaatatattcaatgaactttctcatatgttagccactagttatgtgttactatttaaacataaattttaattgatctaaattaaatacaatttaaaaataaatttgtcagtctgagtagtcacatttcaagggcttaatagccagagttgccagtggctactgaattatataatacagatatagaacacattgattactacagaaagacctactagacagtgctgttctaagaaattatttttagaaaataaggagagatgctcttgaaaatttatgtataagaagagttatcttaagaggacatgttaaaaaattcattaatattgtactactcaaataagttatattcataaaaattataaagcatttaaacctataatttagaaaataaatttatcacactagacaacattcttatgataatatgtaaaaatatattaataattaattgagatgctttcaattttggacaagtaaatggggcttatattttatgtaattttaatatataaaatcgatcgatgttcgttacatttaagtggcaggattattcaactgtttttctttatttttttttcctttgatgtagaggaattatttatagtgaggcatgttattttatagtcagaaacacttcttttaaacaaaattagcatatatttgcatgtgatgctgataaactgaacaaaatatgtgacattacttaaaatagaattttgagatggagagggtgctgctcatggaaaagtggttctgacagaatcgatgaactgtcatccgtgtgcgcacctgcggcaactctgctggaggcttttagctgaatcccagcggtgaccttcaaagttgtttttaggtatttgcattaaaattttgagaaaaacgttcctttgtttttacaatacagacatgccttgttttattattctttgcttaattgtgccttgcagatgctgagtttttgaacaaatggaatgtttgtggaaaccctgcactgagcatgtattggcttttccaacagcatatgctcacttcatgtctctgtgtgacggctgggcaattctcacaatatttcaaacttttcattattattttatctgttatgatgctctgtgttcagcgatctcttatgttactaatggaattgtctcaaattgccacaaactacaaccacataagtcagataacttaattgctaaatgttgtgtatgtcattactgttccaccaaccacccattcatctgtttctctgcctctcctcaggcctattctatgagacacaacaatagtaaaattaggttaagtaataatcctacatggcctttaagtgttcaagtgaaaggaagagtagtgcacctctcaggttaaatcaaaagctagaaataattaagcatggtgaggaagggatactgaaagctggccgggcgtggtggctcacgcctgtaaccccagcactttgggaggccgaggcaggcagatgacgaggtcaggagacagagaccatcctggctaacatggtgaaatcccgtccgtactaaaatataaaaaattagctgggcatggtggcgggtgcctgtagtcccagctactcgggagtctgaggcaggagaatggtgtggacccgggaggtggagcttgcagtgagccgagattgcgccactgcactccagcctgggcgacagagcaagactccgtctcaaaaaaaaaaaaaaaaaaaaaaaaaaaaaagcaagcaagctgatataggctgaaaaagttaggcctcttgtaccaagcagccaagttgtgaatttaaagaaaaatttggtgaaagaaattaaaagtgttacttcagtgatacaaggaatgataagatagtgaaacacccttattactgatatggagaaagtttttaacagtctgtataaaatattaaaacagtcacaacattcccttattaaaaagcctaacccagggcaaggccctaagtgtcttcaattcagggaaggcgggagagaggtgaggaagctacagaagaaaagttcgaaggtagcagaagttggatcttaaggtttaaggaaagaacccatccccattaatagaaaagtgcaaggtgaagttgcaagtgctgagtagaagttgtgacaagctatccaggaaaactacctgagatcactgctgagggtaactacactaaacaacaaatgttcaacgtagacaaaaaagccttatattggaaaaagacatcatctaagattttcacagctatggaggagacatcatagactaaattcaaagcttcaaatcacaggctgactcttgttagaggccaatgcagctgatgactaaattgaagccaatttgaagccaattcagaataccgttctgaaaaccctgggggccttgaagaaatatgttatttctactctgcttgtgcactataaatggaacaagtcctggatgatggcacgtctggttacaggatggtttactcaatattttaagcccactgttgagaactgctggtgagaaaaaaagactcctttcaaaatattactgttaatatacaaagtacctgcttacccaagagatctgatgaagaggtgaaaggagattaatattgttttcatccctgctaacataacattcattctgcagtccatagaaaaaggagtaattataactttcaatattattaagaaatacattttataaggctatagataccatagatagtgattccacttatggatcttggcatattgaaacattctggaaaggattcaccattctagatgccattaagaatgtgtggttcatgggaggaggtcaaattatcaatattaacaggagtttaaaagaggttaatttcaatcattatgaatcattttaaggtgttcaggcttcggtggaagaaggaaatacaaatacggtagaaataacaagagaactagaattagaagaagggcctaaagatgcgattgaactgctgcaatctcatgataaaacttgtatagataaggagttctttatgaaggagcaaataaaatggtttcttaagatggaatgtacttcttgtgaaggtgctgtgaacattgttgaaataacaacaaattatttaaaatcttacaaaaacttagttcatgaaaccatggcaggcttaaagggaattgccttaaattttgaaagaagctccactgtgggtaaaacgctgtcaaacagcaacacatgccacagagaaatcttgtgtaaaaggaactgtgcaccgatgtggtaaatttcattgttgtgttatgttaagatttggcacagtctctttagcattcagcaaccaccatcctgatagccagcagccatcaacattgagacaagaccctccacaagctaaaagactatgacttgctgaaggttcagatgattgttagcatattttaacaatgaagaatttttcagttaagctatacatactgtttttgtagatataatattactgtggacttaacagaatatagtatactttaaacataactttatatgcactagagaacaaaaatattttattgcagtggtctagaaccaaacctgtaatttcaatgtaagtcttcacagtgttcttttgtcagcatggtacacaaagatgtacttacatataaagtgttctaatttttcatataaattgtaaataaatgtggcaaatgttcacagttcttaaattaaggacaaaagcaaatattatataattaagttcatcttttgttcatgtttatatatttatattttatatatgcatagtaatttctttttgaggtttgtcttaaatgagtaaaaagtgtttacatgagtgaagtgtgggttctgtacacgtctatatgactaatgttcaaattgtatgaatacccatacatatataagttatttatagtgtgaatatatgcattgtatcatgaaatatgaataagtttataatccatgctataaaatgatacaaattgtattactactttatagcattaatgtacacaaatatatttaatttaccaaaaatataaggtaaaagtaaataatatttttgtgaattttgaaacattgtggtgtgagaagcactagtttgctattgtggttaaggcacatttttatattagaatatattgagtttaaaaatagtacagaatgtttaacatattagcagtaatttctaggaaaaacctttatgaagtttagtataaatagaatataaaaaataattttaaaatgatgtgatcagtcatcaaaagcatctgatatataaacaataaaaacacaatcttaaactgttataatttacttggcttgcaaatattttataatataatatgtatacatatattatacatcaaaatttatttttgatgatatgcttttagtaacttattcctatgacaaatttggcaagtaaaaatcaaaattattatctaattccattaacatgcaaaacatatcacaaaattagtgaaaacctaatttgaataagcccacatttaaatgagaattgctaggtcatactaatcaattaatcaacctctcaatctagaatgtattgaacaaatgagcctcagcaatactgcttaatacttatggtccattaagcaagaccaggtgaatgaggcaatcaaaatattttaatagtgtatccgatcaggagatagtagaatactaaatgatctggtggttatttttaacaatatgttgtgctcttgagaagtaaatgaatcttggaggattgtcagctggaatccaaactcaatgtatcattttaaacagtcacttaatttcttgattgttttaacctgaataaatttaagactgtagcaattttagacaattatccaaatctaatgtctatggtcatttcattccatgaagatgaagtattatgtatagcaatgcttttttcaaagaaaaatgaattatacattagaaattatatgatcacttataataaggtattaaacaatgagaaatttactgtaaagatggcctagcattctaaaaaatgccaataaatatttgtcaaacactcttctagttgctcatttttagggatgatcaaaacagacctgaaaccagatgatgagacgggctggagcaaaggaagggagctcctttaattagggtaatcacagaaggcatttttgaggaagtaatagttctgttgacatataggaaataagcaggaatgcaatgaaaagagccatatgaaaagccttttagtctgaaagaataagaaatgcaaacgatctttatgagcatggagctagggatgtcaaagtgtaaaaataaaccagaagctggaaagataggccaaatacagaaaatatagagttttctgggatgtggtcagaagtttagatgtcatgctaaggacactgacatgccagtaggttaaaaatattatctgatttaaatatacactaaaaatattctgacttgctgtgtggagattgaagagtagaagcaagagtagaagcactgagaccaactatgaaaggttttacattgtctccattgagagatcttggtaacctttactgaggatgtcacagctgaattagataatagtggataagttcagtttatatttttaaatagaataaactagatctgggggctatgtgtgtggtagttgagtaagagaaaggaattaaacaagtatcttaatattttcctttagtaattaggtaaattgaaaatactaagagaagataaatgaacattagatagtatgggggatagttataaagcagaaagtgttttatttctgacttttgtatttaattcatctcttaaacataccctgatagggatacataagaccaacttctaaataagtcaattacaggaaaaaaaatttagttattggcatgcagatggtatgaagcatatttgatgctaacattttttctttacctccctggttttgtgatacctcactgaggtaagaatgtgttttttgaatgtatgattttggttttggatatgtgagtttcttcagcaaaacaaaaacaaaacatgagtagagatgacaatgtaccagttgtaagctgaggctttattagacatcaaatattttcactcattgggattttgccatttgtcatgagaagagcatactctgggtacctgttgatcctgaaatgaaaaacacatgaatcagacttcaacctagtcccaggcctaagtctttactctagccactcaagatttgtgagaaagacaaatcgttacagttctaaatcaccaaacttcagatgtctcaccagaaatactgttaaatatgtgtcatataaacaatgaattctaaataaaatcatctagcctagaatggagaaaaaaattaaagaggaataaggagtagggcaatctatcttttgtggtcgggtagagaagagaaaagggtagaaaaatcttgcaaaataccaaggatccaaaatgaaaacaaagcaagtgaacagtgatagaaatcaagataacttttttttccaaaaagtaaaataagacaacttcagaatgctaatgagaggtggagaaaaatgaagacagagaagttatttctttattatgatctcagcaagccttaatttacatagaagatatatcttccaaattttgcatgatttgaagcacataaaatattttagggggctcataatcttcaagtaggtttatatggcatttaaatcaagaaacagtaaagctgtaatcatttctggagatgtttagacatataagcacacatacatatatttggatggtaggcatttgccaatacaggaaacatggttcatgctgccagatttgacaaagattaaaacaatggttccaaataaaccggaatgttgattttcagtagaggaaaaatagagaaaattggtgattggtaaaaccatacagaatagttcacaacctaaattatcttggtgattaaaatatagtagagtgtttgccaagtctgcttgtaaagatgctggagtattagcagctgaaaagaaaagataacattttcttctactgagtttagagaaactttttttcagactaagaaatgtagctttcaagtattaagaaatataccatgagatttacaatatttttttccttcatttgtgaagcactagacaaatctttgtttacatctgtttctgaattccagtgaaatgaaatagcacagaagtcaaaaacaataattgtattagtctgctctcatgctgctgataaagacatgcaagactgggtaatttataaagaaaaataggtttaatggactcacagttccatatggttggggaattctcacaatcatggtgggaggcaaaaggtacatcttacatggcggcaggcaagagagaatgagaaccaagagaaagaggaaatcccttaaaaaaccatcagatctcatgaggcttattcactaccatgagaacagtatggggaaaactgcccccatgattcaattatcttgcactgggtccctcccacaacacatgggaattatgggagctacaattcaagatgagatttgagggggaggcataaaggcaaaccatatcaataattgtatctttcttcctctcatctataagcctccatattgatgtgatataatcctatagccttgggaaaacctctctgcaaaactatttttttaaactttttataggctcagatttttgcatttttatccttattgtttacatcaaaaagactacttgcgatttttaatgactgtgattttatttttaaaagtatcaccaaatccagaaaaagaaatattggaaaaaaaaattcactcttcattaggtacatttttaccatgtacctaccatgcactagacactctgctaggtagtgagggtaacactgtgatgataaatgataatatggcttgaacccagtgggtggtaattgaaacatgagggcatgtttttctcatgatagtgaataagcctcatgagatttgatagtttataaagaaaaattccttgcacatgctctcctgcctgtcaccatgtaagatgtccctttgctcttccttcgtcttccaccatgattgtgaggtctccccagcatgcggaactgtgagtccattaagcctcttttctttataaattactcagtcttgagtatgtctttattagcaggatgagaatgaactaatatagtaaattggcaccagtagagtggggtgctgctgtaaagatacccaaaaatatggaagtgactttggaactgggtaacatgcagaggttggaacagtttggagggttcagaggaagacagaaagatgtgggaagagttggaacttctcagagacttgtggaatggttttgaccaaaatgctgacagtgatatggacaataaagtacaggttgaggtgctttgagatggagatgaggaacctgttggaaactggaataaaggtgactcttgctatattttagcaaagacactggtgacgttttaaccctaccctagagatttgtagaactttgaacttgagagagatgatttagggtatctggcagaagaaacttctaagcagcaaagtgttcaagaagtgacttgggtactgtaaaatcattcaattttatgtattcacaaagatatggtttggaattggaacttatatttaaaaggcaagtagagcataaaagttcataaactttgcagcccaatgatgcaatggaaaagaataacccattttctgaggagaaactcaagttggttgcagaaatttgcctaagtaatgaggagccaaatgttaatcaccaagacaatggggaaaatgccttcagggcatgtcagaggtcttcatagcagcccctcccatcacatgcccagaggcctaggaggaaaaaatggttttgtgttccaggcctagggccatgctgctttgcgcagtcttgggacttgatgccctatgtcccaggtgtggctaaaagggggcaacatagagctcaggccattgcttcagagggtgcaagctgcaagccttagaggcttacacatggttttgggcctgcaggtgcataaaagtcaagaattgagatttgcatagatttcaaaggatgtatggaaacacctggatatctgggcagaagtttgctgcaggggcagggccctcatggagaacctctgctaggtcagtgtggaagggaaatgtggagttggagcccccacacagagtgcccactggggcactgcctagtggagatgtgagaaaagggccactgtcctctagacccaagaatggtagatccactgacagcttgcaccatgcacctagaaaagacaagacacaaaatgccagcccatgaaagcagcttggaggggggctgtaccctgcaaagccacagaggcagagctgcctgaggccatcggaacccacctcttgcatcagggtgacctagatggaagaaatggagtcaaaggagatcattacgaagctttaagttttggctgccctgctggatttcagacttgcatgagacctgtagcccttccttttggccaatttctcccatttgaaatgggtatatttacctaatgcctgtacccccattatacctaggaagtaactaacttgcttttgatttttcagcattataggtggaagggacttgccttgtctcagatgagactttggacttggacttttgggttaaggctaaaatgaattaagactttggggaactgttagaagacatgattgattttgaaacttgagtgcatgagattttgcaggggccagaggcagactgatatggtttggctatgtcctgacccaaatctcaccttgaaatgtaataatccccatgtgtcttgggaggtacagagtgggaggcaattgaatcatgggggtgggattttccgctgtccttgtgatagtgaataagtctcatgagaactgatggttttataaaggggagtcccctgcacatgctctcttgcctgccatcatgtaagacatcccttcgcttttccttcatcttctgccatgattgtgaggcctcccagcatgtggaactgtgagtccattaaacctctttcctttataaattactcagtctcagtatgtctttattagtagcatgagaccagattaatacaaaagaacacagaatttggcctcatttaaccaaagtaaaacagaatcaaacggaaatataaccatgaaagttttacaaggatgcatatatagtgctaaggaatatgatatgcataattggcctactttgtgaagtcacaggatctttgctcaggaatcaacaatgattgagttacagagaaaaatctgaattagatacatgggatagcagagaaaagtggatttgtcaggaacgagaagatatcacagtaagaagaaacatggtggcaccagcttaaagaactaaaaacggtcagtttgtctggataacaaaacataacagaaaacacgtgaaataaggatgaagaagaagtaagagtcagggtacacagcaactcacaacagaacagctaaacggaagtgattaagagtacagacctaaggacgacatcaacaatgatggtaagaattccaaaattcagtccctctacaaaagcaatgataaatttaacaaaacctgtcagaatcaactgttttaaagctctggacctctaatcaaaacctcacaataaataggggaatgtatgatgatgaaagaaactgccgaccagcctgaccaacatggcaaaatcccatctctactaaacacaaaaaattagctgggcgtggtggtaggcgtctgtaatcccaactactcaggaggcttaagcaggagaatcacttgaacccaggtggcggagtttgcagtgagccgagatcatgccattgcactccagcctgggcaacagaatgagactccatctccaataacaacaacaagaacaagaacaacaacaacagaaactgccaaatattaacaagagaacatatgacattttaacttaccttctatcatcttccagtctctaacttagtgctatttgtggagataagtggtctatattcctagtgtgtctagcttgtgccagaggaggcaaaaatgactgttttcaaagacatatgatgtgtgttgatatgtttggtgggttgctgagggattggatctgaagtttgcctttattgagaatattgcctagaagtattctcagtctaagaacagcaccttatatcacatttggcaaaagcatttatagcaaagtacactaccacagtagtctaggacaatggataccatccaggtcaagtagcagacagatgaaaaagcctcggaaagaagagactggggaaggaaattggcaggctgcttttcagggtccctccactgtggtaccagttggtccaccacatataagactgtactcaacctgggcagctttcctgtcttggagtaccagctcacaatggatactaggctctgatctcccttgctgcatatctgtaagtaatacattcacttaaggtaacttgtacacgagtgtcctgtctcactagactcagacaagttggtaaccagtgcacaatgaagttgcttgacaagatgacttgagtaacactacaaaccagacctaacagacatgcacaggatagtccatccaacaacagcaaaataccaacaacaaaatacaaattcttattaagttcacatggaacatcctctatgtattaggccacagcagtctcaaaatattaaaaaaattgaagtcatacaaactatctttagggatcacaatgaaataagtatagataaaaggaacaaaaaagtagagttcataaatatgtgaaaattaaatgacacactcttaaccaatcagtcaaagcagcaatcacaaagtaaattctaaataaaaaaatatgttgagacaaatgaaaaagatatacagtatgccaaaacttacagactgcggtaaaggagtacttggaagaaatttctatcaataagtacctacattataaaagaagaaatatctcaaatcaacaacctaatgttacaccttaaggaatcagaaaaatagcaaactaaacatgaaactgaaaggaagaaaataataaagattagagtggagataaatgaaatcaagaaatgaaatacgatagagagaatcaacaaaactaaaagttggttctttgaattgacaaacctttagctagattgactaaaaaaaacagcaggagagaatactcaaatcactaaaattagaaatgaaattgcagatggggacattactgctattttaacagaaataaaaggataaaaggatttataagaatactaaggaatacttagttctatgccaataatttatataaccaaaacaaactggacaaattcttgaaaaaatacaaactaccaaaaatgagtcaggaagaaatgcaaaatctgtccggacttaccataggtaaagtgattgaattcgtagtcaaaacctccccaaaaagaaaacacaagacgagatggccacactgacaaattctatgaacatttaaagaaagtttttcagataatatcagaaattttcagataatatcaatttttctcaaatagaagatgaaagaatactttctagctcattctgtgaggaaagtgttacccttaataccaaagtcaaacaaaaggaacaaaaattatacaccaatatatcttatggatatagttagaaaacttttcaatatatgtataatatatagaaaaatacagagaattgaaatataataatcaacaaaactaagtctaaaaacttttacaagaaaactaaaaactaattataatgtattgaaaatatttgaatctataatataatatataattataattatatagtatagcaaatataaagcagcatattaaaaatggtaaaaacattgtataccctcaccaagggggatgtatcccagaaatgcaaggagtttcaacatagaaaaccaatccacataggctgggcacggtggctcacgcctgtaatcccagcactttgggaggtcgaggcgggcagatcatgaggtcagaagttagagaccagcctggccaacatggtgaaaccccatctctgctaaaaattcaaaaattggccaggcatggtggtgggcatctgtaatcccagctactcgggaggctgaggcaggagaattgcttgaacctgggaggtggaggttgcagtgagccaagattgtgccattgcactccagcctgggtaactagagcaaaaaactccatcaaaaaagaaaaaaaaaaaaaaggaaaagaaaaccaatccacgtaactttaattgaaagagaccaaaaaactacatgatcaactcaattgatgaagaaaaaaataagatttgcaaaaatccaatgcacttttgtaataaaaacactcaagaaactacgaatacaagggaacttctttaacatgataaagagcatttgtgaaaacccacaaatatattatattcaataacaaaagatggaaagttttacctttaatatcaggaactagacagagaaatctgtttttaccactacactggaagtttaagacagaaaactatgcaagaaaaacaaagatatctctattagaaataaaaattaaatctatttatatttaaagacttcatgatgttatatataggaaattcttaagaatagtaaaaaaatctattagcattaatatgcaaattcaacatggttgtagaatacatatcaacacactaaaatcaattgtgtacgtatataccagccataaacaaatttttaaaaattaaaatctcaattccattgcaagaacatataaaacatttaaatatttagaaataaacttaatcaatgaataaactaaccaagaaggtgtaaggctcttacactctaaactgcagaatattactgaaaaaaaattaaaaaactaaataaatgaaaatacatcctgtgctcataatggactcattaactcaacaaaaagacaagcaaccaatttaaaaatggacaagggacttgaacggacatttctctaaagaaaatagtaaacaaatacataaaaatatacccaatatcaattgtcaatacggaaatccaaatcaaagccacagtgagatccacttcatcctgagtagaacaacaacaaccataaaaacctgagaaaaaacaagtatcattgaggctgtggaaacattatgaccttcatatattgtttatagaagtatgaaatagcgagaccgctgtggaaaagaatgttagttcctaaataagttaaaaatagaattactgtatgacccaagaattttattccttggtataaactcaaaagagttaatagtagttgttcaaatcaatacttttatacaaatttagtagtgctcttcacagtagtcaaaaggtagaaacgcagtcatccaaatatccatcggatgataaatagacaaaatgtggcataacaaacaatggaatattattcagttataaaagcaaaataagtggcctagtgcagtggctcacgcctgtaatcccagcactttgggaggccgaggcctgtggatcacctgagatcgggagtgagagaccagcctgatcaaaatagagaatcccatctctactaaatatacaaaattagctgggtgtggtggtgcatgtctgtaatcccagctactcgggaggctgaggggaaaaacaacaacaacaaccaaaaaaaaaaaaaaacaagaagtactgatacatgttgcaacatgaaagaatttcgaatgtgaatatgacatattttctgaattattccacaatatatgacatgtccagagtatgcaaattcagagatggaaagaagtttaatgattacaaggggctgagaagtaacagttaattgggtatgagttttctttgtgaggtgataaaacagaagacaccagtttatgtctattaggagggctattatttaaaaatacacatataagaacatgaaataattagaattatctgcactgcttgtggaagtataaaacgataaagccactgtagaaaatgatatggcagttcctcagaatattaagacataaaattgatgtatgatcatattgatatatgatcaagcaattctacttctaggtataaataaacgaattgaaagcaggaactcaaacaggtatcttaacactaatgtttataggagcattattaataatagacaaaagcttaaatatctgaaatatccatacattgatgaatgaataaacaaaatgtggtatagccataaaatggaatattattcaatcttaaaaaatgaaattatgatacatgatacagcataaatgaacttagacaacattatgctaattgaaataagccagacaaaaaaaggacagatattgtttgattctacttatataatgtataaattgaaattcatagagacagaaaatagaagagtggttaccagaggctgtgggaagggggaaataggcgactattgtttagtgggtagggagtttcagtttgggatgattaaaaagttctagtaaggaataaggatgatggtcacataacaacgtgaatatatttaatactactgaattatatgttttaaaatgggttaaaatgttaagtttgatgttacatatattttaacacaattttcaaaaatagatgcatccataaaaagtctatagctagcgcagtctatgtggaaacaaggatatccactttctccatttccatgcaacatcgtactggaggtttttaaatggtgaaataagacaaggaaaatacagaaaaagcactcagattgaaaaggaaaaaataaaagtattgactaatgacataattgtctatgtggaatatcctactaaatctattaaaaatactgaaactattacatgtgttccacatggttataatatttcagtaacattaaatatatagtaaatctgacaaaaatatgcaagacctacacatttaaaacttcaaaagactgttgacagaaattaaagaatatctaaataaatagatatattgtggtcatggatcattaataatacttttcctcttttacactattggcttttctctaacaatttgatcctaacagcttttaatcatggtgaaaaccctaccatttgaatcaatactttcagatattaattctccacaaattgatctacagattaagtatagtcccagtgaaaatcctagcaggtattttatagaaataggcaagatggttttataaatcatgtgaaaatgctacgaaaaaaatagtaatacaattggagttctaacactctctgacttcgagacttgttataatgctgtagtaatcacaagagtggtggtattggtaagagagaaagacacacttgttaatgacacagaatacagaatctacaaataatctagttacatggtcaattaattttgacaacagtgtaaaggcgattcagtgggaaagagcattttatcaaatgatgctgggagaatcagattgttgtttcaaaaaaagaaagagccagtcttaatccataccttgcaagatatacaaaaattaagacaaaatggattatagacctaaaagtaaccataaggaaagaagattcttgagagtagacaaaattgagcaaagaaactggtagaagaaaaaccaagacaacacaatttcactgaagccaaataaacagaattgacttttaaaaagaaaagaatgcttcattggataatgctgaaatgttttaaaagattaagattagaaagtgtccagtgtatttagcaagatatggaccatttgaacaactagtgttgcggctagataaacaaaaaagaaaaagaaaaaaaggaagcaggttttagacagtaatttttagaaaacaactttttcgttgagcaagagatttatagggagacagcatagcaaggatgttgtttttgtttgtgttatataacagtagagaactgagcatggaacaaaaaagagcttttggtcctaaagctcttaggaccaaattggtggagaaaagtcaattgtatagaaaataacatgtactattaataaacgaagttacagaaaaaaaaaagtggcagaatccggagccctttcgggaaattagacagaaagaaggttctctaatgtaagagaagacaagagtgcagatgggtgtggttttagattgaaagaagagagagaagttcatggatagtgagtttatactctttctaagactggagctgggtggcaagttgcagaaatcagaggagggtgaagaaaagtgaaaaaacataatgttgaagaaagtgacaatgagtgaaactgagaagtctcaagtgtgatatctggacagtttgctgtgtccattttagatatgagatgttgcatttactgcaagacaattctcctttattgtgaggtaatacagttttgtgtaattgcccagttgaagaagcagaataaagtgcacatgggtcttgccagagatctatgacacatacataaataatccacgggtcttaggggaatgtttctaaaataatcaaccatttaagtaataaggggaaatgaaaagaaaacaatggctgacagactgttagaaagtataggggtcaatgaactatgaaaagtgaatatttatacaataaccacttgagtaataaagggtagaatccatcacagacagcttgcagtttaaacaactgttcttctaataacacaatagaagtaatctaaagataaattaagtgatcaaatccttaacagaaggagtcacatttcttgccattttttactttcatgtgattttctcctagattacactgtgttttgttccataactggacagattttaaaatccaataaagaaaaaaataaaaataattggcgaatagcagagcatccagaatgattggtccaggtttagcaaccatctatgaggtcaatgtgttaatacaattacccatgtataatacaattattcatgcatacaattagttttccccccagaagattatttttatacaatgccatacattttaatacctctttttaactttaatatgagttgctaatcctcgtcccttaaaaatgttttcagagagaaaaatttactgtcttggttaaatgcaattatcaacaatgcaaaatttattttcatgtcttttttttcctagagagtctgtatttgaacaatgggcctatctcacatgtggagggcctcccctcatttttcacatactcctgagttacaacgttgacaattatttttctttgagtcatatcttttttcagagagtaaggcctgaaatttgtctggaatatccctcttttatatgagtagaaattttaaaatttgcagtagtaatatgcatgtcaaagctatcattgttttgggaaaaaaatatttcattgtgttacatggcatgctcttaattgtacaggtgaagtgatgttttacttttactggcagtatttaagaaaaacaaaaagtgaatatatatttcatactaggcttaataactgggtgatacaataatctgtacaacaaacctccatgatactagtttacctatgtaacaaacctgcacttgtaccccaaaattaaaagtatatatatatgtacttttatatatatatatgtgtatatatatatacttttatatatatgtatttatatatatatacttttatatatatacttttatatatatacttttatatatatattttatatatatataaagaaaatatatatatattttcttttcagacatatatatctgaatttctgttgctttttaagcaataatatcctgcatatgattatttttggcttatttctctgtgtattagatcagaaaaaataaaatatataaaaatcacacaattgtgtatgaatatatgcatgtatttatttgaatgaaatccattcattaaaacagttaaattctaaaattgttctatgtcgctcaaattccctctctgtggtgttttattaaaagagaggattggggagagactctttacctaattatgaaataatacattgtgttggcagagaaaatcatcatgatggctcaaagccaataaagtctgtatcacagatttcagtttttttcaccttgaccataaatacacaaatggatgaacagcaaaggataaatgtgctatcaaggtttgagaaagttataggtacaggcaagtttttcttctggagtgttgcttaataattaaatttaataatgaaacattgatagatatcctcttagtgaaaatacatcatctcctttgaaagactccagtcatgggatatatttataattccttaaatccttagttaccgagaaatatgcaactatgcagtcatatgatttaaaaacaaaaggcactctaaatcaggagaaagcaagtagtggtatgaatagttcccaagtcttgtggttgaaaaagatataaaggcttctcctgagattaagctggaaaactcacatagcaattagtgaatccaatctatatgccagtgtaggcaatgccactattgtgtgcaagaccatatctaagtgtttatatttctttttaaaatgttctatatttatctataaaatacactatgtaagtaaaaaagcaggtctgtagaagatatgatacattatattatatacagtttcttcagccttctcttttctgaagttccaagagacatattcctaatcagtccaagttgcatatgtctatgtttatgtctctgtatttgtgcaccattgcatggtggagctaccagaactgtgggtgcagatataatgtccaaaattaaaatataaatccttactacatgactacagagaagaaaaaagtaatatttgatttcccatcaaatcacgcatgtggtactttcggagaacaaatattgcctaaaaccactgtgatctactgtattaatggactcctcaaaagtgactactttcttataattaatctttcaattattttccaaaattcttaaagtccaaatttcttaacatgctctataataataaggataaaatctttttttatgcctcagtctcatgcttaaacgtttgagtagttttagatttgctgaaaagttacaaagattgcaccgagttcccatatacccctcacccagtttctcctcttattaacagcttaagatctggcatttgtcacaattaatgaaaatagtgatttattaactgaagtccatacttgatttagcttctgtttttacctaatgcctgttttcattcccatatagaatacattatactatttccaaattaggtcatattctaaggtactggaagttagaacttcaacatatgaatttgggtggggagtgataatttgacccataataaccctcaaggttctaggcaatcactaatcaacttataaactgcctattctagacttttcatataaatggaatattatagatactgtgactttttcacttagcatgttttcaagatccatcaatattgtcacatgtgtcagtactattagtctgctcctgtgaatttttcatttcagttcattaaagaatttcctttgtatttcttatatctgtatcttattgatattctccatttgatatgaaattgtcatcatgccatcctttatttaatcttagtgtcctttaattctttgagcatgtttttaagagctgctttgaagtcttttttggctaaatttaccatgtaggccccatcaaagacagtttttcttgtttgctttttcactgtgtatgggtcatattttcttgtttctttgcatgtgtcatatatttctgttgcaagtgggatattttcggtaatatgttgtagcacctatgaatacattacccacccctccatctggcagtggttattattgctgccgtttgcttggtcatttgtttgcatagtgatttgactgaattaactctgtgagggatattttccttgcagtgttttccctgatcatattttccccttatttttaatctttgagtctaatatctagaggttgtcccaggaagaatatagctatttattgttgaaacattttgcataagctctccttagccagttggagttttacccttttactgttggatatgtgtgtgtggcttggaggctgcaatcattatttagggagtttatgtcagtctcacattcaacagactgccagcttggaggttccttctcttattgtactttaaagggtgcagccttgttgggcatgtacagtcttccagaaagctgaggataagtgttattttatctttacgtttagcttctctagtagctacctccatgtcagaataattaactgttcagtcactgttttgctagaagttgtgtttaagctccttgtgtctatgaggtttctaccctgtgttgatgggtctgcatgtagcttggagaatgttttcattttcatgccttgacctgctcagattgctcctgagtgagggcaacccagcacatgcacacagccttccagaagccctgagttgactgtgatctccaaagggacatcctgggctgtctctcttcctgattctatcacatttccggctgctctgttgttctgtgtatattatgggtctactagcctcttcttagtcactgcccaccaagatcttcattatttattaatagtgtccttaggcatggaattctatgctttttgtaccaagtaaacccagtcatctcagacaaatctgcagagctctttgtcatacggccagcctctcctgtgggcagaacctcctgccacagcatcagagctgggtggagggaaccattttttctcaaagtggtactccggctctaagagtaagcagtggatggaagtggtgttattatttcctggtctttctggtttgttctttctatcaaggaactcctacattaccagggacctgggccacaggcaatcaaagtctcagatttctttgcttgctatccctgaggaggaacttcttctctaccagtgagggctatgtagatatcattagtttctatatattgtgaagtgatgtagcctttggagctctaattgaagatcaccatcatttctacagcattaaaacacatttccaatttgaatcagattaattgatttgtgattttatttaacatctcctttcttaccaatcactacagttgatactggaaatgccaagatgaataagacacacagaatgcaaagtatttataatccaatgtaacagatagatattaaaaagaaacacaaactatactatttatattgtcagttagcaggcataaatatgtacaaagtgtttgtataatatggagatgcctctgtgagatatgttgatgccaaagagaaacaatctcattaattgaatttccaggatttaaagatactacatagctagtgacgtttgatcttttaaaatttctgcaggaatttactaataaattgggagtagattgggtaaaaatgcctgcaagtaagaatatagaataaagtcacagaggaatttggagcatgatgtgttaaaataactaaaggagttcagtatggctaaagccatattaggggtgggtgaagaatattttaaggttcattaaagttttatctttgcagcattaaattgtcacagaaaccaagatgcattggctagcattgcaagaaaatattcagtatatgagcctaagctagatgttctgccttaaaatattggtggagaattttgtagttgtgctattacagaggatgtcaagatttcattcttcaacatggaaaatagtataactgatttactttgttcaagtttctcttaaatatgcagagaggttgtcatccttaatagtactgtgactgagccacatttaatctactggaagtaaattgaaataaatggaatatgtatgacactatgaagagttggatgtatacatgtgcaatgaaaatatgtggataaactgcataagacacaataaggaaaaaagctataacaaaagtagttggtatgaaggtttggcaatttttattctatagttatttcacatatcatatttctcctttatatagttcataatgccaagaggtacaagctgacagctacagtaggaaattgaagcatgaattaggtgatgtagattgtaattccagctctttatgacaatttttgccactctgaacaagtcgctaatcttcagagtttgagcttcaatattttaagatggcaaaattatgtgattctggtaatttacattctagattatttagcaaaattttccttgatttttgaattatgtgtgcacctcttaagtaacaaagcaaaatatatacattgtagtactttgtaataatcattattatgagtagcattaatttgttagtttggattatatcagcattgcttacatatgattaatgactctttaaagggaaaaaaaatcttgaggatcttaatattaccagaatttctattatgttacttaaaatgtacaaaaattttggcatatatttcttaggcttacatatgtgattctgctaatttacatgttagattatttaggaaaaatttccttgatttttgaattatgtgcacctcttatgtaataaagtaaaatatttatagtaatttgtaataaatattattagtagcattaatttgttagtttggattatatcagcatttcttacatatgattaattactctttaaagggaaaaatatcttgaggatcctaatattaccggaatttccattatgttacttaaaatgtacaaaacttcaggcattaggtcatattctaaggtactggaatacatttcttaggcttacatactcaattacaccataacctaaaattacaaagtaaatataaaacccgtaaaatgggtctggcacggtggctcatgcctgtaatcccagaacttctggaggccaaggcaggtggatcacgaggtcaggagttcaagactagcctgcccaatatggtgaaaccccgtctctagtgaaaatacaaaaaattagccgggcatggtggtgcacgcttgttttcctagccactagggaggccgaggcagaatctcctgaacctgggaggtggaggttgcagtgagccgagattgcaccactgtactccagcttgggcaacagagtgagactctgtctcaaataaaaaaaaaataaataacagtatcattttggcagatgatggtttgtggctaccaaatatatgcttataacacctttatggtactgacttcagtggtacagtttcttttacatttaataggtagaaactttcatgtactatgactataaagcaaagattttactgttttcctcaaagctaattactgtgaaactttcgtcacagcaacttaggaccacttttcatctttgcctgatgcaagctaagcatttgtagattaaatctctctttatcttttctttggccaatacaatgaatgtggtttctgcttatgtgagtgttcaaaaacataaattaaaatgaatatactgaaaatgattaagttgggtataaggtcgtagatgtgctgaagaccaattttgtttatgctctttttctttcacttgaatatattaacacgtttttacatttatattaaatacaaaatgaaaatctaaaatataagcacataatagagaactgggtaaacctgggtaatacatctacattttccaggagtaagcatatgcctttacgcgaataaacgaaagccaaataaatttgtataaaaattagctctgcactttgctcactataactgtttttgcatatacccagatactattcaaacatatacaagtcaggggcctcttataaagtctatcatcatgaacacttaggacactacttgaactacaaagtataaggaatgttttagaaatatcattacattttagaacattctctagagacttgaatagtataggtttgtatcattataactgaatgcagatttccagtagaccttccacactgatctcagatatctaaaaggagagggatttgtgccatttaggcaaaaggggattaaagaagtgacagtaggaaaaactgaaaataaagaaatactccagcctgggtgacagagtaagaccctgtctcaatcaatcaatcaatcaaggattgtggtagtgctataaaccacatttgtataattgcatgggcaaacagttatgcttttggtgtctgttcctcatttacgattctgataaataatggtatgtccatctaaggttattatgagatttaaatgagttcataagcaggatctgctgtttaggacccattgctaacattgaaatactgttatacaaattcttcattttttgaactagtaattatagatggaatgatgtatgggtatgcaagaaattgatatcatacagtgtatttggtaaaagaatgaacatttaactgattacagtgaatcatggcccattttggcaaaagaaaaatggtaaaaattaagacagtaaaaattactgatttgtgtttcaaatgatcacaaaatggtcatgtaaaaccataaagtacagttctctttcaattaccaagatttgttcatagtaatggctttaggtatatgtatatagatggaaacatttttcttttttaccaaagtttgatttcagaactttaaagtctaacaatgtgaatactatattatacaaaaagtagtttgctatacttttattcattttctattaattcctgttatattttttactctcaaatactattatgtaaagataattgccaaacaaggtatataatccttttaaaaatataatatatatataatatatgtaatattcaagataggcacaccaatacatgaatcaataatactagaatcactttttatccattttcaattaatatttcactgtcacttgtcagaagaaataatccaaagcatcatcatgattatattgaaaagttatctcattttgatctctgaagcgctgggtttgaatcctaggtttgatttttagtaattttgtgatcatacccaaattattagacctctttaatcatagtgttctatttctgaaatagaagttaatgccttttctattctttgtgtgtgagagagggagagacagaactaaaaataaagtgtacgaaagcacttttaaaaaataatgatccaccataatgttgttattgctattatgactaacatgataatcataatttatggttacattcttgaactcctctcaaaagaaaattaaaattcagagcaaaacctttccatatattgctggttttaaatcttattcaatggcaaaaggtaggaatagccaaatatttttatgtcctgttccacaaaatttcatttaaaagtattagaaataccaataaataaaacacccaaattttggtaacataactgaagatgaacaaatgctacaatgacaagtcagttacatgattaatataaaattacaatcatattaatatgcttaaaaaagttattggaagaatgataggatgacaaacagctgccatattcttctcattatagttcaaaaaataagagctgagaatatcataggcttactaaaattgagcttggctaaaatattttgtcaggtaatctccattttattgcccttaatctccattacatttctggtttaaaaaatgtgtaaaaattagtctgcagaatgaaaaactcatagacacaggccaaaacaagacatatcctgtcttcacagggtgatgctcattgtctcctaatcatttatttgaaatgagagcgtaaaaataacaattaccacaatttttaaattaataaagcatttctatatattattttgacataaatgaatcaataaattatagacaagaatcacccttcacatgtgaccaataaggtttacaaaaatatcttggtacaaattataatctggatatttttgttaactaaaggctagtttaatatataaaaattatctgaaagtataaactttgctaaatacataatgtaaattttcatatatttattctattcaattggctaatgcccactctaggattttaaaaattcttttaaaatttttgcctttaatatttttttcacctactattaagatgactccagataaacaagcagatataagcagaaatgtaacagaacctcattaaatgaacaaatttgaaaatcttcagaattttgtgggtttagaagctgggtgcaacaagagttgatattaaagaaaatggtttttgaaattaagatatacatatttatttgtgaaaggacaaataatattaaatgcatggctatgtttacctcagttgtataatacaaaatactaataccatacatgtaattctaatgggtaactttctaaacctcaaattactaccctgatgaatgttttactttgtactataagcagaaaaaaaatctgttaagaaactaacattaaacacctgtacagaaaacatatctgattttaaaaatccatgtatttgtagcatatatattttgattttttttttttttgagacagagtctcactctgttgcccaggctggagtacagtggtgccatctcagctcactgcaacctctgcctcctgggttcacaccattctcctgcctcagcctcccaagtagctgggactacaggcgcccaccaccacacccagctaattttttgtatttttagtagagacggggtttcaccatgttagtcaggatggtcttgatctcctgaccttgtgatccacccgtcttggcctcccaaagtgctgggattacagacatgagccaccatgcccggctgatttttttaaatttcaagttttattttaggttcagggggtacacttgcaggtttgttacatgggcatattgcttgatggtgacatttcaggtatgaatgatcctgtcacccaggtactgaacatcgtacctaatggtagttttttcagcacttgcccacctccttccctcccaaccctctctagtagctccctgtctctattgttcccatctttatgtccatgtgtactcaatgtttagcttccatgtataagtgagaacatgtggtatttgattttgtgttttgctgttaattaccttaagacagtggcctccagctacatccatgtcactgcaaaggatgtgattttgttcttttttatggctgcatagtattctgtggtatatatcaccacatttttttatccagtctaccattaatgggtatctaggttgattctatgtatttgttgttgtgaatagtgctgcaatgaacatacaattgcatgtgtctttttagtagaacaatttattttcctttggatatatatccagtaatgggtttggtggtttgaatggtatttctgttcgaagttctttgagaaatctctgaactgctttccatagtggctgaataaagttacattcccatcagcagtgtataagcattcccctttcttggcaacacaattttataacagatttttcctctgaaatatctacttgaaattcctgacagtgttttcctaaaacattttaacataaataaatgcataaatatttttctaattatttcattttaaatacaaatacttactaatttcactttacatggtagaaaatgactggttttgttaaatattttgaaattagacttacataaaaatggaagatcttatatatagttatttttcactgattcagtcttcttcctttcacattgttaaaataatatgttaaaagtaaaatcacgaaatagatatactcataaaacttacttgaatttaagtgaccattttatttatgaaagtcctctttgctagttttctcttttcttgtctgttacatataatgattgagttacagttacacgcatagcaacattttccattgtgcccctgtgttaagtataggcttttattctgtttctattctgcactaaagagtcagtagcaaacaagtttataaacatttcagagctggatgcataatcaaaactcataatccactccaacacccacttttttaaaatcaagacccacctaattttcttttccctctggtctaatttttacaaaaatttcattttgtaattatttataataatttatatctgcaatttctgctttgataaaactggtatgtcaggagcctccatccatgatatattgtatctttgcttatcagttaaaggagtccagaaaataactctccccttcctatgtaccatatttatggtttcacacttgatttttcctacaaagttggagggtatttcttaaagttctatatgtgattatctaaccttgcttggacagagaaagagtaaatcaggtgttagcttgtactttagggattgtcttaggcagaatattgactccttctgcttccctaacacttattaacgagtcaatttagctattcctaatgtgtgcatgcgtgtgtgtatttcagaacaatgtattatatatacaatttatatttgtcaattaaaaaatgagaatattaaaaatagtgaattagagaaaatattgtgcaaattccagcaaaattcctacagataagtttttaaatgaacatttaatttgattacctgtataatgactccattacactattaaaaaatagctttatgtgtaaaatttctatgtattttttaaacagctatattgagatataattcacgaactatacactttaccatttaaagtttgcaattcagtgattttagtatatttagaaatttgtgcaaccatcatcacaaatctaattttagaattttttttttaaccaggaaaagaatctattagcattcagttcccatctccccatctgctctaggtgatcaataatgtattttgtgtctatgcatttgccttttctgtatatttcttataaatggtaatgaccaatatgttgtctttgtgactgtcttgtttttagcataattttttaaggttagtccatttagtggcatgcgtcagtatgtcattcctttgtatcgccatctaatctttcattgtacagatgtaacatatttcatttatccattcctcagttgatagacatttggattatttccatttttaaatttttattaatgctactgtaacatttttggacaacttttctgtagatacatattttcaattttcttcagaacatggaagaattggaattgatgggtcatatgataaatttatatttaacattttgaggacttgccaaaatagtttccaaaattgctggatgattttacattttcactagcaacatattagggttcccatttctctacaacttaatggaaaattattgtctatatttttattatatttgatctagtggttgtaaagtggtagcgttttcaagtttagacttgtatttttttttaaatgactaatgatgtcaagtatatttttgtgtgcttacaggccactgctgtcttctttgaagaggtaactacttaaatgctttgctcatattttaatgtgtttatttctgtattgttattgaattgtaagtgttctttataaattctggctaaaagtaccttaccagatacatgattaacaagtgttttcttacattgtatataacaatatgatttgcaacaaaaaataaactgatttgcaacaaaaaataaacttaattttgtcaggcatattttgatgtgcattcatttattcattcacttgtttttttgtgtgtttatcatatcatttgtacttttgattttacaggtatacctcaaagatattgtgggttctatttcagatcatcacaataaaacaaatgtcacaataaagttagccattaagattttggttttctagtacatatacaagatatggctacactatactgtcaactatcacagcagcagagatcagagttactggtggcctgcccctctcagaatgaaactgtagtcctagaataggagttggggggtgaaggaacttctttgctttggagcttctgagcttttgtgacgctttgttgggtgggaatgagggaggaattaagggaacaatcaagactcaaataccacagactcttgtctctgattaccataaggttctaataggtgtttctcccttttttgtatgccatttaagacaatgtcaaagactttatttttttctttttttataaataactttcagcagttaaatttatgttcctctggtgagaggacatgctgagcaactcttaccaccattttggaaatcttttctagcccaatcaacatagcgagacccccatttctacagaaaaataagaaaaaaaatagccatgtgtggtggcacgggcctgtaatcctagctactctgtaggctgaggcaggagcatcacttgagtccaagagttcgaggctgctgtgagctatgattgtgccactgaactctagcctaggtgactaagaatctgtttcaaagtaatttgtttttaaagtttgtatttttttccattttgctagttgtattccaaataaaatagtttttgaaccaataaagataagttcactctttatcattgtcatagtcctcttctctccatcccttcatctgagctgggcctattgaacgctcactctgataaatggcaatggttagagttgaaatataagagggctgaggcctctccctaaggggcttggagattttccagttaggcttgtttttgtctttttaaggacacatgaacagattatacaactttttttgtgaatagtatttattagaagaggtcattggtacgatatttcttttagtcgtttcacgcaaattattttatcttattttccctaataaagtttaattgctgatacaatttgtccatgaagattggctaggggtaactaaaattcactttacctacaaattaaattagcacataagttattctttaaaacctactagaaatgtctccctaaataatgtatttgttcctattgttctcttattcaaaagaatcatgctgttctaaaataattatacttataccctaatttctaccttaattatccgaactatttatttatttatttatttattatttgagaccaagtctcgctctgtcgcccagactggagtgcagtggcgcgatctctgctgactgcaagctctgcctcccgggttcatgccattctcctgcctcagcctccggagtggctgggactacaggcgcccgccagccctcccgggtaattttttgtatttttttttttttttagtagagacggggtttcaccgtgttagctaggatggtctctatctcctgacctgctgatccgcccgcctcggccttccaaagtgctgggattacaggcttgagccaccgcgcctggcccgaacttatttctaccatggcatctatctttcaccaaagttatactgaaataccatccaaaaatgtgtttatttttatttctatatttatgatctttagacacactaatgtctaattcgaaagatttggcttattgtagttccactattttagcacaaagttaatttaaatatttgaaacaaataggacataaaatggtgaaaattgtactgctgctcacattattaaatgttttaactattagaatattcttttgctgtcattttgaacagtactagaattcaatacaagtttatcagatatttagaatcatcccagcatattacatatggtgttgctaaaatgtggacttaaacctattgcagcagctcagagcatgctcacaaaccaatatgtaaataaagaaaacgtaactagcaaatggaattctctgattctgttcagtttgagaaggaaatatgcaatgggagggatacatcaagtacactgattttctctacagattacctatttttccaaaaatgtaatcagtttttatttatctatgcttcaaaaaatagcactaagatggataattgcaatccaggattcaggcaaattaaaactgtatttcattcataattattaagttacatgtaagtcccatacatgtaattgtataacacaaagatcatacaatagctctgacttcaaaaaaaggctgccacctcagcttattattctcatatcaaggcctttatattgatgttctttctcagttcttgtgcgtttccctgaactaggttttcaggataacaaaatctgttgtttttcttctaaattacatttttactagtgttcagtttaatctaattgcaccttctccttaaaaaaagtaaaaaaaaaaattgaggtactagcaggatgtttagatatttatagcttgttttatttgaaaaatcttggataaacaacaacttttttgttgtttctggtgtttgttttgtgttatcatctcagtgacactgaggcctctttttctggccatggggggaagatctctcaaagagctaaataatatagaatctatttaacaatataatttagtttatttttaatttctgaaaaatctactttggggaatactgcccttgacataactggaacctgccccaccaaccttgttgtctttctattttccttatattcctattatttctccctagtacagtagacaggaagggcaatcaaatgcaaaatagcaatgtgaaagatacacaaaatgatttttctcattcaatcttattttggttgttcctaaatggtactatgtaatagcaataattatcacatggtgtgtttactatgtgtcagtgtgtgtactaagcactatgaatagattattgcactgattcctatactcaccttatgttgtaattactatcattctcagtttgcagttgatgaaactgacatacagagagtataggtgacttttctgcctatattgtgaatatgaaaatgtatagggacaagtacacatacatcaagaagactgaatgcaaataaaagtttgttgaataacacaaggaaaggctgttaatttgtaacattatttaattattcatgtcttatggtatgccagaggacaaaatcaaattaagagaactttatttgggtttagatttcaatttaattttctatccattattacaagtatatccacaaggattcaatgtgcctaacagaagcttggtggtcactgggaaaagagccccccatagtaatatttttttcctgtctttttcctgcctttaatatatcctcccatttgctcatattgccttttctaaatacatctgaaacacggtatgttttactgtagtcttctggtattcagattggaaatacacacacacatgtatgcgtgctcgctcgcactctctttcatacgttcttcaatcaaaaacttttaaaacaacaaagaatggctaagcagataatccatttgcaggccatctttaaaagctattatttcagttcttgctttttcattcactgtgtccttgtgacaaacatattttcaagtacattcctaaagtaacaaacataaggctaaatgaaaagcctagaataaactcagaaatgaagagaataaaaaagatctctatttctggtattgttctctcaatgccaggtctcatggaagaacaatataaggtgataaagtaaaaaataaacaaatagttcatagggtgattttatgttttaaaatatgtatttcaaagcagattcattattgttttaactaaggcctgagtaaactggagacaggggcaaatgaataagctgtatcggtccatgataatcatctttcttatcactctctcttgctcactcgggtccaaccatatagtccctttcaggttcatgaatacaacatatgctcacttgactcaaggattgtttatgtgtctttccttccagatatcaattttctcattatctcacttccttcagatcacttctcaatgtcaatttatttgagaagtttcctctgataactttctatcagataggacccattcctatacctaatcttttaccctgctgtattttctcagtaacatctttttattcctaatatataaatattcattgttttgcctactatttgttgctctagcagagtgaaaccctaacaggcattgttttatcttctgttacacctccaatacagagaacattgcctagtatatgacaagaactcataattatttgaagagagaataaagtaaataggggagaaaacatattctctttcaatgatctcactatgcattctaacctaattaccagacaccttggcaaatttgtaaaccacagaagaaaatagaaggattagaatgcattacatttctttatgtttcctgtctcactttggctagaatcactccaaattatttttgtccatagcctatacacaattatttctttaaaattgggtgttcagtcactaatattgttctatattggaaagaaaataattcaaaatagtatcagaataaaatttgaccaaggttatctttaggctttacaattaaatagtttgtgactctctttattttgcttattttggaaaaaaatgggcctttataaaacctgtataatacattaaagaccatacatttgtgattttagattgcttataatttcccctacaatttactctataaaaaagattatttaaaagaaagaaaagcaaaagatactcagattgttgttggttttttttcctcctcagctggttttggctgctcaattttaacactccccagagagctctcagacatttatgtgatttaatggcctactattattaagtcagaaatattttattttacattgagattgccataaccattgcattaacatttgagtaataggcaataacactgagaatgtatcaatgtatcatttagtgaattaatctgtattcccttcctaggacttgcttattgatgatgcaggataaatgtaatagtaacaataagtcatcaaacattctggcagacctgtcaggaagaggagatgggggtgcatggaagtgagcttgttgagagacagttcaatgcagaagaaatgacatatgtcatattttccccacagtgaaatgatagagtacatggggatagcttagtgatcagcaatgtgtgcaagttttgtttgcctagagcctgtggttgtgtttctggttaccctatgtagcaaaataataatgagttaattgaaatagcaatcaaattctgtaggaaataaatcatctagaataaaagaaaaaatgaaaaaattagaaatcacatttaactgtaaataatatctcctagctgtctatcagtccacaaattagggtgacgtatattcaaggcagaaaaaaaaatagatttgttgtgcatgtacaggaagaaaatattagaacttccatttatatgcatatttatctaaacataagaaaacatggactcattttcattaaagtgtgtaatattcagattgatatgtatgtgttcatggtatgctgtgtacaagttatcctgaagaagaataggaggtcctataataggcaagtttgccaatggctgccagactcctttgtggagctcagactgttaatttcagtatactgtgatgttgagcatatccaattaagttgatttaagaatattttctgggtttagtaaaatgtgtcctataaaactgacaagtgaaaaaaaaaaaacaaaactcaaaccaacatgaacaaactgtggaataaaatgagagtaataagaacaaagtataaaagaaaatagcatcactgatatttttcagagtataactatctaaaccatattatgaagaatagtagtctaatatgatgaacaccaacccccaaaagctcaaaatcacaacaatttaaaatattaatatttacctggtttcattaatgataaatcagaacttacacactgtgttttaagatgtgaatggctgtataaagccgtgaaaataaataagacattccaaaattaagcatcttgacaatgaagagaaccaaaatttttgagaaacatctcaggtcatgcaactcccagtccagtatttcatgcaaggtcaccaaacaaccctaaagagttagaattttattggaaaaattctcacttaaatagcaaaaggcctaaatccacaaacaattacataaatatccttttttttttttgctatggtaaaagtggtttaaacactatcaagaaaagaaaaacagaattagaagtctcttgtctgcgaacacaaaaataatgtataaaaattgttggaaatttacaaagcaagcattaaaacacatttattgtgtgaaacacttttttctttgaatttaaagtacatatgctgcttctgtcataatatagagaaaaccattgaatgaaagatgcagtggagaagataaattataaaagattgcccacaggagaaataatgtacaacttaaaagcacttacttcattaatgataagcaaggtaaacaaggtactgcagcaaaaaaggttaataactggaagcatcactggcaatacgtggtttcaatacttgtgttgttggtgaagagacccgctataccagaagattgtgcagaaatccgtgtaagagaggttcaagcattgggcccggatttaacaaacgtaatggaagaggtcaagtttcagagatattagagaagcaaggctcaaaaaatgtgctggcagatagtatgtggaatatgtggaaaatattgaaattgaagatgatacttagattaaaattttgtcaagtgcaactgaatggatgatgataccatagttgctttcggttaagagcatcaaatcaaacatactaaaactatgctctattatatgcatgatgaagtctggagagtgttctggaaaatccagcaaagtttaaataaatattctttcatagtctatacatttttctatttaagttcatttggctaaaaaaaaataagtctaggttatacctattaagtgtctacccttattagctgaggggaagagacactatcagttggtattctcctatatttatgaggcagctcctgtaaaacaaaccactgatcttttatggatcttcttggggttactagtgagcagagtagattttgttcaccaaaaattctcagaagaaatctaacagtaccttaataaagctgacttccaaggtcaccactaaattaaagctaaaaattaactctgttctatttttatcccaacttacttccaaccatattcagaacctggcctcaaaaaacattctcaaggagataaaatgacattataaaaatattctcataatgaaaaacttcaacaatacagatgaccaaatttgaatataaacccatgtatattatcaaaataagagatagatattttaagtccaagagatatatccttttgcaagttaaagaaccaaaacagtaacatccaaaaaaaaaattaatctaccgtaagttagaatttgcttctctgtggaaagacttaattctacaataatgctagtcctcataccttaatgtaaaatttagtgcaattcaaattataatcccaatgagtttattctttttaaaaggagattggctaatatgattttaagtgatatgaaaaaaatatccggaaaatagataagaaaaatataaataacaacagaaaaaaaaaaaaaaaacaggagagcactggccttaacacatatctaaacaagcaaaaatttgtatgaatagacaaatgtacacttttatagcattgagaatccagatataggtagtgtcaagtggaaataattaggaatatttaataaataaagacaaaatttatcttccaacaaaaaaattaaaaatgaatgcataaacaaatagcatcaattttataaaataaaattaattacaaaatttatgaaaagtaaactacactagaaaatactgatgtttgatcaacgtatgtaaaataaactataaaatagtggtatatttttgagcaatttattacaaactataaaaattttaattatagagaaaaaattattttcaatatttttgaagatgttataagttcctaggatttccaaacaaaaaaaaacaacaaaaatgaaatctatttatttgtgggaaatatataatcaagatagagacactgttgtcaagataacaatataccaactctgattccagggaagatggaataatgacattccactctactatttctcactgaatatagctatagaaagcctgcagctgctgtatgaggactgactcaagcaaacagtagcaggtaaaatgggtagaagacccaaatgccagtgaatttaccattttttcccctcaaatatccatagtctgaacgcaacgcttcagaactggccacagatggagttagagagtgatgggagaactctggttctgactcaaagagtgggaaaggagactcccaatgcctaaagagaataccagattccttccccatcccagcctccctgtgccacatccctttttttgttgtttttgtttttctctctttttctttgtaccagccttaagcaattccgtcatgctggtggtgatagccgatggtgacaaaagcttatagtagtcaaaattatgagggaggggaactttcctttctgtttgctacagtcatttttccagggggtaggggcgactcctattgtttttgttttatattgccttttcttttgcttcttgcatcagatggggatgcagtcatggaagtgaagagcagagtattaaaccccaacttcctggcaagaggtctaagtggaaagggaactggagtgcacaggggagatggcagagggaggagctaagcaaagtgaccccatcacatttttaataaactcctaaatcacccctgtgttgcacagatgtggatctgattttattcagcataccaaagacaaagaaaatatagtaatagaccaccaaccacatcacagattgaccattgatggcaaacacttaggataaatacaaatacaaacagaacaaaggtttgaaaacagaatggacattggagacaaggctcagggaagacattggaatttgtgacctgaaactaaacaaatcaactgcttgctaaaataaaatgcatatatcctcaataggatttaaataagatccagcgtctcatatttattatttaaaatgcctagggtataatctaaaattattcaacatatgaagaaccagaaaaatatcaactgatatgggaaaagccaatcaatagatgcccatgtttaaatgtcgaatttatctgacaaacactttaaagtagctatttttaaatgcccttgtaaataattgagaacactactgaagtcaatggaaaaatacaaagtctcagcaaatagataaaatatataaagaagaattgaatgaaaattttacaattgaaaattgaaataactgaagtgaaagttttcattgggtgggttcaattcagaatgaagatgacagaaaagaaaagtcagtgaacttgacagcagatcaatgaagattatccatctaaatagagaattggtgaaaaaagtgaagagagcctcagacctgttagacaataaaatttctagcatttgagacatccctgtaccaagaaaagagatgaaagaatgcagtactgaaacaaacaaaacaaaaaccttgaagaaattgtggctgaatatgaccccactgtgctaaaacacataaatccatagattcaataaatacagtgaaatctatacattcaaaacaaaacccttcagacacatcagaaggaagctgctgaaagctaaagacaaaaaggataatatagcttgagacatttatactgtagctcttgctgttggactcccacataatatatctaggctctaatctattccaatctgccagaaaggctttgaaataattttcttattcttcttcattaattccagatgaattatcctggtgtttgttttaaaagaatgttgtgttgtagcttctgcctttttgttaaattgaaatatgtgaaaataaaattaaacgcccactgaggtcatcatactctacttatccaaggtgattttcctttaactgttttatgacctagcagaaaaatattaacatactgtaatttttatatatttgaattatttgtaaatgcagtgttctgatgtaatgcataagactgagatattttataagtcatatacatattattgtgaatgacatccatcattgaaattattctaaaaacaatattttaatgaaattactctaaaagcaatttgcattgattcagaaaggtcttcaaaatagaagtcactgtagaccatagctatatttgagctagattcataaaaatacaagcaatagaaagttaaagttaatagagtgctacttcaaaacagtatacatggatataagagtacacattgtaaatggaaacttttttctttttattacgtagtgacttagtcaaactctaatatcctatctttttctgatttttcaggcatttcccccaatacaatataaattctactgtatcagactcaattcttagtaaagcttaatctcattgaaaatattaagaggatttaaaataaatcttaaggtaggaagcttaaaagtgctttatatctataaagtcatatctataaagtcacctaagaacttcaaagtttctaagaaggcttgctaaaagaagtctttaaaacatatgccgagataacatagcatttattttgatacacagatttacttttatctcttagaactttttcaaatcacctgagcagttgagtattgctcttttataactaatcccttcccgcacccacacaccctgatgtatatacagaccagtgcacacatagaaaacaactggcttgtgtattgatttaatgatgagatattttgggggataaaacaggtatggttaaacacatctactaagaccactaatattccgactctatttcattttgaataaagtgaagaagatcctagttaaagtgtaagaacaagtaggaaattcaatttacacaggatggagtggaagaggtaattgtacttgaatggaatagaatgttaattatgaaaagaaaaattactgcattttgaatgataaataactttctaaatttcagtacaataaaaaattgatagacacagaactgcaaatgttagattccaaagttattgtggaaagattaatttggttacacatcttttaaaacaagaccatagtaaaatgtggaattcagtatagattttcatattctaaggagcttcccaatttattactgttcaaaatagtggaaagttatgtagggctgttaataagtggatgtttggtgccttgcggaataatgtttcttctaatatttattttcatatgaaatcaaagacactggtaatttaaaatgatacacaaaaggaaacagcacatttttacagcataaagtaacattttgataaaagtattaatatggctccattttcacttttgaaaaataaacatgaatttacacatttttaaataaaccatgctcataatgttcaaacatatcacttgaattagttcaagcaaaataactgccattgaaatccttatacaaataccagtgatatttttcacagaaagagaaaaaataatcctaaaattttatggaagcacaaaagacccagaatagccaaagccatcctgagcaaaaagaacaaaactggagatatctcattacctgacttcaaattatgctatagagctattgtaaccaaaatagcatggtaccggcataaaaacaaacatagaccaatggaatagaatagagaacacagaattaaatccatacatctataataaactcattttcaacaaagatgccaaaaatatacactggggaaagaacagtatcttcaataagtggtgctaggaaaattggacatccattttcagaagaatgaaactagatccccatctctcaccataatcaaaaagtaaataaaaataaattaataacttaagtcataaagctactaaaataaaacattggggaaacactccaggacattgtctgggcaaagatttattgagtattatcccataagcccaggcaaccaaagcaaaatgtaaaagtgggataatatcaagctaaaagcttctgtacagcaaaggaaacaatcaactaagtgaagaaacaatacacagaatggaaaaaagtatttgcaaactacccatctgacaaggaattaatatccagaatatataaggagctcaaataacaggaaaaaatcaaataatcaaattaaaaattaggcagatgatctgaacagacatttctaaaaacaagacatataaatggccaacaggtgtataaaaaatgttcaacatcatcagagaaatgtaaatcaaaaccacaatgagatattatctcacctcagttaaaattgcttttatccaaaagacaggcaataacaaatgctgatgaggatgtgaggaaagggtaacccacaagcactctcaggaggaatatgaattagtacagccactgtggataacaatctgcaagttcctcaagaaagtaaaaataaatctaccatatgatccagcaatcctgtgctggataaatattaaaaggaaaaaaatcaatatatcagagtgatatctgcattcccgtgctgcttgcagcactaatgacaataaccaagatttggaagcaacctgcatgtccatcaacagatgagtggatagagaaaaggtggcacatatacacactgaagtactattcagtcataaaaaagaatgcggtcctatcattggcaacaacatgaatgaaactagaggtcataatgttaaatgaaataagccaggaacagaaagacaaacttctttttttttttcttttttttttttaattaaagttttagggtacatgtgcacattgtgcaggttagttacatatgtatacatgtgccatgctggtgtgctgcacccactaactcgtcatctagcattaggtatatctcccaatgctatccctcccgcctcccccctccccaccacagtccccagagtgtgatattccccttcctgtgtccatgcgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggccgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctctaatccatcttgaattgatttttgtataaggtgtaaggaagggatccagtttcagctttctacatatggctagccagttttcccagcaccatttattaaatagggaatcctttccccattgcttgtttttctcaagtttgtcaaagatcagatagttgtaggtaagcggcgttatttctgagggctctgttctgttccattgatctatatctctgttttggtaccagtaccatgctgttttggttactgtagccttgtagtatagtttgaagtcaggtagtgtgatacctccagctttgttcttttggcttaggactgacttggcgaagacaaacttcacatgttctcacttactgtatgaggtaaaaatgaaaacaattgaattcatggagatagtgagtagaatgatggttactagaggctggaaagggttgcagggaaggagaaaagtaaagatggttaatgagttcaaaaatatagttaaaatgaaaaagatctagtattgatagcatgatcaggtgactgtagtcaacaagaaattattgtacattttataaaaactaaaaaagtggaattggaatgtacctaacacaaagaaatgataaatgttttagacaacagatactccctttactctgttgtgactattgcaaattgtatacctatgtcaaaacattacgtgtaccctgtaaatatatacatctaatatatacccataaaaatttaaataaagttttaaataacttttaggttaaaaatgcgaagatattaacatggatatcattttccagttagtgacagaaaaaaaattgttggaatttaaaagtggggggaaaaatccactgacaatagacaaagcaagggaagaagagttgaattagaggagaaagcagcactttccattcaaagtaatttgatccaaaatttccacaatttccctgtgatataggtaatcttctgagaaaatctgcattgtatattgtgggatacaggattcctgtgaagttttgattattgacgtatttaacatttgtatattctatcgtgcatggtagtttaatctcaaaagagaaaaactgtttccctttaaaagttgatgtagtatatgtcacaagctgtggggaagggggagagctatgtaatccaaccaacaaataatttcaaaggttaggaaaatgtctttcttgcattggttaaaaactaataaaactcctatcagacattatgagagcaagattgtctggttctagtacctacagagaaattttgcggtggaatataaatgaatccaaacaggtatgccactgcaggagatacaatggaatgtatactcagagtttctcaaaacacaaatctaccatatgtttaaggctgaaagttaaagtaaaattttctggtttttgaccatttgaaattaactaaaattggtaaagcatttgtgaaatgacataattgtgaaatctcccataaaagtattttttaaattttggggaaaaagaaaaattgatacaagtaggaaaaccctgcatgtggaaatgcaagctggaggggagtacagaagaaaaaataaataaacttttgttacttctgaatatctgataatttccagatctacgcaagatgattaagaatgattacagaaatttaaatattttcataaagatttaaaatgacaaatcctagatggtagacattactgaggtcttgtgtctcttcctttatacatatacctattgaagtaagttgagactttggtcaatgaaaagtgaaaggaactggtgttggtcatttcaggatagaagcattaaagagtcattgctccacccatgtcctcttcttccctcctggtggtaacaaatgaagttgcaataaactgaaacagctggaaatacagagtgagtcattaggtagggaaaaaaactgcttcagagattcctgcagttttgcagcaaattttctgtaacccagaaccaaatgtcttcggtgttaatcttctaagattttgtctttgtgcaccacagtataacatatcctatcctgagagagacattgaataaatttaaaaaaaatggttgatgtgtttttatacttgaatgcaaatttagatagtaaaattgccacttaagaattacaacattaaatagatgaaatgttgtatttcagatgaaaaatttatctgtttagaaaattatacacaaagccaagattattggtttgttttgtttgtttgtttttcaaaatcttctttggctccataggactgatcagtaaaaatgataaatcttcacatggaatttaagacctaactcgacatatctttcaatttctatctgatactagtgggaatgtactcctaattttcatgtgcttgaaaattcaaccaaaagtacagaataatgaaaaatgactaagacccaggatacatagtgacactccagttctgcctggagtagaaactgtctttggacagctcatgcaatctctctcaatttctcatctgtaaagtgaagtggttggagagtagaatctctttaatttacgcaatatattagtccattttcatactgctataaagaacggcctgagaccgggtaatttgtaaagtaaagaggtttaattgactcacagttcagcatggctgaggaggcctcaggaaacttaaaatcttggtggaaggcgaaggggaagcaagcaagcttcttctcaaggcagccaaaaggagacgtgcctagtgaagggggaagagccccttataaaaccatcacatctcgtgagaactcactcactatcagaacagcatgggggaaactgtctttatgatgcaattacctccacctggtctctcccttgacatgtgggaattataagaattataattcaagatgagatttgtgtggggagacaaagcttaaccatatcactcaatttcaaagacctgcctgcagatgcctgctctactttaccacacaaaggcttttatttctgttgtttcatttctctgacctatctttttcttattattatttcctagaaacatcttattgtttctatggtttatcaatgtttcaagtacccaccacaatgccactttttccataaagcttttcttctctcattaaaattgtctttgtttgaattatattacattatcactgcctcttgtagtgtttattttttaatccatcaattattttcatattttgcctattcaatatattataaatttataaactgtgaaatacacgtttaagattgaaatacacatttaagattacttatatgtcacacaatatccaatatggcccttttatgttgtatgtgctctaaatacacttttaagaacaatgggtaaaaaagcacaaaaaaacacgaggacaaaaataataaaagagaaaactgaaacatggcttgtagagaattattttcctataagaacttattagaaagagatcactacctttattctatcaagatgaattatttgttctttgactctattaatccattttccaaatattacacttctatttactattttcttgtctaaaacctaaaagcttttacttaatctaggtctcagagttactaagtactatcatcattgtttggagcgactttacttgggggaactttgcacttcactgatctttaaagagtggagaataagaacatttcagaatgcattacgaacattttaagagcagagaatgttatctatgtcactcaggttctgttggattatctcacacaatactgattgtcacagtgtggaatcaagaaaaaagtttaatcaatggttattttttaaactgcattttgaaaggacatatataatatgtatatttatacatatatatttacattcacatgaatatatatatacacacacaaacatatatatgtctgatataatttttacatctcatccaaatatatacaaagtgagcagaaaataaggaaaaatccatatctgtctggtgtgcatgtgtttaccactcctctgttgttaagcagcaaatatcaagaaaactcttaagttgcttgtgtttaataaaagactgacatgttccaagcaatagtaaactcaattatggtttgcataatgattaacaaagtgttattctcacacactgatttatttggtattcacttaataatataaaacagataaagcaactatgtatagataaaaaataagaagattgtcatttgtctatgatcaaattgttaaaaattttaaggtcatggcttgagcctaagttttcttattctaaatctatactgctttgtttcttcaatcataagtggtatgtcaaaatttttccacttggaaaattttaactgtattttttctttaatcctttcaatagttaactttatttgctcattaaatagagttgttttaccagcatacaaaaatgtttactgttttctgtctatgaaacagtctatagctgttctgaaagcaccacgatattatttgaagaatttgcttttccaattgaacaaggtctactaacattatatttatggacacgttcctcttaggccagtggatcaaactattcaatcaaatcttccctccttagaatataattcttatcagagatcaaaagagaaaagtacactgatcatgttgagatttatcctgtatcccatccctaaatctctgcacctgatttagttctaaatagctcccaggtgctttttcctagctagccttctgttaattctgagaactcattatatctttccagtaacatacctttgattcaattagccagtgatatttgtgttacttcttactaaagaatcttggtactattggtcataatcaatttaatcataaatatttttctcaatacattacatgtcatacaggactaagcacatacttaatcaaatgtgatgattggaagacaaaagacttaatgtataattgaataagaaatgtattactcaatataatgaatcgtctactgagaataacattcagtgacctgcccagcccagaaacacgttaactcattcacttagaaaatgacattttgttactcgagagctagaatgcatgagatgtaattatcactgggtaactacaagagtgatttttgcattcccataagtctcagggttaaatttctgtacttcatcatatatatgatggaagatataatttctttaatgatataatatgatatgaaatgatatatattatgatatgatacaataagaacaacaataacacatttatgtattagtttttcaaccatgggcaaaacaccagacacccaatttatttaaagtacacattgtgtgtttgagatgcactagttaggttcatttaaagctcatgtaggtatctctatatttaaagaatacctttaaaagattttaaggggacacccatattaagaggataattggtggactctattcagtaactgtccatcatatagatcatcttgcttataatcataaagccattggatccgtcattgatattatatttttccaagtccattgtataactcgggtctgttatgaagtagaaatggttattaatgtaaacaatcaaaacatataaaaaggagataacttagttttggatgacagcgaattgtaaacaatgcaagaagcaggttacagtgacaaacgcctataatcccagccctttgggaggctgaggtaggtgaatcacatgaacccaggagttccagaccagcctgaggaacatggcaaaaccccacctctataaaaaacacaaaaattagctggtcatggtggggtgcacttgtagtcccagctactcagaaggctgaagtgggatgatcacctgagcccaggaggttgaggctgcagtgagctatgatcgtgccaatgtactccagccggggtgacagagcgagaccctttctcaaaaataaacagacaatgtaagaaatcagaagttaaatatggagagtgttgatcatataagtgtaaaatacctgaaatcctcaccaaaattcagtaaagtaatatgataaagtgttattaccctttacataaagaaatagctcttccaaaattccagaaaattaataaaaactaaaaattaaaagtcagttttaaaacaggctgatgaatttgtattataattaatgtttgaggaatcaaaagtaatttattattttcatgaatattggaacaataaaaatatgttttctataagggtagcaagtagctgatttacaaataaggcatagaacttcaacctaaaaagcaaaaacaaggcaaagctgtgtgtgtgtgtgtgtgtgtgtgtgtgtgtgtgtgtaatttaaaattaaataaaaaacaattgtggtagcttgcgcttgtcagttacttgataggcagaggcaggacggtcacttgagcccaggagttcaaaactttaaggtgctataattgcacctggaaatagtcactgaactccagcgtgggcaacacagtaagaccctgtctctcaataaaaaacaaggaagtagaaaaaaacacagaaaagaagtcaagagaataggaaaaaagccagtcatgatggttaatagtggaggaagacagtactgagaaaaaagtagaggagttaggcaaattagacatttaaattttctttctttcttttgaaataatatctctgcagtaaattatttggaatgttctatttaaaaaaattaatcaacctgcatttctggtaaccaatgatatgtctttccagttgttatacctagcaaggcactttttgaaccaatttaaagttatttaccagcgaacaaaggaaagtgttaccaaaaattctaacattcaaatatttatttctcctttgtaggaaaagtgtactaataagtgctaattaacatttcttctgttaaatacccaagttattctttgttttcaaaattgtaactacatttcattgcaaattgttttcattacttttaaacatgcagagaatgagactggatttttaaaaatagccagaattttgatgcacgtaagacattcacttaaaacaccaaaagtttagaaaataagtacacctcagaatagaagtacttctttgtctctccttaaataatcaaaattgtattgcaaatttgggtactttcggccattttattttgagaagactgtttagttgttgttagtgaaatcaaaagaaaaatagaaaataaataaaagtgatttaataaaaaggtatgctttgctggtttcctttaggttactggttgtttatttttctcttgtctcacatataatgaatctctttcactgtttaaaggtatcatattgataacaatgaaagactatttactgaacttattgatgtaattttgctcataattactaaatataaaaaaattaaaatattctcacaacattctaaagtaaaaatatttggaatgatttttacttacattatcatagatatatctgtgtagatatatcttattctatttattttatctaaaataatttattttgatattatttataaacaatattctattgcattagtatacaatgcaatacagattgcattgatttttaccctctagaaaagttcagaaagattttaaaacataagtagcctactccatataaaatttaagtacacatgggcaacaacagaaattggagactattagttgcagggcagagggagagaggcaagggttgaaaaactaattattgggtgctaagcttaatacctgggtaatgagatcttttgtacccaaacttcagtatcatgccctataccctaggtaacaaacctacacacgtaccctcaggatccaaaataaaagttggaaaaagaaatctctaaagaaagtaatttgtttttcctttgttatcgcatagaaccttatctgtagttcttttaccttatttggtcttgaattattatttgtatttatggattgtgtcactattaggggataaggtatttaaagcagggactatggtttgctattctgtgacttttctacaactctgaacgtgattcctaagagaagtgagtagatgtttgctgactggacctggaacatgtgaatatgtctattattatattttcttaatatggtatgcttaatgtagtgagctaaacaaaataacaatgtgtatagagtattgtttaaaataccccacttccaattgtttaaagtgcaaaagaaattatatgtttgaaagttaggtggaataaatgaagattaaatgatatagaactactcagaaaacaggatgactttgtggggaagtgaattttgaccctgcttttgaagaatatatcaaatgtaacttacagagtaaggatatgtgggaagaacataggctgtggatttcagaaaatgctcttattttttagctatgcaaacttaagccatttaacctaggattctattttctaatctgtaaaatgaaggtaacagcactcaccttaacttactgggtgttttgaggtttaaatgaaatacagaatttgataatattttgtagtttctaattttgagtacacatctaaaattttttcatctatttctttaggccatcagagaataaaaaaattaacatttaagaaaaaaatatgtttgccttgtaagtaagaaatacagtattatccttccatatctcattcttgattttactatatccaagttgataatatagagagaatttttatattttattttgcagtgtaccagataatccttcagataattggtataactgttcaatcaacttaagattatgatattctttactattcattctagttattgcaacacctgtagaacctatatttactttcctgtcagtcagctaggggaccatacagactttaaggactggttagagaatgataatattgatagaatagaaattgattctgaaacagtgaaagaggtttgactcttacatataagactataaatctatgaaggcggaactccatatacttttttcaccattattttctttcactttgatgcatggcacctaaaagctactttacaaagatttgttgcatgcatgcatgaatgaatgaatgaatgaatggatgaatgaatgaaatttaaaaataaaattttaaatccacaaaaatgctttatgtaaattgatcgtggtgcataagccttttgatgtgctgcaggattcggtttgccagtattttattgaggatttttgcatcaatgttcatcagggatattggcctgaaattttatttttttgttgtatctctgccaggttttttacaatactgtgttaaaatattaaaaactagttcattagtatcatgagctcaaagcaagaaagaacatataaaaaattttcagtgttaatttctacttaagctactctacaatatctgtttaataaaaaaaactgaaaattttaaattaacatttatagttgttataaatacacatcttaatgtgtgtgcatatatatatatatatatatacatcttgagacatatatatacacaaacattgatatatatatatatatgcacacacacacataccttgacatatatatatatagagagagagagagagagagatcacacatgtaaaaaatttgaattaagccctatttttggttcacaagtcttgcttcttccagaatttttctgtacatgtctctcaagcagacaagtacctcggcttttcagaagcatgtgtgatcctgaagagatttgaaaatacggactcctggtgctttatgcaaggctataaaaaagctccaattttcaattatgattgggtaaaatatttctcagttatataatatttttcttgatattaattctgcaattttcttttcagattttctagactgtaataacgttccactgatatataataattctatagttgggaaaatgactaatcgcatgaaaaagaaagggtactgtgagaccatcacttgacaaaaaaatcgatcatagtctgcctcaacttgagaggcacagtctttataagatatttaattcgtcatagtacattgcctgcaggagtgttacacagaagtccaaccagtgttttccatggggtttcaccctagatctgatgaatcataatttatcggatgaagcacaataacatatgtttatatgttctttttaatacctctcttatattttacttatgtatgtatttttctgtccttaggtttaggggatacgtgtacagatgttaccctcagcagtgtataagcgagaacacaggttcgtaacaattccgattggtaactatcatgcaaccagctaaattccaggtaaacatatgagaatcaaaataccaaaactttaaaattcaaacaaacaaacaaacaaacaagcaaatggaaatctgtttcctgcaaagtatgaaatattttaaatttttctatccaatttcttcaaaaaaccaagatggatctcttcttaaacctatacctcttcaaaaattggccatattgaaattaaccttagaaaatgtgtgtctcactatctctcccctctaaacacacacacacccacacacacacacacaaaagcatataaagaaaacatacttgtgtcttattatgcacaggataattgctaatgtaataggcaattatattcagaaatgatttgcatattcacaatgtaaaaatgctgttatgctgtggatatgcaatgaataattaatcagttacacttgaaacaatacctatgaaacacacactggtgtttagcaataatcatgaaagaatcattgcaaatatgtatgtgaaatagattacaaatctatcattaaaattgattcagcaatttaagatatttgatttccacctaccaaattattaaagagataaactttactaggtaacccatggttttggttgtagatcatatgataaaaaggataaattatagatttgaaaagatcatgaatattatgtatttcaatatcatacttagttttataagtaatataagtaaacaatagttatgatgtttagatataatttacatcctccctttttccctactccataaaatatatttgagaaaacatacaatcaaacattaatgcaaataaagtcattgataaaaatagagatcacaagagcaattccctgaagatagggagaataatagaaatggttatgaaagcattgcaaccaagttagaacagttactgagcttggaaagaaacatttaactttgaactttttagcaactatatcgaaattggaaatgtaagggattgtatcattctcattctctagaaagaagaacatcatcgttttatctggaaagaaaaactgctagaactaaacgcaagaggaattgttttttgtaacataacgtggtatttcaacataagtttttttttaaaaaaaagatgctaagatctcttgatataattttattttacatttctaatatcctactaatggttagctttaatgattgtaaaactttcaaaaatgcagtcaaatcagtaaattttattataattttcttttcaaaatttataattgataccttaatttctcatattacaaatatttaaagaataaaaaaatgaaggcaaatattatctccaatctaagcctaataatagtcattattcagccttgtcatcaccctgatcattttttcttgactctaggctctgtttgtcagtatcagctcttaaaatgacaaccaaatcctgctcaataattcaaatatagtttctagtcaatctttgtccttcatgtctttgaacatattccctatatttcataatcacccacattgtgtgtcccacttcccaaagcataagttcaaacaaacaaagaaacaaacaagcatgtctagattatcttggagtttaggtatatgtgtgtgactcagattctagatatcacagtgagagaactggatttaaaagggagcaacctgtggaggcaattgtataagggggatgtcatctccagacaagtgtcatgtgtaggtatttcctgaaacaagcagtaaagaacttgtgacatccagccctgagtcttataagacttggtagttctgagtttctgctacagcagctgctgtgatatgtgggttagatgtgattcctatctgtaaagctacagaatctgagttatggcactcatggagactgtcttaattcagcctgctataacaaagtaccatatactaggtggcctatacacaacagaaattatttctcacagttctagacactggaaaattgagatgagggtgccaggatggtggggatctggtgagggtcctcttcctcttccaagtttcagactgctcacttctcgtgcatcttcacatggcagaccgagggcaagctagtctctgacctcttcttacaagtacaatgctaatcatgagggtggagtcttcatgacctaattacctcccagagaccctacctccaaatatccttacattgtgggttagagggaaagaaatattcaattcataactttctattcttccccccaaattcatgtcattctcacatgcaaaatatattcaacttaacagccccaaaagttaacttacactagcatcacctctaaagtttaaaatgcaaagtcttacctaaatatcatctaaattagatataggtgcaacttgaaagccaattcatcctgaggcaaaattcctctccagctgtgaatttttgaaaccaaacaaattgtgtgcatccaagctacaatagtaggacaggcataagataaacattctcattccaaaagggagaaataggaaagaaggaaggggtgatgggtctcaagcaagttcaaaacctagcaaggaaactccaggtgatcttaaggctcaaggataattctctttggctagatgctcttccttctgattccactggggtaggtgtcctgccttccagaattattggatcaggagttacatctttattgctttgggtggccctaccctcacagtttggggcagcccctctgctcatggttttgagtgaaggccatttgtactgttgaaagcaacgtgaagtccccaacaccaacacaaaatacatcctaactgttctcgcttaacacactttctcattttttttgtgatatggataggctgagaattttctcaatatttaatttctagttctttttttcttaataatttggtcttcaagtcatttatctcatcacacattttactatgaaaagtcagaaagaagcaagcacttcttcaacattttgctgagaagtttcttcaattaaatattaattttattgattgcaacccctaccttccacaaaacaactagaacataaataaaattcagcaaagttctttgctagtttataacacagatcacttctgctccattgtccaataacatgtttctcgttttcacctgagaccataatggcagccataatgcagtgttctatatatgatttatgtattatttaagaaaacagaaactttctctacctctcttctctttctgagccctcaccagaattgtctttaaaagtctcttcacaagagtcttagcttcttctagcatatacttctttcagcttctatccattatccagttctaaaattgctttcacatttttaggtacttatcataacaacatcccaccgtctcgataccaaaatctgttttaggattctccagagaaacagaatcaatagattatatatatatatatatatatatatgaagatttattataagaaattggctcacaggaagctggaagttgagaaattccacaatctgctgtctgccaattggagacccagaaaagttggtggcataatttgaagttctgagacccagagagtcaatgatggttccagtctgggtatgaaggcatgagaaccagaagcactcatggcaaaagatcgatgtctcagctcacacagtagggaagagggcaaattcaactttcctccaactttttattctattcaagctctcaacaaattggatggtgcccaaccacactggggagggccacatgctttactcagcccaccaattcaaatgctaatctcttccagaaacatccttaaagacatacccagaaataatgtttaaccagctatctgggaatccagtggcccagtcaagtttttaattttttttattattttttatttttttagttggagtcttgctctgtcactcaggctgtagtacagtggtatgatctcggctcactacatcctatgccccctgggttcaagaaattctcctgcctcaatctccctcatagctgggattacaggagtgcactaccacatccagctaattttttgtatttttagtagagactgcatttcaccacgttggccaggctagtcttgaactcctgacgtcaagcgatccacctgcctcagcctcccaaagtgctggaattgcaggcgtgagccactgcacccagcaccagtcaaaacataaaattcaccatcacagagaccatgagctctaccttcagccagttgaaggagaaaatcctgaatttgattttcagcattcttagtcctatgtctacaggaggtaaagttctcagcatacatacagctttcagattgtgtacatgcgcttaaactggtaattcaaattcctgagctcatccttttcttttcccagtctgtctagcaacattaggaaaaatcagccaattactttatatttctaaatttgagacaaatattcaaaagtatcatatactcagtcactgagatctttgcttcttataagtggttggttaggagtacccaatggtgactatttatttatctctattgccagatcattccatgggcaatcagtgctctttgaactgctgaaaatagtgtcattatgagaggagagtgttcccttgactttgacccccttgaccttgaccttgtcccttcatgagcaggaaccgaaggggctcatttcattcagcctgcagtccatggatggctaagagttaacagctcactaaagagtgacttagggccaagattccaggtttgagggtagagtttagccaggagcccagccattctgcatcaatcagaatctaaatctaatcatgttccagagtcaattccaaaaaccccagaaccatttctgaacaaactcatctttaaaaatctcttccttttgaaccattctcagtatcaaaatctgtattagttatggaaacagaactattaggatatacattaatccattcatgtattataattattacatatatataaatgtcattcttaacacagtaatgaatacattaatgttatattgaacaaatttaaaactcattctcacggataagtagaatcagcattcaaaatatcttgacattaaaaagtataacatatctaaaaataactttatgcataaatatattggcatgagcggccttaatctcccacagatgaataagattaagattaggatgatagggcctaccataagcatgtgtgcgatcaagtttaatttataaattagtcacagtgctcttgcattttggggcctttattaagtaatgtaaacgttacttgaacataaacactgcaataaccgtaacagtcaatttaataatcaggatggctaattgaataatatgtgatacactggataaaaaaagattcatgtcataagagggagggagaaagatgatgtgagatttcatcatgctactcctaatggcacataatttaaaatatctgaatggtttatttctggaattttccatttaatattttggacagtagtcaactactttgactatacagttaccacaggtaactgaaaccatggaaagtgaaactacagataagtggggactactggactgttagtctttccaccagcattccacaagtgactccacagccttttaccagtgtaactctgcattaagggaagggaaacaatcatgagatagaaacttaaaaataaatatgcattcattcactctaaggaaagtaacaggcaaggcaagggttacaaagaaaagaacaaactttactctacctagcaagctcacttcaaggacaattataaggtaacactctccggaaaggcaaggccaaagaaatgggctccagacacccccaatccagagcaagtttgaaggggaaaaaaagagaaagacaaattatttccctggtttcttaagcatgattatgttttacaaatgtctgtatttagccagttcttgttttccttgcaatgcagctacaaggtcaccagctatgcaaggccacaagttatgttatgctatacgttacgtgacatatcaccgtatgattaactgcttttgttttgcttctgtaggtctgcttataaaaaccccactctgtctttgttcaaggttcagctttttgtatgcgaatccactgagccagtgcgtacctaaaataaacaatcctcctgttctccatattggtctctcctgtcctcagtttcccgcaacaatcagaccttttaaggactactggacactgtccctgaacccatactaacttcaggagacataaaacatcactggtgtctaccagttagaactggggcttatggaggtcaggtgagcagtggagtttttacacaggttcaaatcacaaggggcccagtgagtccccagacacaccctgtggttacttccccagttctggaatgcacaataggaatatacatactcagcagctgacttgtggagtgaagattgttatggtagaacaggacaagtggaagccactagaactatctctaaccaggaaaactgtaaaccaaaagcaatatagtatttataaaaagattgcagaggttagttctatcatgaagaattgaaaaatgcaggggtggtgatttccatcttatctcaattcaactcctctatttgatctgtgcagaagacagatggatcttggagaatgacagtggattatcaaaatcttaaccaggtggtaatcccaattgcagctgctgtacaagatgtagctttattgcttgagcaaattagcacatctccttgtccctagtatacagctattgatctagcaaactgttttcttcattcttattcataaggaccaccagaagtagtttgttttcagctggcactaccagaagtatactttttctgttttacctcagggttataaaaattcttcaggccattgtcataatttggttcacagggatctttattacctttactttctataagatatcatgctggttcattacactgataacattatgttaattagaccaagtgagcaagaagtagcaactactctggaccaattggtaagacatttacatatcagagggtataaatccaacagaaaatcaggggacttctaactcagtaacatttctaggggtccataggtcctgtcaagatatcatttctgagttgaaggataagttgctgcatctggttcctcctacagccaaaaaaaaaggagagagagagagagagagagagagacaatacctagtggcctctttagattttagagctaaaatattctttatttgggtattcccatttacctagtgatctgaaaagctgctagtttgagtgggacccataataagggagggttttaggggaggtccagattgctgtgcaagctactctgtcccttgggttgtatgatccagtagatccaatggtgctcaaaacggcagtgacaggcattctgtttggagcctttgataggttcctataggtaaatcatagtacaggcccttaggaacaaaatcttgccatccgctgtggctaactatgctccttttgagaaacagctgttggtatgttactggaccttagtcggaactgaattttcacatgggtgataattcaaccatgtgacctgagtttcccataatgaattagatgttattaacccaccaagtcacaacattgtaccttacatagcagcacttcatcatcaaatggaaattttatgtatgtgattgggcttgagaaggccctgaaggcacaagtaagttacataaagtggcccaaatgcccatggttgccacttctgccacactgtcttctctctttgagcctgcatctatggcttcataaggagttccctaggatgacatgaaaaggaaagaagacttaggccaggttgttccctgcgcttggaagaagaaatggccaaaagggcaatcatatatggattcatgggctgtttctgtagccaatggtttgactggatgatctcagacttgaaaaggatataaattggaaatttgggaaagaagtttgtagatagacctggctccaaatatggcaccattccccagggtgatcagccagctagctacctggtggcagattggttacttgaaacattgtcatcacagaaggggcatcattttgtttttaataaaatagaaaattactctggatatgatttgccttctgtgcatgcactgcttctgtcaaaactactatccatgcacttaccaaataccttatcaccatcatggtattccacataacactgcttctaataaaaaaacaaaacaaacaaacaaacaaacaaacaagaaaacctcatttcatggcaaatgaagtgatgcattgggcccatgctcatagatttccctggtcttaccatgtttcccactattctgagatgactggtttgataaaacagtagaagagttttctgaaagctcagttatagtgccagtgaggtgataatatctcacaagagggaacaaggttctttagaaggctgtatatgctctaaatcagtgtccatagatgagttatttctcccattgccagaactcatggtccaggataggaagagtagaaatagaagtagcaccattattcctagtgacccactaaaaaattattgctttttgtttctgaaaccttatgctctgctaacctagagatcttagttacaaagagggaagtgcttccacccagaaaagaaaaaaaaaaagattcctgacacttagttaagactgccactgggtcacttagaactcctcatgcctcaggatcaacaggcaaagaagagttactacactgcctgtagttattgactctgactactagagtagattggtctactgttttacaacagaggtaaggaaggctatatctggaataaagatcattgaaagcctttcttggtattacaatgctctttgatgaaggtcaaaggaaaacagaaaacaactgaatccagtcaagactactaatggctaagtttcttcaagaataaacatctaggtcacccaagatcagctgaggtagttaatgaagccaaaagaaatacagattgggtagtagaagaagcagggatttatcctaggtcacagccagctgtgaccatgtgactagttacagaaaaagataactgtaattgacatgagcatttccttcttattttggtataaatatgtgcatgtttgtataaaatattttttattgtctctcttatttcctggtcatgtaacataagacatataacaaagtattgaagtattgttaattttacatcatgacaacaaactacatgtttatgttcccccaaaattcacatgttgaaatcattgctcctagtgtgacgccattagaaaatgaggccactgggaggtaactattagacataagaaggtggagtcctcacgaatgggattggtgcccttacaaaagggaccccagggctgggtgcagtggctcatgcctgtaattccagcactttgggaggccaaggtgggtagatcacgaggtcaggagatcaagaccttcctggccaacatgatgaaacaccatctctactaaaaatacaaaaattagctgggcatgttggcacaaacctgtagtcccagctactcaggaggctgaggcaaaagaatcgcttgaacccgggagccagaggttgcagtgagctgagatcatgccactgcactccagcctggccacagagtgagattccgtcaaaaaaaaaaaaagttaattaattaaaaaaaaaagcgccccggaaaactttttttcctcttctgctatgtgaggatacaaggagtcagcagtctgcattccgggaaagaacccttacctgaactcaatcatgctggcaccctcattttgaacatctatccttaagaacagtgaaaaataaatttctgctttataagccacccagtctgtggtactttgtcatatgaaaccaaactgacttatccatcatagtaattaagttatgggatatgaagaaaagcaaatgtcactcaatgactttacctcctttttagagcaggtggtgatacattttccactgtacacaagatagatgtatcaagttaggagattcagacctagctattgtcttcatttggagattgagtatgaaagagatgcatatgggtggttaagttaacacgggatggacttacaatgtttatttgtcaattttactgggccacatggtactcagatatttgcttaaacattgtgggtgtttctataacacctggataaggagggattccttctgtctgactaccttttagctgggacaccaggttgttttcttttcttttccttttcttttcttttcttttcttttctttttttctgccttccgtcttaaactgaaagattggctcctgggtctagagcctgttggcctgtggactggaattatagctttggctgtcttggatctcaggcctttggactgggagtgttatggcattggctcttctggtgtagactgcagatctggctgcttgttaacctgcataatcatgtgggtcaattccttataataaatctctttccatatatattctatatatatatttatagaaatttatatatattctatagaaatctatatatatatagaatctatatattctatatatagaatatatattatatatattttatagaaatgtattttatatatatatatctcctattggttctgtttctctggagaaccctaatacagcagctcatatctatatattacattattcaaaaattattttttctaataatgccattcttttgctgcaatctttttggatattgactctactttttatttctgaggatcaatttcaaggttattcagtgtggcataaatgtattcaccccagttactgatagggttttgtttttaatttgaattaaacacaaggcccaagtcagaggagtttactttgtcatgctcactattgtatataatttatcatttgttgctgactcttctagtcaattcataattgtttctattgtgccagatgacatgagattgtacaacagttctgtgaaatatactacatttactaccactcagccattgagttttattcaaatagtatctgagtctcagatgtcatgattaactcttggtcagtcatggctctaagagggtcctatgaggtgttacataatatgatacctgtggcccagcccggtggctcctgcttgtaatcccagcactttgggaggccaaggtgggcagatcacctgaggtcaggagtttgagaacaggctggccaccatggctaaactccatctctactaaaaatacaaaaatattagttggatgtggtggcatcctgtagtcctagctaatcaggaggctgaggtgagaggatcgcttgaacccaggtagtggaggttgacaatgagccaagatcacgccactgcacttcaccctgggcgacagagtgaggctctggctctataaaaaaaaataataataacaaataacaaatatggtacctgtttacctcaagatgtctgtgcttagggctctctcttcctgcaactttctttctccctgactttctcatagttatttcccttattttttctagatctctgcttaaatgtcatttccttagagttctccctttgctatcaatctaaaatagctttctactcaccatatcatcttctcctattgcctcactttattttcctttgtagcaagtgataacattaggcaacataccacactttccctaacttatatttttcagtcttctccagtaaaattttagcttcccaaaagaagacaggctttttctttgttcatctgtgttttcttcttttttttccctagccattcccccaaaatagttgcatgtctgacaagcagtaagtataacaactgataatattctgttgggtgaatatatgaatgactaaatgagtgaataaataaacttttattttaagtactcatcaagcatcctttaaataattctggcatcatgttaaaatcaacataaatccttcccatttttttaaatgtagacttacataaacctttcttatgtgacatcttgattgtttacatcttgctaaagattttgtaaaaagacaacgtgttcattcttttcccaacatgatttcaattctataattttgacattcaccagcccagaaaatacaggagttcctcagattatttaattttcctaggagacaatctctgaataatgaatacctcaggaaaggaggctttcctagagcattttcagtatcacttggaaatagacccaggatagcaaccacttatttttttgtggtatcctcttataaagtcacttaataaagtactggataaaagaagtagatttatattatttctgctcttctcagaggagctttattttagacttaactgacttcccctacctactaaacagcatctctaaaataatgttactaatttccagtttgttagccactcttccaatccacaaacaatgactcattagtcaacagaacatcccttcactcagcccctccctccattctgccatcgacgccacctccagcactgtacaactactgagtgttctcactaggaaatgcgtttattctcaaaaacaaatgtctgtatcagacatgttgggtgaattataactttagtttttatgtagtaagtatattttcaagatataatagctaattagaggcacttggaaattattaatagtgaagttacctatttgagcaccctgacgtttcacatagaatgctagtttcaagctatactaagaaattaatgctgtataatttatatcataaatatctgtagctgtaattttttcttatgaatttaggtttaataaatatttgtaagttacttttacatgatttcatttttttaattcggtctgtgggggatataattttcacatacttgtaatgtaaaattacaatttccagtgctattttatgatattaattcatctgatacatagaaataataacacctggctgggcgcagtggctcacgcctgtaatcccagcactttgggaggccaaggtgggcggatcgcctgaggtcaggagttcgagacaagcctgaccagcaaagtgaaaccccgtctgtactaaaaaaaaaaatatatatatatatatataaatcagctgagtgtggtggtgtgtgcctgtaatcctagctacttgggaagctgagacaggagaatcgcttgaacccaggagatggaggttgcaatgagccaagatcatgccattgcactccagcctgggcaacagagtgagatgccatctcaaaaaaaaaaaaaaaagaaaagaaaagaaataataacacctaactattgaggtaagttttttttgtcatatatatgtatatgtacatatacatcattaataaagtgatacttggaaaatctggaatattatctataccacctctcattaagcaacattattaagttaacaatcacttatattttgttttctattttgagtatattaatttgatattcaactactcttattagaagtagtatttgtaagtaaaactagcaaaattaaagataaatgttaatattcaacagaatatttcagatgtattttcactataattaacactaaaataatttccttttataactcacaatgtatgtagttcttattgtgggataattagtctctgtctagtcactgaaaattactttgaaatacagttttaaacattggaaatagtgtcctgagcttgtgtgttatgttattttcttgtatttcagaaagatcactctcagtataactctgtgaatgcttgcagctgcacacttttgaaagatcacataaatgtacatttgaacgtgtaatcattcttgcatatgtcagtactttacttgaaatctcaactaagaaaggataaagccttgatagtcacatatagcatgagagagaaaaaccatatatttctactaggcctcatatcagaaagagaataggtatggattgaatactaatgacattggggacttcttttgaaagctcataacagatgaaccaggttctgtaagttcttctgaaggaaaactccatttctagataaatatgtctcctagtttttacctatagttttgtatttctaattttatttagtatttgggtaatttaaacatatttaaacagtacatctatgttaaaattttttatccattcatctgttgatgcataataggttgattccatatatttgctattgtgaatagtactgaaatgaatgcttaatatgtggaatcttaaacgattcaagtcatagcaacagagtagagtgactgttacagaggatggaggatttgagtgggggtggggggtgatgattaatgaatacaaaatttcagacaggagggaaaaaaatatatatatagttctatggcacagcatggtgaatataggttaataatagagtattaaatacatttcaaaattactaggagagtacatttcaaatgttctcatcacaaacatattaaatatttaaggtgatggatctgttaactagtttgatttaattactccacattctatttataaatcaaaacattgctttgtacatcatacatttataaaaagtaccgatttacaattcaacaaatttctaacaatatactgaataacaaaatgaactaaaattaaataaaaacataacattggctcttaaaatgtctgaaagtagaaaaaatagtaatagttttaaaagtaaaacaaaaataagttgttaacacgtgagcaaatttttaagtatgttattgtgtgcaatgctgattttcaaattttactacatgattatagaacagaaaactttaacttggaaaatatagccaatttttcataagcactgtaaacattccatactttctggggccgaatgagataatacatttttactgtcaataattgatgtcacagatattaacaaaatagctcactaataatggctttccataaagacatgtgcacattttaactttatattctaggtacaatgcttttgttagtattacttcattgctctataactataatgtttttattaataaatacagtagcatttgtatactgttgattattggtcttatttgtacaattaaatggctcagtctgcagagtttcttaaattgtttcatttctcaaaaagtttcatgtaatttagcatattttctccaaatgccattcattttacaggtaggcaaaattaaatatatatacatccacatgctaaaatttgtcattttagtgactgcttatatgttattagacatgtctatcatcttgcaaaatgcataatttaaaaaatttgatatttgttaatatactacattttcaactacccaaagcaatactaatttttcttttttcccacaaaattaaaacaatatgactcaatattatttgttagttaatatttttcctatcagaactccatagctagtgttctacttgatctttttggcactgaactttaaaaagaacaagtctcattctgtaataattttatttttattttaaaaaatatttcagctcatgatgttaaaccagatacattgatatttattttataattccaaatgataatatcagttgtttatatggattagaaattagttttatatcttacttttgattattatttgttagcatttagtagcaacatttatcaatatggtggcagttcattgtcgtgactatttgttaataacatcttttattttttctattttttttacatttaaaatattctaaattcctttctcatattatagacttgacatttgtaacactaatcccattctttactgattttaatggagattattttactatgccaatagtaaaatagagttactctgttaactctacttttctccaattttattcaagtggctattcatttttacggtggtctcatttcataacctttttttcacagtatctatgcctttttaagaaaacatttgtgtcaagctagctttctcatctctagcagatctcataaagaattatacttttcagtgtcaatattagtttctattttggtttatgttgcaaatttttatgggctgtatttgagctttgtatattaagtgaattaatttgtatgagcagaaatctgaacaatctaaataattgcttacaaaatagtaggttatttttattttaatcttcttgccatttctgtggccactattaaaatcttacgtgatctaaactcgattgactgaatgttatatacgttttccatcaaagcgatgcaccagtactcctggaagagttgaaagattctggagcgattgctttctcacctgccaagaattgaaatggcacatttcctgtgtggctgtgggctccagttagcctctgttctgttgctaggttcatgttgtacactgcgcaatgccctagccacaaactttggggaagctaatggctaccagataacagaaaatctatcttctcaaaaagaagtctggccaaattttgtgctttttattttgctaaaaataacttatgtgaatatcctgcttctgccattttgtttttaataatacattttgcctgtctcagttgccatatgaaaaaagctactactttttttttgcaggtgatttttaaaaagtcagaagctgttaagtataccataagaaaaaatatcattttaaaaactatttttaccatgtatgcttataactattaaaattgaaaagttaatatctattatagtgaatattatctaatgctatataatgagaacccacctatgcttctctgaaaatatcctggcttacagatctatccagcttgaacttaactaacataactccaatcatcattcatttttggtgtataaataaaaaaggaaccacatagctaaatggttttaaatgtataattaatcactatggcctcattatacttgataccttatgccaaggtaaatacaagtatggaagaataaacaggttgttaacagatgaatggatggatgaatccataatacataactttgttgaagcgtatttaaaaatacctaacttattgaaagattgtttgaagcaataagcttagatcatcctataacttataacatctgattaatttgcatgtttacatagtgttcatgtaacaagaggtattctatttgtaatgaaataaaaacactaaaatatctttaaaagcaaacaaatctattttccttctttcttaaacatgtgcatatttattgtaagtgtttgatgttttctggctatgtttttctattaaaggtcttccctgaaaaaaaagaaaaaagaatgacatgtaatggaagctttcaaagtgattgttgatacgtggtatcttttacaaaattgagaaatatatgttaaaatttaaaacatcaaataaaccctttgaggattgtgtttaaatttgtgttattttctgctacattttgtggcctaattatgtgaaattttactctgcaattgtattttgcagctattttactatgaataatttgcatttttttctattttccatggaatttaaattaaagacaatcaacttttcatttatgagagcagggcagtatcacctttacattgtagcaaaaataacaaaagatagagaaatcacttagttttctgagaaatgcaaaaaatgtatctttcctctcttgcatttttggatgctgttttataatgctttttacatttagtcagcatttttgaaaattgtatagattagaaatcttttaagaagtgccctaacagcaagaaaagccatgctatcttctattcataaaaaagatcattttggaaaggtactttccttcagcagcttttggaggctgtttatataatgtagctgcaaaataacattttcagataaattttaaaaactacaaaaatataaattgtatagtgtcaacaaatatgactgtattaaatgatagaaaatgtcctaagtgtacaaatcgagaaatattactgtcatatcacattgaattataaatgcagagctaacctggtatctgttagaaagagaatggaatttgacaactatatcatttaacttataatggtataaaaaatcaggagaaaaagttccccaggtattgtaggaacttacacaacttttatcagtattctggagggtgaccaaattggtagttcactgattattttggccttcacccatcgtgaggttgcctaggttaacaccaaaatttttctgggttagcaaagctactaggtcacaggagggaaattctaaccaatcacttccatactatgccttaaaaaatctaaacacagaaattatgttagaatttgcagccagaaaattaattctcattgaaaatgtgtcattttcatacttagacctgttcattttaatctctattctcatttactctcatttagttatttctcagttgcttgataattaaaataattatacagtatgcatatatcacacttccaaattaagctggccttttatacattatctcaatctctgccaaatgtagacttgtctttctctcacttctttcttgtttacagttaccttgcatttcatggagtgttggaagactcagtttcatcccattcatctttcaaggatcagctcaaatattacattttctaataacacaggcaaaagtcattgactatccatcaagacagattcttgattaaatttttaaaaatacatttctacatgtgttgaattaaaaatcaggacctgtaacccacagaaatatacatatatcttcaaaatttaacatgtgatgtctttaatgttgataaaactatattatccatgtacataagttatagaaatgaataccaaaaattctacccaaagaataacagtaattctttctttgagagtactaaaaatgttctgaataaaaagggaagaaaaacaagctatcaaaataaagtctcagtgatatgccacttagttatgctgtgtaaattcacattaaaattaaaaacccacactttaaaattatctgtggtcttgggctgcttgatatttgatttaaaagcagttaattgaagagtagtaattttaaaagtagtgaatggggttttagttttgtatttgttcatttgtatgggtgctgtattgttgattgatttcttaatgggattcttttaacttcaatgggaatgtgtaagaaaattaaattacgtaaagccgggagcagcttataaaagtcttgggctcagtagtgttatcaccttatattaatatattggatttcccgcaggaagctcaagatcctttcagtatttatcctaatagtaaagtagggcaggtatacagaggggaaatagaatgtctatacaccaataatgggaaaattgaaaaaaaataagatatttcatatttagatgaaacagaatcagaaaccaggtctcctttagctactttggtacagaatgaatggtgctcacacctataattttactaccatttactatggaccactccacagtgtagaaatgggctcagcataaatgctaaacatatcattacaaatacttcatgttatgatgaatatatttggtcatttcccttggggtcacttcccaagatggttattttataacactttaatataaatgcttaacctttaaaaatgtagttcttttggagaaaatcccagatgtgcatacaattagaaccaacatcaaatattttgtgttgccagatcactaattaaattcctgcacataaccttttccttcctgaaatgcaacatttagtaaattattttataattatgcaaacaatgttttgtatagcttttgcattttaatgagtttgggagaaaccaatttagaattaaatcagattctgaaaaaaaacgaaacaaaacgtgttgtactaaagagctgccatctaattataataacacacactactttccatgagtctgtaattcctttgccatttaaaaagtcacaaattttctgcttaatttttgtttttttgcctttttatgggaagatgtttaaatatttaaattcacaaaggactcataagaatcttccaaagtgaagaaaaactgttctgtctcccataaccttttcttttatattacctttcaaaaaagtttctagagctcctatattctatttggttagattagccttcggtacactcaaagtccagggatcaaagtaggcaaaaatataatgcccaactttatttccctgatttcatcaataatttcatcagacattgtatagaacagtattctactaataggactaaatatgcattagttgttaaataaaatgaaaattatgtagcagaataattatcttgaaatattggactttttaaattcgttaaatatctttagccctctttctatttcctgtttttcagaatgtaaggagtataaatggacctgtaggaaatgacaaacttatgtctgagggacaaacatattgacaaacatattatgtctgagggaatcctataaataaagaactggagtgaatagctgaagttctgacaaaaaatatgggaaatatttggtattatagctgtctgagtcttccactgaattctttgtaccatggtgtgctttaaaaaaatataggaatggacaaagaggagtcaaagttattataggactaagaatacgagatagatacaaacaaacacatatgtatatatgtgttcatagatacaagcacacacatgtgtatttggtacagttctttcattttacttaattaaaattgacctcctaccatcaaacatcttttaagtataaaggtgaaagaaagaggtaattagagaatggagaattcaacacacgagagctgcttaaaaagttaccatacatatggcaaaagacactagttggaatttcacaaatgtaggagataaataagggcaataaaatagtacaatgtgagtaaatctaatattggatgtataaaatgataacaatgtctcctgctattttaaagatatatggaataatacatatgcacatatatgtgaaggggattaaatgtggttaaatatttatgacttttaccttgtctggaacgtgtaacaagtaccaatttctattaaaatatggtaagctaattaaaagtattgcaatccctaggttaagcacttaaagagtagtaaaggtaagtgttaatatcaataaaggggaaattggacagacaaaataatcaattgaaaagaatacataaaaaggaaaaatataacatagaatggatgaaacaaataaaaaacaaatagtgttggcatatatttaaaccttaatataaactaactacataaaatgaaagtaggtgaagtctccaaataaaagataaaggcaaaagtagtatcccataaatagatttaaataagaaaatatgtttattttatacaaatatggattaaaataagaaacttttaagtatatgctaaataatatagctcaaaatttaaaaggtaaaattttagaactacttgaaacttattaaaaccaactggcatgaggacctctaactcatttatattgggtttgtgtgtatgtatatacatttatgtttattataaatagatgtaaatgttatatagtcaaatttccaacatttagctacactttaaaaccacatgggagtatggtatatagattgaaacactgagttttttcttgaggactactcccaaatatgtggatatgttatatttgaggtggcatcaaaatactgctttcggaaaaatgtattcagataattcttacccccagcctgatatatataccacagaaaaagacattttgaagtatatgcgtaaggtaaatttcttccaaatatccaagcactattcaaaaattatcacatgctaagccaagcataacagatgagtcataggaatccaacattcctaactccttcctaaattcacacattactaacaaatcatagcagtatttctgccaaactttaggaatttttctcagcacacttcctttcagtcctcttggtaggtgctagaaattctctacaattggaagaacaataagaaataattttacatttctgtatttttcaaaaaaattaagagcaaaaatataccaaaaagcaatgattagtaatcatgttctttattaatgatacattaacactgaaaattagtaccaaaagagtaaaaagtattgccaagtaaatttagaagtcttttctttcaaatgccatatttactcataaatggaaatgaaaatcaagtctgaaatctatttagaaaatagtacaaataagaaactttaatttaatatttttagaatacaggcaaagcaatacccaaagtatttgtagctccaaacttgttattattaaacaacagacagaataaaaaattgactaagggttaacaaaacatcaaaaattaaagaacacaaagaacaaagcattgtaaagtttagtaaagatggagaaaggactctgtcattaaacatataaagtattaaacaaaaatcagagaaaaccttgagaataaatctatgaaaataagttcttgaaaataacaatgatatgcagaaaagtctaactattataagagaaaatacaaaagatgaaaaaaattgattttgattttatgactatatttttttctcatgttttattagtttttgattggaacagctagaattttgcatatcattgaattgttattctatgacaattatacttttaaatgtgaatattataagtaactccagtaatatacattagcaaattcttagcaaatcctaaggaatttttaaaatgtttgcaaccattatgatttatctcactttatttaaaacattttagagtttagagtcagaaatactttccatatctttgtataaagtcagcacaagattgtaaggccataaacaaaacttctaataaacgcatctaaaagaccaaaattgttagtgcatcagtgtgtgcaatttgcaaaatctttaaaaattatgaaagtaaaatgtcagtttattaaacagctgttgtgctaaattattacttccccttctatttctatttaatgtgttttaattagaaatgatatcatcttatttatcatctccttaatatcaagccatcaccatgtttaatgatagtgaaatctaaagtcctttgaaattcaggaagaaaaaaaatgggtgtttactctcaccattaatattgtactttgtcttagaaatttgatcaaatggtattaaacaacaacataatattagttaagtaaataataaaaagaaaataaaaactacctttatttgcagatgtaattctctctagaaataataagaaaagttgtatctttaaattataaagcactacagcaactaagtaagatacacttctcaggaaaacatggttaaagagcctgtaaaaatttcacattgtaagcactcaatctttttttgctgctgcaagaagtgaaaatcaaaatgagatataatctgatatgttaagagtggaggaaagtcaaaaccataatgattaataattggcatagtgaatgtgtaaaccaaatggtcctcctgcacactgttggttgaagtgtaaatgaggacagagaatttggttgtaccaaatcaacaaccactcacatgttttttttgatttagcaattttcttcaagttaggtacatgcagttacataaatacttcgaagccataaaaagtgaggttgtatatttatcttattgatatacactgatggtcaacattcatgtgttattttaaaaaaaggaggttataaacatatgtacatgaaatccactgttaacctttcataagggaggttgttctttccatgacatgaatgggtaggaagttgacaaaaactaaaggaaaatgctccaggaggtcatctctgggaatttagggatgaatactccttgagacagatcagctctgtggagactcatctttggagtctactaaaagagttatgttgcttcaaagatgaggctcattttcatgaagaactaaattctcagtacatcgaaagagtaggatcctgcttctacctacatcagagaacttaagccactagctgagtggtttaagagccagtatgtcagaatatagtgcagagtgatgaaattgagcttgacgtgatcctacaatatgtcttgaaagccctgagcagatacaaaaggttaatggaatttttatgaagagagggatgtacatgcagctccatgagagacagaatatactgggataagtgataccaacaaaaaaacatagtgaatttaaggcacaaccccggtgactaaaaacaaaatattttctgaaggaagactacaatatcatggcgaattttggggaaaaccataaatacaagcaacgggcttatataatatctcctactttctcctcttaggcataaattacaaaagaaaatatatacaaaataaaagcaattacataagatataaaatcaatgttatttgtgcattggtgtttttaaaagatcagaacacaaaataggctacactataaatttgttttctgtaaaactatccatgaggtcttaacagaattggtgattataagggctaggttaattaaatgtctattcaaagtatagagactggaatgtcgaaggaagcaatcaagggtaaaaatcttactaactgggtcagttttgaacacccaacatgaagtagttcaattctaatgtggacgagatagtcttgggcagtgtgatcactccagtgagtgttctagaagtacgaaggcacctagaagtttctctctttgtatataactcctttgtatataaagtaccccctttaggtacttgtagactgctttggggaaaatgaaattataacctgaaggaatatagtacaacagtgaaaataaggcatcaataactggcactgtacagtgggagctaggttccagctgaaatgcaaacgtggttgaaacatactagtacacttctacagaaataaaaattagcagacaaggaaaggaaaggggcctatggaaaagaaattaatcctggaatttaaacagttttgtgttgccaaggtaacttagacctaaaaatagaataaagttgtctggttggcattttggagaacagagtcataaagatttgcaagtcaaatttataatatataagattgtatcagaaaaggagtttgctttaggatagcagcctcatggaaattagatgaaaactaacaagtctatcaataaggcttatctcagtctcatctcaaacaggaaacggctgggcttgatattgtctaagaacttgaatcctattggttaaaggagaacttcctagacttctctggtaatcaagacaatcataagaaaagtaagatgagaagatggttactcaaatcaagaaggacgataaacttgcatggtcttattttgaccatgtaaaaattttagacaatactagtgctgaaagtgtcaaaaggatgagggaagaatattaactaaaaaaaaaaaatcaattttgagttcattactaaaatattatagatataaataacactggaattgcaaaaaggttataacctgaaaaaacacattctttgaaattatttccagagttaaaaatatttggagagtttcagaaaattgattggaatcagttttaaatcctgtaggattcactcaagcatatggccttaccaaatgaatgtatcagcttcttcaagaactccagagattagtggttttctgcagagaagattggactagctgctttcctcatgctgtgtttcatggtagttcacactcagaagtgaattttacatcttaggatccatacaactcctcttcattaacataatttactgggtttagaacagttttcttaaagtggttcacagatcagcagtgtaaggatcaccccagacatgctggacgctagagctaccaactgagaaactcctaacgtggggccaataactggtgttgtaacaagacctccaggtgattctactaacataacgtttgtgatcctctgggctggagatacagagactgacatttaatctggaaatttgaccgtaaggctaatacttccaaaaatgtgatggggatcagggaaataaaaggtgattatacttgatataaaaagccatggttacgttgtttttaaaatgttaacaaatgccttcagaaagcacatgagtttggagacggagggagagaaagcaaatggaggggggaaaagagacagcaaggagaaatcaaatggaaagggagaaagggaaggaggaggatcatatgatggggagagaaaccaggtggaaacggagaaatcagatgggaagaattcaagatgaagggagatacaactaacagaaggaaccagatagaggaagagaagggggctggagagaaagaggggcatctactttaaactgcccccaaaagattccactttttgtgggattaactctgcatccctgggaaagtttaggcagatcagttcctttacttctcactgtgtgaagagtttagaagtaggactgaactgaggaaagccagaggattttttataattcagtggaaagaaaaagacacaatagaaaatacaggccttgcttataatatgggcctgtgaagcttgtgttgggtttaatttgaaaagtgaaagaaacataatagtgtttaaccccacctggagaagtaggccataccaattttatattatattccagtaataagtattatgtatatatgtggtaaaactatatagtttatacacaatatatatttaatgatcatataacgtacaaccaatatagagttgatataaaaataatagatgattcattgatcatgtttgcaaatacacatatgtatttagccatgcaaaaggattatggcaaattacatattctgttagtaatggcattatgcagagttaaattcattctttattttatgtaaaattactgcttaactatatatttactgatatttggaagattgttaaagaaatgatatatatctattttctaagacagacacctatattttaacaatgctagcacatttatgcaattttatttttacttagaatatgtttgaatgtgaagtaatatgaccaactttttagcaagcttaccagaatttttgcgctcaaatttatttttgccttaaaaaagctaatctggatggctatacatttattccaatgatatcaccatttccatttttggaatttatctttaaattgcttccaaaaccttcaacatattactttaaataccaagcagggaaaatatttttcatgttacgatgaaaatccaaataacttttcgaattgggtctgcttaataaaatggaaaatccaactggacaaaacttaaataattttgttttataagtgataatgtaattgtttttctgtatggccactgttctgattttataaggtaatgataataagtttgaaattactataaataattatatcaatgtaagaccaatcataaaaatgtcaggtaattaaatttgaatgcttaatttctgatatttaaccttaaaagctgccttattactacactgaatcttgttctctatgactgtacagagaatatagtatgtttgtgacttcactttttcttaaatgttattaacgtcacggcatcaaactgacctagacaatactgaaaccaaattttattcttaaactagaaaaaattgtcactccatgtgcttatgcagccaaacaaaaggttgaaatgcagtactaagctgtttaggcaaaattatttggagcttatggctgcctgtttttcccttcagacctttgacatataccatcatattcccaatgcttcagcctgaccttattagtcttatttgcatgagcaaggctgtgtagtcagattaaattgcccaaagaagcaatcctattattcaagtgaatgcatttttttttttactttgccaaataagaaatgagacaacaataccaatcaatagacacatttgagatatatttgagatatatcaaataaatatattaacaacattatttactagaaaatttaatttatcaggaaaaaaaaaacttgcctttaaatcctgggacacacttgcggaagaaatatccccttaaatgtgtactagttgttccatttttgcaggacgcagatttgcagtcttcagtatctatctcacagatgttcctttcatatctttgcagaccgctacagttacaattgtgcgaaagggccaggcagaggccatgcactgatatactgtggttccctaagcaatagtcaacattgacaacacacaatctgccaatgtaactaagagaacagctgcatctgaaacacagagaaatgaaaaacccaattagtcatatactttattttgatatatttaagtatttaaatcacacatttatttaaaaacacagaaataaatatttaatgaagatagttgtggggtgcatttaaaaaatattttcataaagtgtccattcttggcaaaattacttttgattactgtgcagaattatgagtgaaaataactttggtgctgaatatatctagtctcaaaaacatattctgccacttaattgctatgttagctgggataacatcatgaactctgcctatgctaatgtgtgtgtctgtgtgtgtattcatatattattaggttggtgcaaaagtaattgtggtttttttcattgaaagtaatggaaaaaaatcacaattacttttgtcacaactatatatatatacatatatataagattattcaaactcagtttgtcactcaatgcaattatttaagatgtagctgtaaggcaatgccaggtattcttatattattctttaaatctataatattttgaattttaaaatatctgtactcttgaatacatgaacataattcatgcattcattattttagttttttagatacatttttaatgaatttgcaaatttcgacgagattttcccatagtaatttcaatttatccaatatatttttctagtagttttttacatagttttcttgtaagtgaagacaattgtgaaatagtctgcaatttatgtaaatgtattttaaatatattttaggtttaatgttgagaactatgttggctatcaacaaaagtggggatatttttctggagttagagagacaaagatttttcactttttccttcctttcaaatacagacgtgcacagaaacacacacacatctgttcaaggcctaatttatttgatcattatacattgaacaacttttcttgggttcctctatatctaggcatagttataagttattaatataaattcttagatcattttaatataataatacattatataatatatccatatgcatttctttgaatattttatatacatacataattgaaaaagaaagcaaaagatgaaaaaaaattaaagtatcatgattttcaagaattctttaccaagcattcaaagggcacttaacattagcatataaatatgtcaatgggctgagaaaagcaatgtcaaatcactttgcttgttattattaataaaaattaacctactgaacctaagtcattacacttataactgtatatgacggtaagcgtttggagccagcaaaaatgttaaaggtgaattagttcaagcctttcttcttgtagttgtaaagaacttagccatttaatgcaatttgtcaaggatcactgagattattaacggtaggaagtgtagtggatgctttgatgtgttcaaatcactggtcttggagagaaaactttggttttaattcttttcaaacatgtattaaataaatatatttgtgcctgttttctcatctgcaaaattctcagctgcacatctatttcacagaagagtattgaatgcattttttactgggcaagtaactgttacctactatatcaaacacccttccaacaaagttacctgaaataaaatcatagaatacagttacttcccttcaatacctttcctcttctccctccacatacagaaaaagaaaaaaaaacctaggtaaattcaaaacaactgccacatggcaaaaaattgttggcctgtgctaggccttgtttaaccgtatctttgtaaattgttaatagtgctctttcacttttaacagtgttctgattggggtggtagattacacggggccctatgtataatgccaagattattacatagttctgtgcctctactatgcaagctttagtcataatgctgtttgttattccatgaaaatgaaaagaaaattgtagaaagttccttcctaaatgaacaggatatcctgtacaagaatacgaaggcatatctttataattcttcctgagctaatctctagtttattaaatctcaataaaggcatcaagaggtagactctaaattatatatgggaagcttacggcattgagaatatttttgaaaattaagagtaatatggaagtactagctcagatactataacaaacaaaaactgtactaattgaaagagagtttgccagttaactattaggatcttgctgaagtctctaatctgaactgtgtggagatagtgacaccttttattaagaggaagatttaataggagaaaatttggggtagaaactaggaatctgcatttggccatagcaaatttgaaatggtaattgacctatttttatatttcattatatttcatgtatttttatattgaccacttgatgtttgttttattgagctttaatgtcctcaagagaatactttttcttgtgtactcgtctttttaaaatttgacgagttgtggttagagcaacaacctacttgttcccaatttttgaatttttcaaattttatttttgacacaacttaggcacattcccttattgtttagcattaccatttctatatcaacctacctacaatacaaacctacctacacatacatatttatatatatatatatttaaattctcaaaaatgattatatcttagtaatatataatgctctgaaattttatctttccatttaatgatatgtctgagataccaatccaaattagcacattttgttttcaaaggttgcaaatattctattatatgaatgtaccataatatttcaccctcagaaggcactgtagttactatgcgttttaatttgttgtgttaatatttatacagaaatggaagtccttgtacaaatatatcagtggattctatagagaggatccataggataaatcccttgcaaaattggccctaatcaaaaggaaatcaagtgtttaattttaatagttcttatcaaagccctctctataaaggttgatgttcagaatgccgggcttcccaaacactggagagttctgcatatcataaaatgttttagtatttgccagtctgattaaaaaatctgtcctattttgctatgatttgtatgtgtttaattcatgaattgcactttttttgcaaagttactggtcatttacctttttgttttcctaataacaacctatttttggtaatttttctacaataaataacatatttttaacactaattttataattagcacaaaagaaaatcagatatcaacacttccttttcctttgcaccacatccttcccctgaccccccccaaaaaacaacttggcagtctattgctttctaatggccattgtttgaaagctcattgggatgttcttaggaaagtgtcgcttctgatgcattggaagtagtccaaaatttctgaaatgccaggcgttttggttttaaatttatttccaagttttaatattctggtttattttaatttatattttcatcaaatactatgtaaatattcctataataatgcaaatatttcttatagaataactatagtgtcttctgagggtcaaatattacagtgcgtttccatttctaactcatcctgccacctatataagatgtttaactatttttgtgttttcatttatctcaatatttccaaataaaatattttacatttattacttaataaaaaagcacatttaaacattattcattgatgtcatcctatggaagagaagtatttacatttcttacactgctccttaccccaaaacacacacacacagacacacagataaacacaccaagcccttatatcattctcccaatataaaattaggttaattttgtaataaattaacattcattttatataattatgtgtttagtgatatcatttgtagctgaaagaggtcatatgcatttacttttacagaacatttttgttttcctggcagtttttaatcactatatttttagttttgtttacttattctaagcatccagtcatcattacttccccatgtccctcaatatgcaaaatacattggatattctctcagcctcagtctttttgtccttagaaatgcctcttctgaatgggtagatccacaggctcacttcatagtgttttctgggatgactcttcaccttcatcctgggaggctttaccgcctgtcttctggtttggatcctcagtttcctaaattcctcatcttttccttacttgacttcctattttaagcgaagtatattatttttaggttagacctcttagaactaaaaatgttcacatattgtagatctgaaaactatttttttctacctttttcttattactttgagggcagtagtcttaagttttggagtttttttcaaaagtttaacatgcatctcttctttgtatttcctctgaattttctccccaccttccaactgactttggtctctggctgtgaagttagagaatttcctaacttacatggttatgcttggctctccacttatattgaaaaataaatcaccaaaaaatatggtttgaaattccatgtattcattgtgagtggttttctagtgactttattgcactgtgatcaaagagacctggctgatttgtttaagaactctctaattctctcagagtctgtattcttttacctacatccactcagtgacagtcaggggaagtggcctgaccacccacatttttagagcagaatagggaaaaataccttgttacctttgttttgggagtagatttttacttaatttctcctctgtagtattgcaccacatccctgggctctgtgtattgctcaagaatggaacaggctgttcgcacagataaaagagagaattcaggagtttaactgtgtgctcataaagctttcaaccaattctttgattttcagctttaccatggtcccaccctcaggaatgactgatgagtacaatgcctgtctttcgagtattcggcttatttagtggcttcccctctgctaccaacttagtttggtggttctagtctttcctgatgctttgcattttaaataatttttgttaggatgttagacactgtaaatattttattgaaagtctagattttgggctgggcgtggtaactcatgcctgtaatcccagcactttgggaggccgaggcgggcagatcacgaggtcaggagatcgagaccatcctggctaacacggtgaaaccccgtctctaccaaagatataagaaattagatcttaggcatcgcgtcatagaggaactacaccttccagaaccctcgcgccctgcgtcgtgctggcacttttaccggccgggccttagagcgcagcctgtagccgggcgccatctttgacgctggcagtcttggttttctgctagtgctgctgctgctgggaggacgacggacggcagcggccaagcgagaagaaagacgtggcagcaagcgggagtcggggatagtgtcatcggttcgggtcccactactttggagcttgtctcaaactccacatacagaaagccaccgaccttattccggtatcctacacccattccccaccctcattacactcccacccctggccctcagcgtgggagtcaagagcaacagggacacttccgtactccttgtaggattggtgaaaccgtaatgacgaacacccctaaactcccataattggtgcggattcctgtggggaaggcctatactgttgacatcttccaggccatctcaaggttctggaccttgagaaggaggctgtggaactagagatagtgatgctttttaggatttggggatattccctgcccaaaaaattcctggaaaattgactagtattaagtgtgaagaaatcttgaagaccagaaattggatcttactgaaaaactgattttttttgtttttcagattatattgttcagctatggaagatggattttttttcatgatcctttgactctcaagttcatctttaaatgaactcttttttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaaattttttctgcttcattattattaattcatggattgagtgttggttcgacctacaggcgtaatagattggaactcagtgaagacacagacgttcctgttgagagcaatcagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattctacatgtaccaaaggtgacagctgcccattccgtcactgtgaagctgcactaggcaatgaaactgtttgcacattatggcaagaagggcgctgttttcgacgggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaagtgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccaagcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgcattttggaataaaaactcttgaggaaattaagtcaaagaaaatgaaggaaaaatctgaggagcaaggtgagggttcttcaggagtttccagtcttttactccaccctgagcctgttccaggtcctgaaaaagaaaatgtcaggactgtggtgaggacagtaactctctccaccaaacaaggagaagaacccttggttagattgggccttactgagacactggggaaacgaaaattttcgacaggcggtgacagtgatcctccattaaagcgcagcctggcacagaggctagggaagaaagttgaagctccagaaactaacactgacgaaacaccaaagaaagctcaagtttccaagtctcttaaggagcgattaggcatgtcagctgatccaaataatgaggacgcaacagataaagttaataaagttggtgagatccatgtgaagacattagaagaaatgcttcttgaaagagccagtcagaaacatggggaatcgcaaactaaactcaagacagaaggaccttcaaaaactgatgattctacttcaggagcaagaagctcctccactatccgtatcaaaaccttctctgaggtcctggctgaagaagaacataggcagcaggaagcagagagacaaaaaagcaaaaaggatacaacttgcatcaagctaaagactgatagtgaaattaaaaaaacagtagttttgccacccattgttgccagcaaaggacaatcagaggagcctgcaggtaaaacaaagtccatgcaggaggtgcacatgaagacggtggaagaaattaaactggagaaggcactgagggtgcagcagagctctgagagcagcaccagctccccgtctcaacatgaggccactccaggggcaaggttgctactgcgaatcaccaaaagaacatggaggaaagaagagaagaaacttcaggaaggaaatgaagttgattttctgagccgtgttagaatggaagctacagaggcttcagttgagaccacaggagttgacatcactaaaattcaagtcaagagatgtgagatcatgagagagacgcgcatgcagaaacagcaggagagggaaaaatcagtcttgacacctcttcagggagatgtagcctcttgcaatacccaagtggcagagaaaccagtgctcactgctgtgccaggaatcacatggcacctgaccaagcagcttcccacaaagtcatcccagaaggtggaggtagaaacctcagggattgcagactcattattgaatgtgaaatggtcagcacagaccttggaaaaaaggggtgaagctaaacccacagtgaacgtgaagcaatctgtggttaaagttgtgtcatcccccaaattggccccaaaacgtaaggcagtggagatgcaccctgctgtcactgccgctgtgaagccactcagctccagcagcgtcctacaggaacccccagccaaaaaggcagctgtggatgctgttgtcctgcttgtctctgaggacaaatcagtcactgtgcctgaaacagaaaatcctagagacagtcttgtgctgcctctaacccagtcctcttcagattcctcacccccggaggtgtctggcccttcctcatcccaaatgagcatgaaaactcgccgactcagctctgcctcaacaggaaagcccccactctctgtggaggatgattttgagaaactaacatgggagatttcaggaggcaaattggaagctgagattgacctggatcctgggaaagatgaagatgaccttccgcttgagctatgagaaatgattgatagctgaaggtggtagtgaggacactttaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcaaacttagtgactccttgaggtgtttgtcagttttggcttttttctcctttgttgtattctttatgtattgtcttgatgtacttaatattacctgagtttgaaatggatgaagacagctgctaccattaaggaccaaattttatgctaccactaaacaaaaatacccactcagtctgtgttagattgtatgtctttttaaaggtatttagagattcaactaagctttaaagagggctgagcagctcaggaagcctgtaatgtgggcataactctttggacctgatcttgatgcttctgctgctctgttggcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatatggttaattttttatttctaattctcccaacaaacccctgttgcccagtatttatgtggtggcctttaaccacctgagggaaaaaatgagcttattcaagctgccaatatttatctatgggctgtagcagtacactgaattgtactgtgccagggatattgagatgctctgggggtatattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccccacctgtcatgttggctcctaaggaactgctgttgtaagcggctcatcaagagttgaacttcacgtagccttgttgggaatatggaaaaggaagaaagccacaggactgcccattcagtcttgttaagattgggatgattctgcacaagcaaaaatgacttgaaatttatgtatcgacacacctctaccaatccatcttcagctgactgaatgttgtatgatagcccttctccaaagcaggggtagaatgttcaggtttcaccacggattttctacttatttcgcttttggaatcagcttacagattccaggtcccttttgtagatattctttattcttttgcttttttaaaaaataaactggtattagtcaatgtttcgtgttccgcattatttgaaccatttgcccttacagaaagagaaatacttgtttgtgttttaaataaaactgatgtaggataaaaaaaaaaagaaagaaagaaattagccaggcgtggtggtgggtgcctgtagtcccagctacttgggaggctgaggcaggagaatggtgtgaacctgggaggcggaggttgcagtgagctgagatcgtgccactgcactccagcctgggcagcagagcaagagtccgtctcaaaaaaaaaaaaaaaaaaaaaaaaaaaaaagaaagtctagattttgtagtcttcctctggaaagccgaattttgttttgccagggagttaagttacttaccattcaacctgatcctttttaagcgtatttttaagtttgggagtatgcgtctagagtaagtttttctttagggctaatttaattatccttttgaagcacgcctcttcaggaggctcgaggaaatattcagggtggtccgcaatgcctccattctggctggctgcaactcaacccccagctcacaaatcccagtagctgtttttgcctggcctcacagagtttcatttcatgcatatgtagcctaatattcaatgaaggactcaggatagctgcctgtatagatttctggagttctttctctctgtgcctcacatttcagctcttttagctcctttaactctgatctctgtctattaaattcagtaagttggatctgccttgtcatggttcctcctctcttactgcagtcttggaagtgcctacatccagaaagccatgttggttctagggcttacctcatttcttttcctgttctgaagactcacacttctgtgctgtgtctgttttctaacgtctgaaaacagctgtctcatgtattttgtccaatttcctagctgtttacagcagagagacagatttggtaccagttattctatcacattgagaagtgatagtccctaaacttgctctaaacatgtttagatttaatgtgaacaactaatgtttccattttcagtttctcttagcagttttcaggagcttcaatccgttaattctcaaatacatccataaatcacttggaatatcttaatgcattgtatgaaagataattcctcctctgtacccatcatcaccactcttcctttaaattgtgggatatgtttttctgagactgtggctttagtgtgtacgagaaaaattcagttgttatcccctcattttggggagtaaaaataataagaatgaggagcattatagtatctaatcttgtccaacaaaaacctaggtaactttggaagttttcttctctctcccccactctcccacttctatgtgtgtataagtgtgtttattgaataaagagccttttatttttatttatttatttatttatttatttgagatgatgtctcactgtcatccaggctggagtgcagtggtgtgatctcagctcactgcagcctccacctcccgggttcaagcgattcttctgcctcagcctccctagcagttgggacagactacaggcacatcccaccacgcccagctaattttttgtatttttattagagacagggtttcacttgttggccaggctggtcttgaactcctgacctcaggtgatccacctgccttggcctcccaaagtgctagaattacaggcgtgagccactgcctcaggctgaataaagagccttttagataatgtcttgcctgacaagtttaaaacaactttcttaccagatatgccataataaaaatctccaagaagttttccttaggctacatctcaatgggccatttaatactatatcaataaactttattacataataagatcttggtgtttatcagaaagggatttgagccagggtgttttaagttggttagtatcttgagtgagaaagatctctgttttcattagccttctcagaaaaaactccccctatttatcaggaatgcaaatgtttcagattgaagtgggtacccagacatagctcaacattgcacaaacaggtgccaaggggaatctgtttccttttctatctaactccaactcctttgaatttttttgacaggtacttagaaaaactgggattgacaaagtgatacagtttgagttatatgttgccatagaaagaggcaagttggcaaatattttggtaaatcatttcaagatagctttgaggaggtcctcaaagcttagtattatacatagagcaagaggattatatgaagtatgaagagaaaatttcttctgattttctaaggaagatattgtttaagatccaagactagaaaaccagttgaataatgtaatagtagtgcttgggcgaatcaaaccttttggtgtgttaagtttaaattctcaggaggatcgggaaatccatggaaccagatggctcctaattgtttacaaggagaaaaaagtcatgcagaggttgagaattgcatggtattaaaacctatagggttaaaaaaattagaaaaaactagtgtggagtttggagtatttcaactggtaatcaaatacagaatgttatgagatagctgatgagatattctttcgtcagatttcctcaaataaataaaggctgttgatggttccatcaagacagttttgcgtgtagggaaataattagcatgtgttttatctccgttaacatatgttcgtaattgcacccatacacttccttagaaggggaaagtttgcaggcctctgaaatgacatttgtacttccatagcagaattcaaaaccaacactatagaaagcatctatagctgccttaaagaaaaaaattggtgaatcagccaagggtgatgggaaacatggggcctgatagacttgtcatatcttgttacaaatgttctcaaaaaagcattattcatgtgcctctgcttcctatgactagatatcagatatcaccaagtctctgtcactgaggagcttatagcttaaaagggggacttttaaataagtaaacacactagtagacattaatcagctcaccaaccccaaaatattggagcattaggaagaactgaattcgaatcttcgctctggtacttaaagtgtgattatgggaatgtgttttaattttaatgaacatcagttcccatctcagttaatagcaaccaagcttcccggtaaaaattctatggttatcctttatgtatctttccccttgcctcttactgccaatttagcagcacgtccaattgatcctactttcaaacagacgtgactacttctctccctttcacagtgacatccaaggccccaacatctattgcctagacaattggcctccagtctacttctacttttgtcttcctccccttgatccctgttcaatttttcttggttgaatagccatattgatcctttcagtatgcattggatcacaatactatcttgctccaaccccttcaggtccctcccattgcactggactatacacactcttggctgggcgtggtggctcatgcctgtcatcccagcactttgagaggccaaggtagacagatcacttgaggtcaggagttcgagaccaggctggccaacatggtgaaacctcatctctactaaaaatacaaaaattagtcaggcaaggtggcatgtgcctgtaatcccagctactcgggaggctgaggcaggagaattgcttgaacccaggaggcagaggttgcagtgagccgagatcatgacactgcactccagcctgggtgatggagtgagactctgtctaaatctatctatctagctatctatctatagatatagatatatctgggattagtggtgaccagcttccaagatgaccctcaatgatcctgcctgcctctgagtacccacactcttgtgaagttccctccctcacacactatgccagggttagtctgtttgactaaccctggttagtcaaaaacaaaaacaaggaaataaaaaaacccaaactcttcagtatgcccttcaaggctccatgtgaccttgtcgtgtctacctcttctgcctcatctgaaccttagctctttccacacccttctcattctgctacagtcatctagtccttactgttctatgagcagctcatttgctaagcacatttcttctccaaggagtggctccatttctcgagtgattcccatttccactggctggtttatcattatcatataagctccatgtctaactcaagtgttaccacttcaaatgggttttcaccatcctagctaaaatagcagccactgtctctcttgctctgttttatatcttcgtggcaatattgccaactgaaattttattattattattttaaaatattatttatttcttactagaaggttagttctgtaatgaccaacttttcctgtcgtgttcactattgttttccaagcacataatcgatacccattaaatatctgtcaaatgaatacgtaatttttaatggggatgatgaataaaatattattttttgaggagggaataaaagaaaataagtatatctataaatactacacttgatcttagccaaaaggccgagaagcgatacgtatatctataaatacttaaaaagtatgaagtactacaatattaatattcttagatatataactaaaagggttggatggtaaacaaagtacttggacatgtttctggtaagtttctctatgagctgggacataagttttacatttaatcctattttctatgttaaaggaggataagtgagttttacccattgaacaaatagacccactactcatatttcacaattagctgctttatgcatatttgaccaacgttgcactttaagcaattacagataacacttagtcctggacttacagatggtttgacttatggatggggaacgcagtagaatattgtgttcccaataatgctgcctatttacaaaagcagagtttccatccttttcattagttaaaagtgaatagtttttactaattaaattaatatttaatatttaatttgtgtcaattaaatatgcacaaattctgcacaaccctcagcccccttttgcagattctgatatgacagttgagtattattatatgagtaatgataactgtcagggccaatgttggaagcaaccatgtgacctactaatacaatatttatcctctgtccctttgattttctgtttagtaggctctccaaattatcactcattatgtatcccaaagcagaaatcagtgtaggtagcattactaaacttagcaaataaaaatatgggatgccaagttaaatgtgaatttcagaaaaatgagtgcttttctggtataagtatgtcctatgcataagtatgtaggggtaccgttttgctaaaaattatttattgtatatttgaaatttatatttagctggatatcatgtattttatctggtaaacatatatataggatatagccagtgacataattcctgatgccatcactggtcctttggctcagaccacagtatttctaatatcagcggagcacagctagattgttcaactgttgcatctgttaaggtggttagaagatggtatttcatggaacaagaatatttactatgccttcctttatctaagtgcctttaatatgtttccttttatttgaataactttgagtgagaaatagacataaaggagagttttcctatgatgcttgactaactctgaatacttcctggcacttgtaagataaacttggtcatgataaattaagtgatcagttattgctcccaaggtttctgtcatctgggtttagggtcagaggtggattttctgtgaagttaggaaaactatagctttagggccgtcactcgcataggtcacttccatggccccatgcctaattttgtattctttttcttaaatacaaaaaaaagagacctcccaaactctataagtgccatgaaaacctgcattctatcccctcatcccccacccatgtctagggataaacagtctagcatgctagctctagataattgctgctttggataatttccagataaaatgcccaaattgacaagacaaatgttttacatgtaaacaagttgcacttacttatctcaggcccccaacaacctgattcatttcagctattggctttttcttttctctatggtcacagttatcacagtatgctctcaggaacatgggggcagagcttcaacgttaaacaggtctttctgttttcctttccactgggagatacctagttcaatgttcctgtaaccagttgtaatatatgccaatctcaaagttaaattctggctctttaggagggagctttcatctgaagacctgggatcttcagattatcactgcgttgtcacttcccctaatttaacagctgcttgttttgctttactccagtcctcaacccccagatgaggtagtagagatcccctactgtttcgtggaacaccagcaacacggacacaaaggcaaactccagctttcctcacacctcttaaagagcatcttgaaccctacaagtctagatggccctggcctattccctgggggatattttttccccataggtagggctggtgagatattatgttggagtcacccggggcctattcttgtacctcttctgtctttctttgggtactttcattcacttggtaatcccatcttttgtcatggctctaaaaaccatccaaatgttgacagctccctagtttatatctgggaaataataggagggtttagagtaaagaagtgacccgatacatgcgtgattaacacatgcttaaaggatcagccccgaattatcccttgactcaaaacttattcaactgtctatctgggtgtcctttaggcatctcagacatactgtgatcacagctgagctcctgatcttgcctccaaatacggtctttctgcagttttccgtatctcgataaatgacaacttaatcttcccagtgtttcaggccaaaaatcatggagtcatttctgactcctctgttattctcacgttagctgttcaaactacctaaataacagtctacctactaaataccctttgtctctaccttcagaatatatccagaatctgatcccttctcagtatcttcacagcaaacacctggcccaggccaccccatctcctacgtggccttgtaattgcctcctaactagtctccctgcttctgttttcagccaactttagtctgtactcaatgtagcagtcaaagcagtcttttcaatacataagtcagagcatgttagttatcctctgctcaaaagcctccaagagcttcccacattaataggaataaaagcccaagtcctataatggcctgcaaggtggtatctgatcagaccctctgcaacgactattgtccttgtctcctaaaattttatccaccacccactcccctccagccttgctgaccttgctgtttttcacagaagccaaacatttccccacttagtgcctttccattggctgttccatctgcctggattgctcttccttcaggtgtgtctatctgtgtgtgtgtgtgtatgtgcatgtgtgtgtgtatacatgcttacatgcttccttacctccttcaagtactttctcaaatgttaccttctcaatgatcaccccatttaaaatcgaaaccccccctccacaattgttaatccttgttttgatttttctccatagcattcattacttctaagataggtttttaaaaattttttattctgtctcttccaattaaatataagctccatgaaatcgggtttttatctgttttcgttcctgctctatcattcctagcactcagaatagtgcctgtcacaagaaatggagggcactcaacatatatccattgaatgcataaaacaggataagaaagtcttaaacatttgcttaatgtgtcttcatcaatccttaaaggttcaaaagcactcaaccctctttctcttctttggacttccccttatggtgtgtgtgtgtgtgtgtgtgtgtgtgtgtgtgtgtgtgtgtgtgtgttttccagctaaaacctaatatccttgagtcacaccattaagagagttgcagctagctcttcagaaatcttgtatctactgaactccaagaacatcatttattcagtacccaaggatgggacatagccaatgatgatgatgggaacattttcaggaactgtgctcactcacatagatttttgttcatggaataagtttctgaaggtctgtttatcagggtaaaacttcagtcctgtatcaactaacaatcccatacagaagggtcactgtttatatttctccaaagcctggtcaaaagtaactttgactaatttgattaaattgattgataaagtaaatcatatcaccaaaacacttctcattccaatgcttgatagttatggaatttgctgagaccacccactgaatacccgttcaaatgaatggaatctcacagagcacacataatcatctctgacttttgtagccatagggatacattaatacctgtgcctcatacttaactgaaaatcaccagttgtctgctgagtagtttactgcatgtcaaatctgaggtccagtgtaatagactgttttaccacttctattcagaattttctaattcatagacattctaattttatttgtctttttctctcaaataccatgatagggtgaaagtttgagcttttgtatcttaatgtttattgaatattaagatacatagagaatactctactatacataaatgcataccattcaatgaattgtccttggatgaacattgctgtaaaactattcaagttaaaaaataatatttccagtatccagaagtcttctgatgtctcctccccatcactactcccttcttcctccccaatgtaactgttacgctcattctaacactggagttcagttgtgtctcttttccaactttctataaatgaaatcatctgtataaatcttgcatctggcttcttttgctccatattatgtttgtgaaattcatctatattattgaatataataactgtggttcattcagtattactgcttcatagtattccactttatgaatttatcacaatatattgtttctagtttttcatttttataaatcatgttgctctgggcattcttggaaatatttttggttaccatgatcccctttctgttgaatatacactttggagtgcaatatctgtgtcataggtatgtacatgttcaactttagtagataatgtaagcagttttcctaaatcattgtcccaatttaactcccaccagcaatataagagacatcctattgctacatatccatgtcagcagttaggattatctctcttctttattttagttattctccttggtaaatagtagtagtatctcattgaggttttaatttgcatttctctgactacaaataagattgaaaatatgcagatatccttttcctgaagtgtccactcaagtatttccttcttttttctattgcattatttatctagttatagttaatttgtaaaagtttaaaaattatttatctggatgcaagtcttttgttagttatgtgtgttgcaaatatcttttctcactctgtggcttgtttttatagtctctaaatggtgtttctgttgaaaagaagtttttaattttaaaacatccaatgtatccatcttttcttatgaacagtcatttttggtcccaatttatcaaatccttacctatcctaaagtcttgaaggtattatctgagttatagtcttagattatcttctaattgatttattattttctctttcacacttttcacagttaaatctacaatcacccagaatggattttcatgtgtggtgggtggtaagggtcatttcttttttaatcgtcaactttttaaaaaaattatttttatactttaagttctgggatatatgtgtagaacatacaggtttgttacataggtatacaagtgccacggtggtttgctgcacccatcaacccatcatctacattaggtatttctcctaatgctatccctcccctagcccctctccccctggcaggccccagtgtgtgatgttcccctccttgtgtcatgtgttctcattgttcaactcccacttatgagtgagaacgtgcagtgtttggctttctgttcctgtattagtttgctaagaatgatggtttccagcttcatccacgtccctgcaaaggacacgaactcatcctttgttgtggctgcatagtattccatgttgtatatgtgccacattttctttatccagtctatcactgatgggcacttgggttggttccaagtctttgctattgtgaacagtgctgcaataaacatacatgtgcatgtgtcttgaattgaaccagcatcatttgttgaaaagactatattctgtgtggatttcaatttgaaaattttatataataaatattgtatctatatttataactatgatttctctttatgtttgtaaggcttagcaattaggatatgctatcaatttatcattttaaggctgattttgtctttttttaaatgtcaaagtatttattttacctcaattgttggaagaactcattggttggagcagctaaacctagatctttgtggagagataatggaaaaaatctgtaataggtgtttgattttctacttaaatctattcactgattactaatttgctcagtttattttctggagtcaatttttagtcatttatatttctccagaaaattatacatttaaaggcatgttttatttttactactataaagctacattcaatattctgttaaatgtgtaaacaattcttgtaaatactgtttttcatttgtagttttggtatgatttttgttttcctattgttacggtctgtatattttataaaatgaatgtctttgattctgttatctattgctgtgaaacaaattactccaacacttagtggcttaaaagaacaaacatttagtatctcatgcaatttctgaggcaaggaaatctaggggcagcttggctggttcaacatctctcacaaagtcacagtcaagcttttcttcctgggctgccattgtctcaaggcttggctggggctggagaatccactgttaagctcactcacttggataccgacagagctcaattccttgctagctcttggctggaggctacattttctcttccttccttccttccttccttccttccttccttccttccttccttcctttctttctttctttctttctttctttctttctttctttctttctttctttctttctttcagacagagtctccctctgttgcccaggctggagggcagtggtgcgatctcggctcaccgcaacctcctcctccggggttcaagcaattctcctgcctcagcctccagagtagctgggatgacaggcgcccgccaccacgcccagctaattttttgtattttcagtagagacgggatttcaccatgttagccaggatggtcttgatttcctgacctcatgatccgcccacctcggcctcccaaagtgctgggattacatgcgtgagccaccgcgcccggctggaggctccatttttttttttaccgtgcagtcctctccatagaactgttcacaatatagcaacttgtttttcactcctttccccttctcactcctcttttccagcaatagatcagagagagagagagcgacaaagacacaaagagacagagagaacaagagagctcaacgtggaaattatactctttcaaagtctaatcttagaaatgacttaccatcacttccacatctgctattgttcaaacagactaaccctggtatagtgcgtgtgggaggagacttcacaagagtgtgggtactcggaggcaggcagggtcattgagggtcatcttggaggctggtcaccactgatcctggttatatacatattttatatatatattatatatattttatatattatatgtattacatatattttgtatatataatttatatgtaatataatatatataaaatatatataatttatatatataatatatgtattttttaagacagagtctcattccatcacccaggctggagtgcaggggcacgatctccactcattgcagcctccgcctcctgggttcaagcgattctccttccttaaccactgaagtagctgggacaacaggcatgtgccaccatgcctggctattttttgaatctttagtagagacggggtttcaccatgttggccaggctggtctcaaactcctgagctcaagggatccacccgccttggcctgcgaaagtgctgggattaccgtcgtgagccactgcgcccaggctggtcatagttttgttgtgaattctatttttttctgatattaatattattttctacttttgatttgtgtatttacatatatatgtttacatgatttttatctttatatttttaaacttttaaaatgtcactatttggctgggtgtggtgtctcaggcctgtaatcccagcactttgagaggccaaggcaggtggatcacttgaggtcaggagttcgagaccaaactggccaacatggcaaaaccccgtctctactaaaaatgcaaaaaaaaaaaaaaaaaaaaaaacaattagccgggcatcgtggcacatgcctgtaatcccagctacttgggaggcggaggcaggagaatctctttaacccaggaagcggaggttgtggtgagccaagatcacatcaccacactccagcctgggcaacagagtgagtctccatctcaaaaaaaataatatatatatatatttttaattaaaacgccactctattttagcaaaacatgggttttgttcattgaatctgaaagtcttcagttttccatagaagaaccgaaaacatttaaatgtactgtcctgatacttggccttacttcttattcctcttattttcaaaaacattgttgaattatatttgtgtctttattaagatgatgtccaaacaggagtttaaaatttcttctgtataatcatggaacattctctgaactagcacattgtagacactcaataagtatttgttgaatcagtgatacagatagatggatggttggttgaaagaggaatgacgccgctttgctaggggaggtgagtgtaggactccctccctcaaagtagtctgttaaacagggaagtggctgcttggttatctgaacaagtattcactccacattttgagctagacataatcattgaaagagagctagaatgccttcctattgacttcctggcctgctgggaatttttgcttccttctcccccagccatccaatttttcaagaaaaattttctgtttgccagcttatttccccaactcccctactcttttgtctttcctaccctctaaagagagtctaggtctcacaggtgatcttttgtagctctgtgatgcctaataatagaacagaaaaggagatggggaagaactgacagaaagactaaagaaaggaattaactagcgagtttaagtggagctgcctaaggatgcaatgcaggaaaaaaaaaacacacacacacacaaaatggatggggactacatgctgaagggactgaagtcaagagggagaatttgggctgcgagtcagccaatgagagattccaaaaggaatagaaagtgctgagaagacaaaagcacatgtagcctgataagggcatggtgaccaggagctcaggtccctcagaaatgagtgtctagttcatgccatcaggtaagctactaagactagcagagctgcagcctgatataggaggaatccagacggataatggaggaaggagatgatgagtatcagttgcagccctgggactggtgcagaagcaggggtggagttcctcctattaacttcccctattgtagatttcactgggaagagatgcctcttggtacagtggaggaactgctccttgaacgtattcaagtggcacatttggctccttgaagtggatccaagtggcacatgggatagatggtggtagaaacagagaagtgcatctcagaaggacatgttgtccttctgccagttatagttctgccagtagatagcctctagggctcagccccttcagggattcttttagctgcagaggtgcaggttaaacaggttgccttaaggtggcccttaacaagtggccttaaacaggtggcctgaaaaaggtggccttagctaaggccaccacccccatcccctcaaaggttggcatgcagtgactgatggagggccatgttcaccctaagtgaggcaactccagcaggcacctacagcttcctgtggagttggctaaggcaatcaggtctgcatcacaacctgacttctccctctgctcaattgttttccccttcttttcacagctgttggtcccaagggataccctagaaatatactaaacgctaaacattgtctcaggtctgctgttggataactcaacccatggcagtgctctgtaagactacggagattttgtgggattaaaactagtagagagtatgaaagcctttttttttttttttttggcagatgcagtattctgagaaatggattaacatgatttaaaatggtggccaagaaatatgattcttcttgtttcattggaaggcctggaagtgtaagaggctaaaatataaaacagactgggaatttgtttcaggagtctaagaataaaatccacaggctaaaagagggttgcagttggagggaaaaaatgtacttgctatttttcaaaaaagagttggaaagatttggtgtcaacctggatgtgaggatgaagacaagccagctagaataaatattgattccaagattgagggcagaggtttctgggagtgtcactgatgggaacagacaaaatggaaaaagacttaatgaagaagataatatcctcaagttttgacatctctaatttaaaatgtcaacaagctatttaagaggaagtttctttgtgttgggagccaccttagttgtccagccatattaaggggctgcaatacagtcatgaaggctataaccagcactatggtatcatgcccagtctaaaatgaggctgagctctgaccaatgtgggggctgcatgtgccaggaagaaggggtgccttttctgactggcacaaagatgttgtgtgagctggtagggggcctggccattgcctcaaaatcagtgagagagacaatgtgatgtctggtgaaatgcacaaatttggtttagattagagatggaaagttagtgaaggagaaaaggctttagtaagttagatttctttagggtgggagaataggcaagtcacttaaaccttctgaatctccttttccttatttgtgtggcaggatgcttttcttttctccactccctcacagcttcctcgtaccaagatatgatagctgaatgagatatttggcaaggcagagaaaagagatggagacgcttagcctaattaatgtgctacacttatgccaagaagggattctatgcttacctagcagataatttaccctgaaactggactaggcaggtcacctttttcttcattttattcttgcatatgcaagatctaattatccagacgtatccacagagagaggaaccagatgaaatgaggaaagcacggttcaccttcaagagaaagaagtaggactctggggttttaagccgaggcatgaaatgtaccgattaatagcgtcattttggaaacacaggtctcaggagttttgggaaggttagtatgagcttgtcagcattgcttatgaataacagtgagattgctgctttgcacctgatctcagtcagacctcagaggctcagccactggggctggttatgcagcaggaatatatccatgcgaccagcagggtgtaagaagtccaggccaggacgggcgcagtggctcatgcctgtaatcccagcactttgggagaccaaggtgggtggatcacaaagtcaagagatcgagaccatcctggccaacatggtgaaatcccgtctctactaaaaatacaaaacttagctgggcctgggggcgcgcgcctgtagtcccagctactcaggaggctgaggcaggagaatcacttgaatccaggaggcagaggttgcaagtgagccaagattgtgccactgcactccagcccaggtgagagagcaagaatccgtctcaaaaaaaaaaaaaaaaaagaaaaaagaaaaaagtccaggccagactccatctcaggctcactggttccaatgtgttccatccatacctcagtggctcttgatttagggaaaaaagcacatcctgctatttaatttgcaaaaattaaataactacttgatgtgtcttttgtgcagataatacccacaaaatattagtttttgccctttttcccttataattttaacatacttattttctttacttgtctcatgttttctttcagagattctaactctctttgctaaatggatataggaataaatactcttaaaatacattttttattgtattgatgtggaaaatgtagaaaagcacaaagggatttttttaaaactctgcaatatcatccaccagtcataatcattattaagatgttttcacagatattcccagcttttattctataaataagactctcatgattcacttatccctcacttgtctaactattttatactttttgacgcactaagattctaaaatgaaccataaaagctggcacatatttatagtaatcagttttcttatttaagaggatgagatagatgagtgtaaataatcttgctatacacaaaattgtttctgctactctgaagacaaggtgttcttacatctcggtctttgagcatatatgtaataaagttttgtgtaaggttgcagactttgtctttaatacaaaggaaaacaacaggtatagccttcatataaattatctcatttaatccataccgtgattttatgagattggtactgttaccttcatgttactgatgagggacctgagccaggagaggcaaaatatctcagtcaaagtagcccagctgctaaaagattctgcctttgaaaaatcgcctgccattgacacctttgtcaccgtcacctccatctctgtctgagccaccatgatcttttttgacctattgcaaaatctatttaacggctacctctaccttggcccctgtatagtgaccaaagtgagcctttcaaaaacataaagcagatcatgtcattcctctgcttaaacctttcactggcatatccctcagggtaaaatccagagcattagtagggcttctaaggttctatttaatctattccccactccctcactttcccagtcactctggtctcacctctccctcttgcttcctgaactcagtgctgccattctccacacagcttgacatgttcctacctcagggcctttacacctgctctgtctcctttgccagaaatctatcactttattcccatctctgattaaatgtcactgctccttcaaacccttgcctggctacgctatataaaatagcccctttcccagctttctttatcaattaccccgattcattgtttttcccgtggtatttgttaccacctggcttttatttgtttatttcttcatttgtttattttctgtcttctcctgcaagaatgttactgtatgagagtggggactttgttttatttgttgtatttccaggcccaaaacagatcctgggcccactaaggaaaatttgttaatgaatgacggaaaggaaggagccagatttccagttcacatcttcaccctaagtccaggctatttcctctatgcattctgaataccagagccacttgaaggaaggaacatacagtgaaacaccggtgatattgtaaaccttccttgcaaccctcttcgcttgccttgctgagattaggaagattggaatgagtcaaagccagagtccttcctcggaagatcactctagcatttgctcttctccactgtcaggaaagaagagaaagcatagagaaaatggtacctataacagtgaattcacaagaaagaggacatgagaccatttgattgtacataagtaacctggactttggatcagaggaccctggctctgctgtgtgacttggaaaaactttttaaaaacctttctgaggttgtttttatcatttttaaaatgaaattaatgatccttcctttggtcatgagagtcaggttctccaaaaagccaaaggaactgtttcctcacgaagtgtcagagagatttttgaaagagctagatactgtatctctgggattaaagtgacaaagcatggcctttaagagatcagaagtaaaagatattttagcacagtggattgtcagtctgcattagcaggtggtggaagagctttcggcagacatgcccctataacttcagttagtggcagcaccattggcacaggtacacccccaggcagctggccctggtaacaaggtggcagcaaggggaattcacatttagaggcaatgaaggcagctgtcgccaccatcataaacttctcctcctcctccttactcttcctcataattctcctttctccctcttctcccctcctcctctcccttcttcatcctcctcatccttcttcatctagctgtgatattttttgtcctggatttaggttgtactggtgaggatagagacagcaaatcaataataatattttaaataaatttttaagcacatatacaacaaacgctgcatttgatacctacactgtctcatttcatcattatttaatctcccttaaggtaggtatagtaactctgcaatggagttgagagaaatgaggcataggagggagaatgacttgcttaaggtctcacaattcataagtgatggcaggaggatttgaacttcttggaggttcagatttgaacctggagtctctttgactccaggacacttgttctaaagtcactcagattcaaaaggtagaatcagatggcttagtgattggatgtgtcagggacaggggactgtgaggaggagaaggggtctaaaatacttcctagttttctgatttgggtggcctgttgaaatgttaatggtgctttacccagggtagggacactctgactcctagaaatagttccagcctctaattagtgtcgagatcattttttaggttaaaaatgagctttgggctagagttacaggaattcttatttcaatctttcacttggttttgcctgtaatagactggctaaactgtaagaggcctcctattaattttaaactgtcttgaactcaaaatagtcaaagtattaagctaatgaaagagcagtgttcttgttgttgagtaatccacttatttattctatagcttcctctcccatgctctttgttccctttgatcataattttaatgggttttggaaaaaatagaaacccatgcactacattggctatatttaacaggagtacctataaaatatcattttgtctaatgtactgtaaataattttttccagatgcttgaatgtttttggagtgtatacctttataaattatacatttttatataacacctgtatctgtttttcctttaattgcttctcaatcttgtgtcacgtttagaaaagcctcctcattttaagatatacaaatattcactctcattgtcttttagaaagcgatagatttatttcataaatgaattatctgataaatttttaaatggtgtaatttttttctaccattgattagaaatgctatgtatattaaaataaattcatatagataagtacatatatttatatataagatatacatatgcatatgactcatatatatgagtcagtgtctccctcagtagaatgtttgatttaacaccccagaacatattttaataccttgttttaatatcttttctcatactcctatagtttttctttctttcaacttttatcctttttatatacacagtaaaacaaaaaatttatttttgttttatatgagaccatatagaatttatatatgaatttagaattaccatatctaaaacattgagcctttctacccaagaacatgctatgcaattgaaagcatttaataatctttcataaatcattcattataattttaagattttcttttgttatgcatttataacagtttattccttggtgttttatcttttgggttactattgtaaataaaatattagtcttcattttattttctaaacgacatttatttcttattggaaatctatacatttcttacaaagatttgtcagtagaccacaaaataaaattattttatttctaataagttttttaaatcaattcttttattttactatattcataatcatatctataaaccacaataattgtgtttcttcctatccaatttatacttcctcattttttgacttgtttatatacttaaatactttcaggagcctaaattaatagcaggcattattgattgtaatgcaaaatgctttattacgtcaacataaagctaaataaaaactactttttatctggtttaacactttctatcctaaattccaccttgatatatcaagtctgtagttccagccttgttctcaattaagatctctccagtaagtttttcggttgtgtgtttttgatccttctaagtcaaagtgttataatgaacctcttaacctagaattgctcttactttgatttttgaggtaatttaatagatgttaataaccaatatgtcttttatgtgtttataatatttttgttttctattttgaaatgtgaattgtgttttatttatttattttgtggtttgtgatgttatttatttcttataattttgaaatatttgtctgcttttgatcctctattatacttttaaaggtgtataatctacttagctttgtacttcctgaaatggatacactaaaatcaatgagaccaatattttctattaatagtgcatttttggtttttgtagcacacactttacttcatacaatggaattcataatgtatcctacctacacacctaatattaaaaattaaccaagataattccctaactctaatataaaaagtataagagaccactaatttacaagaccactatttctatacaaaaaatactaaggaatgactgaactagaagatacattgaagtggttagctctttgcactcatacacagaattaccatgggtttggtagccataaataaagactgataatagtcatttcctattagacactcaagtaggatgatgtatttttttcaatatagttaaaaaattctaagaaatttctgaatgaaaaatatttattgacttaacataaaaaatttattcctgatatagtcaatgattattaaaattgtgtaaaaatatttcatgccaatatgtgacatgaaattcagatctaggcttagatattcatatataggttttatacacacattaacatatgctgtgacttttagaaattgtgcaatctgtgaaaaacgtttgctttgcctgaactgttctgtgcattgaaagatttataacattcatcattcactacccatatcctaaaattaaactgttccagtcaattattctgaatattgacaatgactctagaagttcccaagatgcctctagaagacaaaatactctccctgaaaattactgagctgaaataaatttctccaatttacaaaagcactcatcacttttcacccaaccatgtactagtacgtctagcattttgtcataataattaataaattcaaataaattgtaatatatatgtgtacattgatattgagtactaagagaaatggctatcagattgaaagcttttcagtgagtacatcaattttgctaaaatatcaattttgatgaaaattatagtaacctataaatgttactgatatcttgaaaatatgtaaatctaaagaaattttctttgagaaatcaaattggactaaaataatttatgaatgtattgctaactgtattaaatatataaattttaaaatataaatgggaaacaagtgaataatatgatagaaagtaaaaagcagaagcctactaggtaaaattctataagttaaaaatatgatctgatgtgaaaatattataattattagttttttatcatttatgtttttaatgaaaaaaattctaggaatagaaaaactaaaattattcctttacacattatcctgaatcctaaagttatgacccaaataccatataaactgtggatgctcaattactgttgcattaatatggtcaacaaatgcattttaaacttgagcaagctatgcttaagacaaaggtcaccttttaaagattctgcataaaaggctgcatgaaactccaagtcttagaaaataatttgaaaagcaatgctaaaaggttatacctataaaaacgatttaaatataaatttaaataaaaatctggcttaggtagtataaaactatataacatgcacaagtcattttattgtttgagatatgaaattgaagtatgaaaagtcataaaacctgaagctataatacggtcaaactttaattttaaatatataacgtatgtatttgggaaaaatatatgagagataattgtgtatagatgagttaaatttcaacccatatgaaacttgaaactttattattcaaaaatgcttcatttaatgaagtttgttataataattttggtatgtgtatgggtaatacaatgatatgtactctagaattgcttaaatgaatgatttctatatcattttactataaggatttaagaaccaagattatttggttttctagagcataataaagagagaaaatatatcagtgtatgtaagtgccttagacaaaaagatttagacacttgatctagtggtttcaagactggccccaacccaaaaatacattcaatatgacactttcatatgcagttcgatatcttttttgctttaaaggtaaaaatatacccacataaaacttttacttgaaggcagaaaagtttgcatagtatagccaaaataaataaataaacctaaaaccaactattcaacttgttaataaaatcacggacatcacggcagaaattacaatagtcttagaataaataattattagacttttgggatcagaaataatttaagaaaatcctggtcaaattatactatacttttgtgccatattcacataaagctctatttttacaagcctcctgactctacagaaatagtttttgaaacttcacctgattttcttatggacttttagattctacactttgaaacagaactcttacttataactgaaaattatgttttggatatatttaacattacacagaaaatgtgaatctcctaaaatagcctgtaaaggaaacaggttaaatttaaaacttccagaaagaaagccagaagacacactgctataatcaagcaacttgtatgttcagaaagtgaaaaaaataattactttagtactttaaaaatgtgttcactttctaaatgaaacagaagaaccatgagatgtgttctgaagagtgtataatcttacctatgtatagtacattacctggggacaggtatcatgtctcattgtcataacattttgaaaaatatcttccagttagaggagattcaataaataataaatgtatgaatgaatatatttcattctgttatgatatttctggtagcaagtagggattggtgacttagacataaatttgaggcttcaaaaacaggtgggagtcatgaacacttcacagtctgggcatggtattaagaaattaacatcccagacttagcaaatctttcctggtcttaagtaacaatatggctggtatgatttagtctttggctcattaaacattttataaacccccagaaaaattttttgaagatttcagggcaaaaaaatgtggtaatatgcagacctgtttgcaatacatcatttatataatgaattttaatctgcacccatttaaaatacactttaaaagaaaatgtttatacgctattcattaactttgtgtccgttaacatcatcaacattattagtgtctatcattataatactatcattattttgccttataaattgagtttaattgaaaaatttctccatcccgaaatcacaaagatatttttctacatttctttcatttatatcgtcattttaccttaaacttttagatccctatacacatttagagtctacttctatataaggtataaggttgtaatccagtttcatttaaggtcttattatgagccatttcctcaataccatttactaaagaaccctgtatgttcaaatgagattatagccaaatttctcatatattgagttcccgtatatactcgggttgttgtcagagctctctgttgacccattattattttttttcctttaaaggcacccatatgtgttatgtagtctgtcatgtcatatggttcatcagatcccaccccattagtcttccttttcaaagatgacttcataatttagaaaatattattcataaatatatataacatgataattagtttctaaaataacttgcaatatttttactattgcattaaatgtgtgaattaatttgggaagaattaatattttagctaatttaaggcctaatatttaactccatgcattatatttccatttattcagtgtatatataattttctctttttcattgagcttagtggtatatagagggtctttttaatggagaattagagcatcttttttttaattctaaacattttgcatatcttttgacattataacaggtggtatcacacatataatttctagatattgcaactgatatagagaaacttaattttatataaaatacttgtatctgcaacatttgttgggctccattgttagtattaattatgagacaatatcaagaactcattaaagtgttgataaattacaaaaattttgtaatttatccaagattctctggatatcaaaaaataatggcaaacaaaagagaatcacaaaatcagaaaaaaggaaataacatcacaaaacgaaggataattttcttagtaaataaaaaagcttctgaaaatcattgtttcattaaacaagtatttgttgagcactattctatgtgtcttttgtggcttactacttttccttatcaaaatgttttcaatgtttattcgtattgaagcacatatcagtaattcatctttgtctattgctgaataacatttcattgtatggatataacaaattttatatatccattcatcagttgatggtcatttgggttgtttcaactttttgactctttcgaacaaaactgtaaacattcacatataaatttttgtaaagaacatatattttcaattttttgagtatatactagaagtagaattgctgggtgtaaagtgttatctcattgttttgatttaaaattccagtctttcagcctttcaccgtaaagtataatgttagttatgtttcttcattcttcttatttttttttaacttctcttatcagattgtggaagttcccttttattctttatttgttgagtgtttgtttcataaagtgttgtgagattctgtaatacaatttttttctccatctacattatcatgcattttcttctttatttattctattgatacattaaattacattaattgattttaagccactaaatcaaacttatattcttacgataaatcccacctggtcatgctgtataaacctttctatatgttgctgaatttggtgtggtatcaccgtgttgaggattcttctgtgaattaatttgggaagaattaatattttagctaacttaaggcctaatatttaagtctatgcattatatttccatttattcagagtatatacaattttctcattttcattgatcttagtggtatacagagggtttatagtgctatatagagggattgaaaacatagatttgcctatagttttcttgtgatttgtctggttgtgctattgttgtaatattggcctcataaaatgagttgggaaatgttctcttctcttctatttttggaggaggtggtgaataactactcttaattttgctttaaatatctgttacaatgtctcagtgaagtcatctagccatgaacatttcatagtgttaatttttgttagtttgtttaattactgattcaatctttttacttgttataggttagatttcctacttcttcttgaatcaatttcagtagttggtatttttctattttatcgaagttaactaatttttttaatttacagttgttcatagcatttctttataattatttttctttctgtaatttcagtaatattttatatcttattcctgattttagtatatttgttaatgtttaaaacaaatgaaattttgttttttgatattctttattgtttatctatattttattttattaattttactctacattttatgatttccttctttctacttattttatttaggtttagtttcctctcttatccattgtgttgtggaagtttaggctattgaggtatttacagctataaattttattcgcagcactgcatcacccacatcccatgagttttggtatccattttcaataatctcaaagtcttttctaatttctcttgcaatttcactttgattcattgtttaataaagattgtattatttaacttccatgtaattgtaaatttatcaagttacttattgattttgatgtttaatctcattcaattttggtcagataatgtcctttttattatttcaattttttgaaatatattacagcttgctttatagcatagcgtaggatatgatctatcttggagagtgtgccatgtacatttaagaaggttattctgctgttgttgggtaatgtgttttatagctatctactatttctagatgatttatagtgttgtttgaatctcctatatcttagttgatttatagccaagtgttatatctgctattgaaagtagaatattagagcctctaattgttattgttgaattggctatttctcccttaaattattttttagcttcattattttgaggctctgttgttagttgtgtatatacatatatatatacacacacatatatgtttgtaatcactaccttttctgatagtttgattcttttataattataaaatatctttctttttctctactaactgtttcattttttctcttaaaatctattttttccctgatgttagtataggcactccagttttcttcttgatgcagtttgaatgatatttttttattgctttactttcagcttatttgtatctttgaatctaaagtgtcttccgtaaaccatatatatatatatacacacacgtatacataaagtgtatcttctatagatcatatatagttgactaaatcagaaaacagccagtctaaacgtctctaaattttgactgaatttctgaaatcactttatttaaatatttttgatatatttgaatttatgcctgccattttactttttgttttccacatgtcttatatctcttttgtacctgtatttttttcattgtaattattctaatactagtttcttttatactaagtaaatctctagggcaatattttattttattgtatttattttctcatgatagggtctcactctgttgcccaggctggagtgcagtggcacaatcatagctcattgaagcttctaactcctgggctcaagtgatacttcttcctcagcctcccaagtagctagggctaggagtacaggtgtgcacaaccacacctggctgatttttttaagttttttgtagagacaaattatcactatgttgcccaggctggtctcaaactcttggcctcaagctattctcttgccctggcctcccaaaacactgagattacaggcttaagtcactgtgccagaccctgagggcaacattttaattttgttaatgctaattttactaaagcatatgagtttttgtttgttttgttgttgttttttgtagttgctttggagctaatcgtacacatcttaacttagcagaatttaccacagatttatgctaacttaattctacaatgacatagagaagttatttctatacagatatattccttcttccctccttttattgtgctagaattgttatacataacatgtattatgtaacataatatataataactatatatgtatatgtaagtgtttgttatggaaattccaatcattttaatcaacaaaaacattgttaccatgaaacagttcgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttgagagggcaaaattcagtctgtagaaccttgtctccagggagataatttgcattgccaggagacaaaaaagggaaggagacgtttctcactctactcttttgtaatttccatcttttaaatgtgaatgtgaaatttactcagaaaggtaagttacataaaatttaaataatagggttattgtatctacatggtcatgtaaatattaagtatctccattaccatggcattttactaaataatatatcagaatataattaattcaataattttgttttacagacctaagacacatgcatcagtactttgttaggttttgaaaaatgtcacagaaaaatatctgtatcctcaggaaggaacagcccattaaaatattattcaaaatcaacaagtatattccaagattaattcagcaaaagtggagtgtatttagtaaaattgcaaatgttctatttggagaaaagattgctttgaaataaaagttaattcaactcagagagaaaacaactataaatattaaggatacgatcaataaagttactaaaaatatggctgtgcttattcaagatttagaatccaaacagaactcattgggtctagtaactactagcctgaaattaggaagatttgtagacaacaaattacaaaagtaattgagagactaagaagatttaggacaataaatgtaagaattctcttttaattgaaaacctaattttgtagaatgcttaaaatataactaatcagtcatagataaaatagcatttgtaagtactctacacattgcattctttgaagcaattattaatgattaatactttactctgtgctgttatttgaatgtcatagatctgtataaaaattaaaatgaaatgagacagagtccattcaaaatggcataatgcataattggatacaattttaaccttgattccattgttctatataaagctactatttcaatttaatatagctaatgttctaaccagaaatttataatgttaaatacttcatcctaaaacttcaagtgtcatgtctcccccagacagggatattaaaggccattttttatctcaaggtaagcctgaaatatagataatatattaatattccagtatttcaaattgtaagcattaaaatgtcatctaatgaattttgtggttaaatataatttgacatattttaatctattcaattgcaatgagtaattttggcactttgtttcaacttttaaaaaagtgaatttctcataatggatctcttaaggaattatctattaacataattagaaattaatacatgttattaatggcttaatcaaagaaactgtaaattgatgtgggacttctttgcaactttgctgtgggtctaatcagtaatatttcatgtactcgtcttcacccaccccatcctttattaaatatagaggggaaaaaagtggctcatgtagactaggactggttcaagaattttacaaatatatgatttataaagtgatatggaggagagacatgaaagaaaaactgacttattgtacagcaaacgttttaaaagccacttaacaaaaattaatgctatatttgctctatttctatacaatcagaaactattaataaatatatatctttcatctataatggccagaattattcttagtaggcctcaggaatggtcaaagtaaaatttttgccagggaaacacaataattgccaatgttcaatacttggtgtgccagtcaatgagggaaacaaaaatgttgctttacaacaatccctcctaatgtttaatgttactgttaattgctttatgtaaactctatgatcttagttccttagtgatgctcttattaaccaaaatccttgtaatacttaaataagtacctatattcacctaaccaaaaatgtgtatatacatcatgcttttattagtcccattagtaaataatgaaaatcatttataaaaatgacaaataaatatctgtaaaaataaaaaaattagtagcaaggtaaatccattatatctctattatgtatacatccaagtctttagtgcactgtgattcctattggtgatttttttcaaaatgattttaaaatctaaaagcttggctgggcatggtggctcacacctgtcatcccagcactttgggaggctgaggccagcagatcatgaggtgaggagtttgagaccagcctggatagcatggtgaaaacctgtttctactaaaaatatatatatatataaattagccaagtatggtggtgcacacctgtaatcccagctactcgggaggctgaggcaggacaatcgcttgaacccaggaggcggaggttgcaatgaactgagatggcgccactgcactccagcctggtcgacagagtgagactccatctcaacaaataaataaataaataaataaataaataaataaaagctttctgagaacatttgatcttttaccagtgttttgttggaaaagcaggtgtgaagttatttcatttatagggaatactttatattacttcatgaatttctggagttatgtattaagacatcacccacagtcaggaccaggaaacttaataaatagaaattcagttttaagattgtctaacgaatttataaatttccccttagtcctgtttatagaggcttaggcagactagttttcaaagaacaaaggctagctctcatgtcaactgtattcatttctgcatgtcattctgaaccaaagaaatggatgaaactcatctgtacttttgactgagggaattacatgatattttgctatcattggaaaacaaataaaatgatctttctttactttcaacaaacccatacactcccccatcactatccacacaccatcatgattctacagaaataaataaactcatttagcctatcccaacagagggatttcacaaatttagaataccataaccaagtagtttggaatactcctgtacaaacatgacagattacatgtgtaataagtgacaaagaaatacacctaagaaatgttataattatccctattttatggacattttttgttttgttttttgaaagatgtaaccacattaaaatgtttatgcctagtatcttacttgcaaactctaggaatgactttataacaatagtagctaacactcatgttactaatatactgatagtggtatactactatttcatttcatcacagtaatggcaagcggattgtaatattgatccctataatgcaattttaaaagttatttttaaatttaatttaagttacataagtgacaaaaaaagaaatttgaattccatgtctataactcaaaggtactgttctaattgttagataatactgctgtaaaatctttttaattcccttctgctctggaataaaatctaggttataatactccagattttaaatgagggctcaagtatacttattttaatattgttttctcttaaactaatttgccgtaagaagaattttatagagaatattaaatataaaaatgcagaggatagtttaatggtatatttatgtcacattttcagtaagacaattactatgcttttcgttaagtaagaattactttatataagtggtagaagttttcttgtagtgttttatacaccttaaggatgccaaaagtaaaacaaaatggcaagtccgagccggtattccactacaaataatattttaattctatgactctcatttcatttggatagctttgaactccatctggtcactgacaggagggaaaaaaagtttgagtttccattttcattaatatcttcactttttaaagtggaaaatggaaagcttcaactgctaacaaatcagcaactaatacattcataaatgaacctgctcctataatggtctaaagtggctctctgtttaagaaagcaattgatgcaattggaccttcctattattttctttaaataatgaagttatttgtttttaaaatacaagtgcatttatattcacagtttacatgagtggacaatattatatttggttttatgttttacacaaaatagggatattgacagaatgttaatatgttcatattaacatactacctaacatatcttatgaacatattacttaatgtatcttatgacctaacatatcttatgaacatattacttaaaataaaaaaaaaaaatttcagactacagaaaattaaagcagaaacttttgttgactggatgaattctaagggtgaataggaaatatatttcagccagctatgacaaatagagaaaaacacaactgaaaaagaaccccagccatctatctttgatactatgtctctagttagctacattaatttaataactcatggactatttctgcatcatagtcttattacctggaaaataggtaggttgtattagatcaacagttctttgctggatgattttgcatccccatgggacatttggcaacagttgaagacattgtttatatcacaacagtgggaagggcgttagggctggcaatactggcatctactaggtaaaatggaacaggagaactccacacaacagaaaattatccaatccaaaagagtaatgtcaacattaggagaccctagaacaggcggtatttatggtttctatatctgggatttcaggatgagttttttagagttaattggggaacatgaggtagagtaaggggctgagatgcctttttaccaattaggtttttttcaaacaaaaatttgaagaattagtaacttttagttccaactgaattatccagaatgttctataaaataccttcaaacgaatcatttttctttgaaaatactacgctaaggctaatctttcacttttcaatgtggaggtccccatccaaagtttatggcatttatttatccagtcttacaataacatcttacgttgctatataattataatatgaatattatggatgatatacatatctttataatccatttaaatcacttctaaagcatgaataatatatatgtcttttacacatgcatgtatacacacaaatacaatttacttataaacctattaagaagttagcactatgggaatattatatatattatatatatatataacatttttcatctctctgtctccaaactttgtgattttataatttcaataaaagtacaattttgttcaaactgtatttgtatcttatgtttctgttcatgcttctgcaggatattttacaagataaaagtgtggtccattgttatttgctttactaaagttctaaattttaaatactactaagaccaccaggaaaatactttctaatttattagaaaatacttacaataaagcattaattcgataattcaagaatgccaatataaatacatgaaatggaacacagttaaaaataaatgtatgaacagtcacataaaccatttcatgtcatcattttctgtatttaccaaagttatagctctttcgaatgattattgctaatgtattcatctctgacaaagcacaattatttatttaaatgaatgaacaaaagaaataaacagactggctcattttcatgggtgactgactgaaggaatttaagacttgcttcaataatcctcaattcatgaatctagatggtataaacacatattgataattttaaaactaaaataatcaaaaatgtacattaaaatatttttaaaataaactgaattattattcatgtaaagaatttgaagtgatataaaaatgttaaataaataatacaatgcaattcagtatattatttcaataacagtttttagtgtactctttgaagcagaaatattataacattctttgtcataatgagaagacaattttaaacatcttttccaaatattaaggttgtctggcatatgagactacatttatgtgactgtatgttgtatttcaatgatgaatgagttttacctagaaaagattaatagaagattttaataaaagtaaactatatgagagtcttacagttattgttgtaagagctaaaataaaagcttcacttatagaaaaaaatactaaaaggtttagtaactactcaatatgaatttgcctgttactaaaatattttattattaggttgttgcaaaagtaattgtggcttttaccattacttttaaaggcaaaaagagcaattacttgtgcacctagctattcatagaaggaggaaaatcaatatttaatttaacattccatgttatgtggccactcacttatttggtggtttcaggctccattttggggaattctacagtttctttatggtttcaggaatgtctgcattaggagaggttgggagagagggtatcttgttggatgtaatttcttcattttactttaatcaaaatagtttctcttgtaactatacacatagagaatttcagaagaggcttttaactgaacagaaggatttatagaacaacaacaaaggtagataatttcaaattaatatggtaatatgcactgctcttacactgatctcttggtcaagtaatttaaaacaagaattaaaaactaaaattgaaatttaggtaattaaattctatgaataattttataaccaaaaggggcaactattgagatgctggagattaagggtatcctatcttaaggaatgtagccattgtggaattaggacagcacttttaaatgtagaacatacctgcatttgtttcttgtcaagttcaccattagagacaaaactgattgtcagaactgtggaacatttgagtagcaacatactttttatactgacaattaggttgaaacaaccgaagaatgaaacgcataaagaagtgtgttcatgcccaccacagaataagaattgcacttaaaaagttaaggaaatataattttgataggaaaatatttgttattagagagaataaagaaattttgtaaagtaaaaaataaacccattgacatattgagtagtagtgtgtacattccctgtccaattctattacaagcaagtctaaatctagagccactaaaatttctatgatagacagtttatctttaactagatgtattttttctgttcaactaaaatgccttagtaatttcagtacgattttttttcttagatgtcaaacatcttttaaaattcaagttatggatcacttaactctaaatacatgcttttattttatttccaaagcttagaagacaaagattattaaaatctgagtgttcaaatataaaatatcttgaagtatatgcattaaatgttccatattttaggctaccattgagaagatgtttctctaagcaacatttgataagactaatcatgaaactaaacagccagctgtttagattatagtacaatccttgctgccatgtataacactattatcatcattggttttataatcctttggctcaacttactacttactggagatagccgaagagaactaacaaagcttttaatgtgatggtgttaaaaggtgatatggttcagttgtgtccccacccaaatctcatcttaaattgtagttcccataatccccaggtatcgtgagagggaccccatgggaggtaattgaatcgtgggggccatgtccccagtgctattctcatgatagtgagaaagttctcatgagatctgatggtttttgtaaggggcttcccccttcccttagctctctccttcctgccgccatgtgaagaaagaggtgattgcttccccttctgccgtgactgcaaatttcctggggcctcttcagccctgcagatctgtgagtcaattaaactgccttcctttataaatactcagtctcaggtatgtcttcattggcagtgtgagaatggacttacacgaaaggcgaacataaatccctttctattgggacaacagtatttggagttaagagttaaaaagaaaacataaaaggatgaactgtaaaccttcattcaaaaataaaacagcatattatattacactttcatatgcaataatatttttaaaagttcaatgtaagtataaatttgtgtgagatataaccaacttattatagttgtagtttcataaattaaaagatgtggatgaagttccaagatttgaaattactacgcttttattatcaaagttaaagatggcagagtaataataattatcttaagtttgaacaataaatcattcagagggtggtgcccagctggttgtttacttttccccttagagaagattgaggaaatagtattaagatttactattagaaagatgtttagaagaataattttgtgacagtgattaaattctaaaatccttgatccaaaagggaattgagagtatgaaattagataatgaaatttcctgctgtgtatcacatgccatcactgaataaattctcttgccacatatttttgtattgtgtttcttttcctctgtgtcataaacctctatccacctcatttaacatttttactgatttttttctcccataaatcatattcttattgtgccaaatactattaatataaaatctaacaggctaacataaagaaagagatgtcactttatccttagaggtatctccagatgtgggcctgtcatgtggcggggggagtatctgctgagcctcttaagactgtggagatggcagaagcagttttatgcctctgaggtctcagcaaattggcatcagtcacacttacctgtctgtttccttcactgatctcttttaaactatttctaaaccttccccctgtccatatcgtgcctctgtattcgaaatataatattattagacacagaattttacttaaaaatacctactcacaggaaaataatgagactttctcaaagaaagatcattcctatatttttggcaaagggatgggctcctctgggaagcctttcagagagctacattgacacatttgtataaaaataaatgaaacagtattcatcataactacgtgtctcttgcaggattctataactcctaaactaacattctgcagatggcatgccaatgtgttcaagagggatcatatataatttggatagttttgatatattaataggatatatacatcaggctttctttttaaaaagtgaaatatatatgatcttagaggcaaatcaatgacttttatatttttgaaacccctaaattaactttttaagccaaatgaggctattatataatagtcatcattctttaaaagtttctacttccatttcttcccctcctgataagtttattttctcctgtatcacaccactcaaatttctagtaacctcttaacttccaaaaggaataatggtgtgttcctcatgccctgtgacttcctaccaggatttgcttacagtcactatccctgaatggaaactatttttctctgatcccaagatcctaagcagagcattgtgtgtatgttgtactctacttccaaccaaccctttaaagcaccaggcactctgcatgttgcattctggccagagtgcactgctttgaattcctctcatttgactctttgacgatccttactcagtgctcttcttcagcctgtttcgtcagtctgcaattatctttttcttctttacctccagttgaaattttacttctatttcaatatctattttaaatactttctccttctaatgattaccctcacacccacttaagtacacacacttgtacacacactcactacctctctaggtagaaatggttgattcttatcttgaattctgcttgtactctcacgtagcaaattttttcaaacagccaatatataaacttcaattggacttatcgctgtattgaaggcccagattattattttttagaaattggctacattctagaatgcctagaaaaccaaactagattgtatacttaaaaaaattaaattaaatcttaaaagtacatattaatatttctaataattcagctaagaaaaaacactttctctgaatgtagcattttaccattttcctgacatttctattttctaatgtattagaaataaatgttaaaggttttggggggtgataatggcctatgttttaacttcggcttaatgtttattaatgtgttacttctgaaatcaattatttctataattgttaaatatgtctttataatgtctacaattgttaaatatatctttataatttaaaaaatcatatgctgaaagcaaaaccattggcaaaatgaacgcgttggacatttttaaagcatataagaaagaaagaaaggattacagcacaatactagagaccttagtgcttaataaaattctatgtgttttcccacaattccactttaatattaagtgtaattgtaaaatgattctgaagatgtagcaagatgagtgtcaattataggcaaaagccaggaaagggtagcatggaaccttctagttctttcttccactaccacagtacccaatgaagcaatgtgcaacagatggtagaggctccatcaacctgaagcagaatatcctgctgcctacaatacacatagacatatcaacacaaaactttttctttttaaatttttaactgacacgtaatatttatacatatttatgggatacagtgtgatgtttcaatacatgtataaaatatgtaattattagggtaactagcatatctataacctcaaatatttatcatttctttgtggtgagaacattccaaattctcttttctacctatttaaaaatatacactatattattgttaactatagtcacttgactgtacaacagaacactaaacattattcttgctatctcactgtaactttgtacccactggacaacttcttattcccccactcccaaatccctctaggcctctgctagcaactattctactctttacttctagaagatcaacttttgaagattccgtttatgagatcacgtggtatttgtctttctatgcctggcttgtttcacttaacatattgtcctccaggcaatttcgtgttgcctcaaaaaacagaattttaatgttttttttttatggctgcataatattacattgggtaaatataccactttttttttttatccattcttcagttgatggacacttagattccataacttggctattgtgaatagtgctacaataaacataagagttcagatatttcttcatcatatttatttcatttcctgtgaatatatacccagtgctgggattgctatatcatactaaagttcaatttttaattatttgagggatctccatacttttttccaaaatggctgcactaatttacattcccaccaacagtgtgtgaaggttcccctttctcaccacatggcctctccaacatttgttattttttgtcttttgataatagccattgaaggtgaggtgagatggtattttacagtggtttgtttgcttgttttgagacagggtctcactctgtcacccaggctggaatacagtggtgccatcacagcttattgcagccctgactccatctcaatcaatcctcccccctcagcctcccaagtagctacttactatatacttaatctgtgtgtgtgtgtgtatgtgtatatatatgtgtgtgcctgtgtgtgtttctcataatgcctttccataatgtaaggaacatattgggaaggtccttggaattacagtaaacacaatacatttaaaagaaaacaacccatttcatagttctagatattatcttttctctttctctttctagttcttggtttattttcttgcctttttagactaaatctctgactcactttttgaagctcctaataatgcaaaaatttcttctgaatttactaatttaacctcttttgttatattcacccacacattatatgcatgtcaccattctctctgtctggaataatctttcccctgatttttgcctggttatgtactactgattcttcagctatcacttgacatgcctttgcgttggaaaacctctgggtcctggacttatatactctctcataatttgcattcttaactctttttattcttaacaaaattgaaaattaaattattttttatatttaataaggcatttctgtatccaccattaagccatatgctacctaaagacaagcaccatgtgtcattatctctgacatatcttgtcacaggcaagcacagtgctatgatgagaacataatagatacacaaaagcatgtgatggataactgcagtaacttataatcaactattttgaaaatggtatttctaggctaatcatacttagcatcattgtatcaatttgtatgttcatcttaatattcactaattttgatcattttttcaaaacacatttctattctatagctttcacttttcatagttaatttaaagttttctaaaaaatgaacattttcataactttaaaaaaagcctttatcaattattctaacagcattcagagtaaaaggcaacttaatttgattgattaattttggatttagttaagttagaagttgccaaattataatatagtatataactgaattttatatatgttagatatttacaaattatgcattgaattcaagttttaatatttaacatctggtaacttttatgaaacagatattttattactatatttcaaagtttcctgttttattgcattttatttacttgaaataaataaacaactgaaatacaggatgaagataacaacaaaactcacagctaacatttatcatgagcaggtataggataagtgattgacatatgctatcttatgtaaccctcacaaccacccagaggggtaaacgccactattctcatttagacatgaggaaactatagtcataactaggtatccagttctaaaaaaggagcttaactcaaatgcttgaggccctgccatgatgcaccactacttcattgcattaaacacagtttaaaattaaactacacatatccttaaaatttatctgtgggagcaggagaaataaaactaagaagaatggttggttttattaaaatccctttcctaatgtcattgagcagtacaacatgtttataattaaaatgaatgaaacttaacattggctttattcttttgtgattcctgcacgtagcatccttctctaccacatagcacaacattatggacaacagcatgagaaccatctttaattctgcctcctgtttccagtaactccagcaataggagtcaatgttgaagataatatgtaaataaatcactaataattcagcattacccctaggtgggctagggaagagcataaattatttcaatgtacagtccagtaaatcctttgtttttggtctctgatgcgtaaccattaaagatgcaccttattaagaaattcttatgtaacatttctagacataaatgtcatctgtctttccaaaactgtcttttaaaacaaactcctattcagctatctttacatagttgagtagtataggacatttgttaaacataaatggaaaaaaccatattcttcagaaacaaaatattattcatattagaagatcaaatggagactttttgcttctctataatattttattacttctctgtttttcttctgatacttcgggcgaaactggtgcaagctaagagttgaaaatcaatgccttagggcatgggcttttaataccactacatattagaatcaccttgaaatagtaaatacatgaaagctgacagcccacctcagaacatttaagttataattggatggggccagaatgtttagagtttgaaaagtttcaaggtgtctctcatatgcatacactattgaaaactactcttaagaggtaagaaacctaaacaaataaagtctattcttaaaattcaatttttctacttactctcccatagcaaattcatgtatttcccacgatattatttttttattctccccatataccttacaaagaggtcattagtactctaattatattttgtccttctctttaggaagtgtttctgtcaggtattatgattattttactttataattataatgcaataatattttgcattaaaaattaattaacacatagaatgtaccaggtattgttccaaaaaacttttccaatactgagtctacagcactattgctatcttcatttcacaaacaaggaacttggagcatagagaaggtcaaataacttgactaaaaatcagtcagctgttaggtagcatagacatgatacaaccccagagcagcatggtgcttcactaataataacaaaataatgagttgatagttatatagcaattagaacagctctggcaagtgttaggttattgcttactttactattatcattatgatcattattattattatttactgtgtgattaccatgtgctaggcataatgctaagaactttacatagttacatggttgtatatgctttatttcattttcacctcacaatatccctgtgagatgagaacacttattgctgtaagcaacttgtttcagtcacccaaccaataagcagatgagcctgaacaaaaacccatagttaaaaccatggcgtttttctttttcattttgtatcctgtacaggatttaataatagttttctcaaacagtagtaaactattatttactgaattgaattaaattgaatttgtatatctatgattcaaacttagttacattactttgcagtagagacattttcctttttttatatatatttgtgtctgtcttatttaatatctcttagcctgacgttcttaaaaaatatcagtttatcagatgagtagattgcaaaaattttctcccattctgtaggttgcctgttcattctgatggtagtttcttttgctgtgcagaagctctttggtttaattagattccctttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaatcctttccccatttcttgttttggtcaggtttgccaaagatcaggtggttgtagatgtgtggtattatttctgagggctctgttctgttccattggtctgtatctctgttttggtaccagtaccatgctgttttggttagtgtagccttgtagtatagtttgataaactggattaagaaaatgtggcacatatacaccatggaatactattcagccataaaaaaacgatgagttcatgtcctttgtagggacatggatgaagctggaaaccatcattctcagcaaactatcgcaagaacaaaaaaccaaacaccacatgttctcactcataggtgggaactgaacaatgagaacacatggacacagcaaggggaatatcacacactgggtcctgttgtgtggtaggtggacaggggagggatagcattaggagatatacctaatgtaaatgacaagttaatgggtgcagcacaccaacatggaacatgtatacatatgtaacaaacctgcacgttgtgcacatgtaccctagaacttaaagtataattaaaaaaaaaaaaaatccatcattcacataaccttaagccaatgacctccacaagcttcactttccttatctgtaaattcagataatggtacttacttcacaggaccatttggaatctaaggagttaatgcatgtaaaatacctaggacataaagcgtcaataaaacagctcttttatctcaaaaaaaaaaaaatcagtttagttaaataacggtttatctctttgggaaatgtaagagagaaaacagtctagaattgcgacatcactgtcttttcaccaaatacagaatatgggtgtggtaggcagcttctaaggtgaccgccaatgatctctgactcttggtattcctactgttgagtctggattggatttaaagacttgtttttaatgaatggaaaatatcagaaataatgggatattacttttgagattaagttataaaaagaaagtatcttcagccttgagctctgagtgttgctatttctctcttcaaccccctatctcagtggaaaaacagcctattgcgagcacccctatgaggagagaggtccatctgaagatgaattgatatctctcatcaacagccggtaaaattctgaggcctgcctatagctacatgagtgagtgtgaaagagcgtcttttgaggcctactgtcagtccctttgacaagttttggggtggattatcttccaattcagctttaagatgactgtggctaaataacatcttggataagctgattcacttcggtgtccttagagaccttgagccagaggaacaaaactgaactacattcacaattgtgagataagttttttcttaagacacttcatttggggataaatttttatgcagcaatagataactaataattatattttggttatgtgatatatgtgaattcattttggaatcttcacataaacttcaaacagatagatatgtatgcagctagaaccaaataaaaacaaaggcctacattactgaatattgggaaagatgtgatttttatgtaaatgcaacatatgtgcagataacaaaaatgtgaccaatatgaatcctgaaatgaaagacaggagcaggcactatgaattactggttttcatgtacagtgaggcttctgtcacagaccaattctccacagcatattctaggttaaatgcaggaagaatttttttttttaagtaaaggtgcttgataattctccttattaatgccaaatatgtcagtaggctttccacaaaaaaataaggaatggtacatcattttcttactttttatttataaaactagaaatattcattacaattataaaaattgatttggataacaaagcatttaaaattgatatggatgaaaaagcattgttaatatcttattctaagtatttagtgggatgataagatttttgtttcagtagttctaacagaaccaagtcattaattagggaaatgatagtccttcaaggacatcattagaatgatgagcttctgctttcaacaaagagagaagccagagaaccgaagtaactcaaatttgatacagattcacaaaggatcagaagttcaaaacatactaatgcatatgaacattatattagagaccactgcatcccaaactggtattttacctaataatatataagcagttataatatttttaaaaatgattcctgctcaaataagtttgagaaaaaaatgctggttagacaggcttgttaattgtagggctctcctgtgctttaaattactaatacgcacgattaatctctaagagtgaaccaagaaacagcatttcctaccttcatttgagcattgagatttttgtgaaggctaaacaattagcctcgcccagagtaatgttccatggaacaataaatgaggaacactcttaagtatcataattcaaagagttcacagtaagctacaagaaagcaggaaccacctttagccactcccagtgtactcccagtactaagtacagtactgacagtgcaggcttttactaagaaattactgatgaatgaatggatagacacccccaaactgtaagttggaaagtattagctacatgcatatattattttcaattgtagccttgcatcaaataatgatttatttctcttcatctttctaccagcatctcaatgcaaggtcacttcagaagtctggaggcttctataacagcacacaggatcaaaggaaggaccctccactcaagaataatctgtcatgactgcggctaatatcaacattatccaagaccttatttaggttccttgaaagctggtatctgtgcagcttccattcaggtggaaggtactgaaataatcatagactggcaaaaatggccaagcgcagtggctcacacctgtaatcccaatactttgggaggtcaaggcgggcagatcactcgagctcagtagttcgaaaccagcatgggcaacatgggaaaaccctgtctcaactgaaataaaaaagttaactggacatggtggcatgcacctgtagtctcagctgctcaggaagctgaggtgggaggatcatttgagcctgggaagtcaaggctgcagtgagctgtgatccggccactgcactctaaacctggcaacagaacgaaaccttgtcaaaacaaaaacaaaacaaaacaaaacaaacaaacaaacaaacaaactctatttttaagtcctcactgctaaatgcaaaattttctaccacagggtggtagtaatagatttctgttattgagaagaccctcctccccacccaccccccccccaaaaaaaaaaacaaaaacttttctctcctggtatttagtacttccttcttttttttctcttttatcaggaaaactgatatactattttcaatgagttttggattttctaagggcacacacagagagaataactttaggctacttcttgaagatataattcaatgatttttaaccaatatttatgccatccagcatcacctggagtatagccaatcaaacaaagcatatgaaccaagtaatcacacaatatctgcattgatgtgttgcctacatgcagcagaatgatctggatagctcaccaaaaacataattcatatataccttttttactccatttgccaacatactttatttcagagaaattttaaattatatctcagctgtttctcagagctcctttgtggaaattacatcctggtttctgttccatacttgagtagactacaggctttccagtacattgtccattggaccaaaatctggagcaagagaaatagtgttatggtagtcaggacacagtagctggagccaaactatctcagttcaaattttcgctctgtcacttactaagtctttatccttgaacgtattatttaacctctttgcctcattttccacaactgtaatcaaagggagtagtaatagtatgagttagggtcatcacttaaattgagtgtattaatacatgcatcacttagaacaggtgtgtggtgtatatatctatatctatatttatatatctatatctatacaatcatccctcagtatcctcaggggattgggttcaggactgcccgcatataccaaaatccatgcatactcaagtcccgcagtcagccttgtggaaatcatggacaaaaaatgttggccttccatatatgcggatttagcttcctgcaaatactatgtttctatctgattttggcagatgaatgtgaatgaggaacccacctatagtgatggccaactgtaattattgaaaaaaatctgcatataaatggatctgcctagttcaaaccatgttgttcaacggtaaactgtatatctcttctggactctccatttggaaacacatggacccagaggatttcttcctttgcttgtttatttttatgtgagtttgggcccacatttatctctattggctgatccagaagattcacagaggttatgttcttcatcttgctatcccaaccgtcaggtccaagactttgtattatctttttctcttacttcattgacttgtagatgcccctggtccttgatccatctttgtgaacttaatgattcaaactctgttgtttatagcaggtttaaaagaacagctcttattactagatgttcagaaaaatataaattttatgtttctattaaatttagaagattctacccatttttagcattaaaaaatatgaaatgtttattcagataaaaatttagtccaatgtagatagatatacagtgtcttctaggtaaaaatgtttagtctcccagacacctttccttcttagtttttgtctccttaagatagtgcctattcatagggaaggggttggggggataaatggaacttattttataaggtttcatggtggtaggggaagcaaacaaacaaataccttgagtgctatgtcctcagatttctacggtttccaaagaattggttatgtgctgttggcacagaattggttatgtgctgttgacatctgctagtgatcactgctgattctgtatcgagtgtgagtctctcagcttagaaagcatgtaaaagtgatcatgtgatcaagtgatcttcatcaagtggaaggttcacctcagcttccactgcacctgtcacttatgagctctcactataatttcattttccttcatctggggatagcaggtagtgattcctaaccttttgtgcaaagacctctgacttcatacagttctcccagcagcctcttggtaaattctgagtcctattgtaactctggaacccagggtggttccaaaaggctacaacatagggccttttctccctgacctgttgcattgctaagtaattatagctgagcccctagtgattcaagtaaaccttcaagaagaacctcatcccagactcctggactatgggcaagagttttctcctcattgttattccttcaatatatgtaacatacctcatggataaggatggctcttatattcttatataatcctaaattaaatgtcaactattaagtattatctctgacatcatctttatattccctccatccttattctcaagcaaatgaaagctatacaacaacatagggaggtactcagaaatgcaaatgatgaaagcataatgtcccctcgtgaacacgaaaacaagttcctggtaatttacgtgcattttgtggtaccgccaaatcccaatcaggaaaataagtactgtgtattgaaattgtacctctgatttcaaaattaaaacataaaaatttttagtagttatataattatgttagttgcatgaaatttgtttctaaaatatgactttgacaaagatatatataggacacatagtaatcaaaacaaaagtggcaattttctcggtagtactatctaccctcatgggctattctatggaattcctttccctattgttttaggtaagccgtcagtatatctgttttgcaaagaaaacaatgatactgggattttagtacaactcatgtcacttagtttccatgtctatttctttatatgagttattatttccttttaaaactatcatttatgtatcatgatagattcaaaatatatctaaatacacgttgcttattatgaatactaaagttaagtaatgcagaatttatagattcatactccagtttaaaattaggtagcttacataggggcatttatattgtttcatggaagcaagtttattagtgctttcctttcaagcatagcctaaatacattaagattaaatacattaaggttaatttgagagtagttttaattccataggaacatacattagccatatcttttcatctggaaaaaattataacaatagcaaaacaataagtctaataatgtctacaaagaaaccatatgagattagaaatatgaaaccttgtataaatccctcttatcagtccccatacaattgtctgaatccccatggctacagtcaattatgcttttttttcccccacagagataccagcaccaataagagaacagtttattctgcctcttgcagtgatttttgtgaatatctcaaaatatcgataataagaaatgggtcctgtcaatcaatgcatctgatggatgctaattctatccagaaaacaatattaaccttttccactgtaagcctatcaaatactagagatctaagatggaataatagctcaaaatgaatttctccatgaaataaaaatagaactgcttgttaatttttctcgaaacacagattagtaaaactgcagctgtttcaagaagtgaatttgtgggaaaatgtcaagtgtgagacatttttctttcttgaccaattaaaagtaataacatgccaactttgagaataatagtgtgggaaatagtggcagtttttaaactttgtaaatagaaatatcaaaacatataattagtttcaaatttttggttaattaaacacaaatacctatttatctgttgtattttgctttcatagtgggcttataatgttggtatgaagaaaataaaaatagctttattgttacagcctatgtaacaaagcatgacaaaaacatccagatatctaatttctcattggtctgggtctttcgcagtgtggatgcataattttgttatcaaattgaatggatatttttaaggatataattacatgtttcttggggaagttcaacaatttaaagtatcttgtcaatgttttatattttccattcctccaaaacttaaaattaagtagtgagtcactgattcaacaagatgtacacaaaagtatgtctactagtataaattataaatgtgaaactatagtttagaactctcatcattaaagttattgggttataatagaaacacatgtaatacatgtaaaaatgtataacacaagctcaagttgagttataaaaacatgttttgctcatgaaatttaattttttactaaatttgattagttgaggcttttaaataaacataaacattaatgaattaaataatgtataattccacaaatgttttctccacatgcatcttatgctatggaaaaatatttatccattctttccacaaatatttattgagctttgaaatatgccagacactgttcttggaagcaagaacacatgaataaacaaaaacattctaaatgctggcctttgtggtacttgtgctcatgttttgtatattaaataaaaaagacaaaaactatttttgtgacatttgcagtttgtggttaagcaggcagtaaactcttcttcacacaagtcaacaggggaagcacaggttgtaaatatctgaatgaaagagtgatgtgatacagaataatgtgtgaaggcccattgtagggaagagacagggaagcctttttgaagtgataactccatggcgtgacacacttttaagtttgcctaagacagttttaatttacatttgttgtcctaacagtctgtcagagtagcctttgctccactcaaatatttaggagaatgactaaggtaaagtagtagactgattgtaagcattgaagcaggttcggtaagggatggttttgattgggtttagggtgatagtaactgagattcagaaatgtggatacacttgatacaaatactctaaataatcttcttttccattcctgtatttaagtcccttatctattcaaagaataagtagcattcaagactctaaagttcaaataacagaatgatacaccacttcctgctttagaggctcacagcccatctgaaagagacagacaaataaacacatgcatataacttagagctacaggaatcctagtgtaattggcaatgggtaagtggatcaccaatgaaagagaggtgaattctaactatattcaaaaacaaaaaagattcacagagtaatggaccatggacttgagatttagaagtgaatgatggtcatttgtcaattgggataatatctctgtaaggtgtatgaggtcctaactttggtgaatgaaaactacaatttgccttcataaattgcttacattttttctgaagaaagatagttttataattccatctattaatatttctttgaaccccctgttacctgagaaggcaatctattttgaaatgaaaataatagaagcttaatacattaacctggaaacactttataatacatatcacactgaagaggtcctacataagtactcttctgttcattttaaacttgagctttattatctgttttttgtaaaccccagagctttcttaatgagcattatgaaaaatcttttaaataagacaaaaacattttaggtttctattcctttttttccctcagtgctttcaaagaaatttctgagcataacctgttgtataaattatactagcaggttatgattgtttggggtacttccttgatttttcacatttaaaaataaaactgctcatgttttttttgtttgtttcaaacagcaagtagaaaaattgtcatacagaatgttacctgtaaactttatctttgttcatgttttagatttttttccttgatttgaatgacttcttttttcttttcaggtacttatatgtgaattattttcaaactgtactttttaagcaatagatgcggaaaaaataggaatactgacttattatgtcctcaaagtctcctctcaacaaataccaggagatttccagttttctcttacatagtttggttggaattagctctgttttgattaatactcatgaacaatgtgtttgttctgccctcttttttaaatatgggagggagttgatgttggtaattatttattatttctctcaactttgctataaaacaggaggaatttcattcaacttccgatcacatttgaattagataccagaagactaataataagtaattttacaatgttgatgtgcgggcaattctagggaagactcaaaacccagaatacataaaagggaaaattcacacgattaattacgtttaaaaattcacatggaaacacattaaagagttcaaaagagaaaagggaaaagtaaagccatgaaatacaaactatccacatgagtactaaaataccaaggtgtaggttatacatgtttatatatttgtcaaaatttggaatgtacacttaaggtttgtgcattttattatatgtaaattttacattaaaataaataaatttgaactctagttaatgatagtaataataaggtatttaagcgaaagtacgctgattcctgcaaagtattttaaattgcatccaaaaataaggtagaataatgtatggataggatgaaggaaatatggattgtttgtgccacgagtttaaataaatattagtgttagaatctaggtggtagatcaatgatgttcattgtaaaagacctttaaattcactgccccctttttttttttttttttttgagacagggtcttgctctgtcacataggctggagtgcagtggcacaatcatgactcactgcagcctcaatttcccaggcttaagctagtctcccaccttagtttcctgaatagttgggactaaacatatggccgaccatgcccagctatttttttttttttttgtagagacgggggtctcactatttttcccaggctggtcttgaactcctggactcaagcaatcctcctgccttggcctcccaaattgctgagattacaggcatgagtcaccatactggctttcactgcacatttgaaattttcataataaaatgttgaaaaatttctacaggatgatttctaataaataatataatgcaattgaataccaattaaaaattgcattgacatgaatggtatcaacaaaaaatttaaaataaacacacaagtgaaaaaaatgaaaataatgcataacttcattgtcgatcacatttataaattaaaattaaattgatatttattctattatgtcttgaaagaagaaaataaattataatacacaaggtttttgagtgtgagggtgttgagaattatatacaatgtccacgtgcatataaatttgtacagccttttagaaatactccttttgaatatatgtctaataaatttaatgacattacctttgattcagcaattcaaattttagaaatgtattttcataaaacattgaaagactggatgcaaagatatatatccataagtttatagttatcaaattgaaagtatataacatacatatttagcaaaattatttgattaaatacatttggtataaataatatgattaaaattttttattgtattgtaagcactgatatagatttatatttatggacataaaaagatagccacacttttttgagtgaaaaaggcaagctatgaaaaattatgttgaataaatatgtgtgtgtatgtgtgtatatatttatatatgattgtatgcataaaagaataaacgtctgaaaatgtagaataaaataaaatttgctatctctggaaatgctatattgtggtcaatgtttactttccttttatacatttccttttacacatttcagtagtttgaaaagtaaaaataaacatttacagataaaaacttgaggaaatatttcacatcagatataatgaataattaatattcttaaagtactgagttcttacagttaaaaactaccaatagtcgcaaatttttaaaaacaatatttatttacatgacaaaatggtagtctctaggaaacacagagaataagaaatatagagaataagtattccttaccttccacatatttacaaccagtattcaaaaatagttttaaaaatatgtttaaccactctaaatgtacattaatattctatacacacaaatgtgaaatgatcacatcaaagtaaaactatttattgctttatatttacttactacatattccaagccatactaaaatgtatttaaaatgtaattctaattgcctaaagaaagcatacgagtttgtataaataaaataccattttcgtaaaatgaaattctaagataaatttgaattttgtttttttgaaaaggattataaataacatttagattatatcatcattcatgagttcaaagaagaaatgaaatctcctttgaatgtcgcaccattctgccctgattagatcaattttggacaatgacaatcgtaattaattactcttagccttcaggatgatgcacaactcaaaatacggaaaactgaaattctataacaaatacaactggctttacaacatctgaacaatttaatacatttaaaattacttaaatgaaaagtaaaagttaaagttattgactcaaaattttaatcagcttgactatccttctgcatctaaacatgaattaaacaatcttaaagctagaaatctaaccacagacagatataagtaaaaaagagaagtttaccagtttacttttttctaatatctgagttgaattagtctcttccaaagtattttttttttgcaattttgaatttactagttattttaatgaatgaagaaataataatgggatataatgtcttaagcaggagtgagtagaatatacaaaaatctaatctaagaatgggaatgagatattggatatttatttatgaaaactgaataactaataaaaatgatctcagcaaatatgcttaatttagatattgtgataatttcttgtgaaacttttgaagttaatgttttgagggaactttaaattctctctcaaccacttgcaatttaattaattagctatcaggcatcagtgatattcaaacttgcctccagaatctcatttatgagatttcaccctggatcacatttttagtttgtcataaaggttggcactctgcacaaaattggcaaggcaaaatatttattttcctctgtattcacttaaaaaaaaatactgtcacatctgacagaaaccatagtaacttctctctaaagttattctttctcaagttttttaccctttgtgctcttgacaacttttctgcaaatttcattgtaacagaaccaatacaattaataagattcctgctgtaactttcctcacgccttctatttatttttgtctgtttattaaaatagtactttttataagagtcgccctatgatattactgcttcttttaattactttttgaaaaataaatacttttatttttaagaagtatgtttaatcaaactcatcttaaatttattttgcgtaccttcaaatatgcagttatctgagataattaatgttttaatatggccaaacaaaatttgtgctttaaagtccattatctcagcgaacagaatggagtgaaaataaattatatttaaaaccacacacatacattatgcagaattttctcctttcagaattgatattcacagaaataaaatgccactcttattgtttagttggaaaatacaattgttagaaaattacatttcatcttatgtgtcaatctctgcagagaaaagcaaattagctttccctggaatgtgagaaagcagcaaaagcaaaacactctaaaattataatttcatattcttatatttttatctttatcttgctaaagaataagaatatattccactcttaaaaattcttgattttgtggaggaaacacattcagcaatctttagaatgatatagataagtgtcacttaattatgaggatacattctgagaaatgtatcattaggcaattttgttattgtgtgaacatcacagagtgtacttacagaaacctaaatgggatagcctcctacacacctagactatatgctatagcctattgctcctaggctacaaacctgtatgaggtactactgtacagaatactggagacaactgtatcacatggtaagtatttcaatatatttaaacaggaaaaggtatggtaaaaatacagtttaaaagacttaaaatggtacactgtatagggcacttgccacaaatagaatttgcaggactgaaagttgctctgggtgagtcagtgagtgagtgctgagtgaatgtggaggcctaggatgttacactattgtatacttcacaaacactgtacactttataaacagtgtacactttataaacactgtacacttaggctacactacatttactaaaaatatatttcattttttcaatgataaattaactcaccataacattttaggtttatttactttttatttactctttgacttttctgtaataacacttaggttaaaacacaaaaacattccacaaccgtaaaaaatatgttcttgctttatatccctattatagaagctttttcctttatatccttactatataagctttttataaaaattttaaaagatttattttcgtttgtagtttctaaactttcttgttaaaaactaagatacaaacacacatattagtctatgcctacaaagtgtcaagatcatcaatatcactgcccttcacctccacattttgtcccacagaaaggtcttcagaggaaataacacacatggagctgttatctcctatgataataatgccttcttctggaatacctcctgaaaggcctacctgaggctgtttcacagttaaatcttttttaataagtagaaagaatacaatctaaaataatgattaaaaacatagtatagtaaatacacaaatcaataacataatcttttattataaagtagcacataattatatttgcttatattttttgtatgactggcagagcagtaggtttgttttcaccatcatcaccacaagcatgtgactaatgcattgcactactacattaccatgactaccaccactaagagataggaattttccagctctattattatcttataggaccaccttagtatatgtggtccatccttgactgaaacaactttacctggtgtacaactgtacgtatccaagatagccaaaaaaaaaaaaaatctaatactaacattgtaagaactgtataaaatttaattttaaaattacatgaatcttttaaaatagagaatgtacccttgttactcctaatacttagctgactctcctttttctagatgagaaaaatatcatcacaattgcaaatcatcttaaaaggagattctcattcagtataatataatttcacttacactgaatatcactttttatttcctttattgcattatctcacatttgaaaggtttgaattgccacctggcagtgtattataatatcatattttacattcactctttatcagatatctaacatggaaattcaagttcatatttctttgcagacaaaaccaatgacaaaaagttctttaaacaatcagtttctccaaagctattctaaatacatttaatcctctgaatcaaatgcataatatgaatatgtatcatgttcataagcaagttacataaaactaaattgttatgccactaaaaatatataggccacatatcatgtgtctacacttatctttttgaatgcattgtgtttcaccttttgagatatagttcacacactggttataaaaatatccagcccaggctggaatgcaatggtgcaattttaggtcattgcagccttgaactcctgggctcaagtatcctttcgaatcagcctccctagcagttgggactacaggtgcatgccaccacgcctggctagttttttcattttttttattttttgtagagacagtatcttactaagttgtccagacttgaagcaaactcaggccacaagtgaacctttccccttagactcccaaaacactgggattacaaatatgagctgccatgcccggcctattaaactattccttatttgttggtggtttttcttttttggtttctttgtattgtgttgttctttttttcccccttttttaactattcttaacatatcagagtttgtctactcagatttgcatgacctcaaactcatagggattatttatcttcattagtcattaattgctaacaatgaaatctaaattggtgagggcagaaaaggatacgcagataaattttgttccatcatttagatacatttttatgtttatattttcctattatgatacttttaggtttctggagctgcagaacctttgtcaaaaggtgcattttttcattgcaaatattctaacctatgtgccataactacaggggaacatcctatatataaagcaaattattctattcaaatttgacacatgtcctctgtctctgacaatatttcaaagtcttcctaactgtactttatttaaaacttctataacttttctagttttattaacggattaattttcacaggatgatatgatgcttgcaatattcagcttccttatgatcaaagccaattctaattctgctatttactcacaagcatactaattactttttaaaatatcgtgtttataatgatcaaaatatctctctgtgtaactgattctttttcctagcaaaaagctcattagtagtcataggactcaataatgttaatattcccaggatgaatgatacaaaagattcattatctttatgccacactggaatcattgaactgaatcattttatacgattacaattatctttcaggcaatgtactcatataaatttaactaaatgcttaaatggcctgttgacccaaagggcactattagttttggcttgataatttaataaattaatgcccaggaaataatacatactttttattccacacttttctcttttattttttgaatcaaataaccgtgtgggtataattagaatattgaaaaaaaaaaagcttcctttcttcttggctacccttccttggtatatgcatgtcttcttcactgattatgatgaagaactgagagaattcaacctacataagttcattttctgtataattgcaatttaaaactttaagcagcatgcttccaaccagttttggtgaaactctaagaacataaataaattatttgaaaagtcagtataaagtataccttcagtatgaatataatatgggtatataagaaagactatttcttgttttctcatgaaatcctaattttcttagttttatgtttagttttctttttatagataaattccttaaagccctaagtcatgacaagcagaaaaagactgaaaagatttcgaattaaaattattttattgtaaaaattatattgattgatcagagacagttaaatattatatttacaaattccaatctgtttaaatgtcctattagtacacataaagttgtaatagtatggcatttgcgatttatcgcaagatttctatacctttacagtacagttctctgacattggctgcacacagcaatttcccatagagctttaaaaaatactaataaaagggcctcaaacccactacttctggcttaattggcctaggatgttgcctcatcatcaggatcgttaaaagatccccaagaagttctattcttgagccaagcttaggaaacattgctcaaaaggtatatcaacagaagaataaagtctaaagtgcaaagtagacatttgctttaaacttgtcacatttctcaaaatttatctagtaatatagaaaacattatttgcatatataagccatttaaaatggccctaacaatacttattatcttaacaatttcactagcaaagtccaaaagaacactcataatggtataaaaatatattaaattatttagacatagccagcattttagacagctaacaggatgttaaaacaattaatataacggtgcttggattggcatgtgtctttgaatgtaaaccctgtatatatatgtatatatatgatatatatgtgtatatgtatatatcatatatatttattatgtatgacatataatcctgggtattactattttaatcaaaagataattcagagctcatgaaatatgatgaattgaacttccttgatactgattcggattgttgtttggtccatctatctgattactgcttaaagaaaaacacaggtactaaatttaccatgaactgattaaattaggtgatactaaatttattatgcactgactaaactaattcttgcaagctataaactaaattgtatttattaactgcattatggaatagaaatattctcatgaacaaattcctaaccctctggaaaaataatactttattttaaatatttctattgctgagttaactaagcaacaactaaacattctacaatatgaaatgttaatatcatttaattaaaatacattgtggatattggtattacataatcactcattctacagtattaatcatagaagttttcttttcatatattttatagaatgttattaatctttattctggtatgttatttattataacttaaaaaagcaagtgattaaatttaaattaagatagtttatattagttgattgggaaaaaatagaattgctcatcatattttccctccttttaagtattttgttttttttacttattttactttttctggttagaatttcatcaattttatcaaaaatatgaaggctgtttaggtatgaatttttcttgagcattactgtgtaaacaagataaatatataaagaaaataacaatcttaaaacttaaattaacttttttctaaccaccccagaagtctctgtaaatgaaacagctacagaggcatctcagtttatagatggtttttgcttcaactatttccattgcacagatatacacgtctgtcttataactttaattttcttgtctttcttatgaatataacagtacatgcaaaatcacattatttagtgttggagaaatcaatatattaaattagaggtgtctggaatacaatagatgttcagaatattggtatatttgttgactaaattaattttattatttaatacggtggtgacttctccatggataaggtgagagacctagttgaatcctttctatgaatattcttcaagcaatcttgtcaataattcactgttcatcatagtaattatgaacataaaaaggaaaaacatctgcagtgtgggaaatctgaatttgaagtataattttcagtctggtacactgggtaagatcatttttaagtggaaaagaaagaaagaaatggaccctgaaatattctgtgtgtgagcattagcagcaattcaaatacatgatctgattgccagccaaacagaatttatttaaatatgtacacaagtaaatgggtttacatgatttagggtagtttttacaggtactaaaagttagcagataactttgtcttgaatgtaagccatgtgtacaacagaatgtaaggatccaggcaattcgtttaactgagtattgacttttttcaattatgatgaattatgataaagtgattaaaaacacactacctcggtcttcacataatatatgttttcatttgtaatatgatttcctactttgataacttcaaacctaatttttttatgtttttcatatggatggtttatggttattaggtaaaaatatttatttagattatgaaataaaagagcctaaattaataaagttggaaacttttgcatacttttcttaaacaactgaaaaagaagcaatttagttactacaggcaacatggtgtccatgattagtacaaaatttaattattcacaaagtgccaggcacatgggatatacaatacgacgtgtctttaaatttcacttatttcattttccattatctttaggtttatattatttcacagataataactacacatttcataactaaatctgaaatctatacaaatgcacattatgagtgtttttggagatatggacccccaaacagatggtgagatgctgaaaatttagactaccatataaaaattactcttgctacactgtacttcaccaaaatacacaggactagttaacaattacaccctaattaaagaatcttgttgtctggggtcaaagctttaattcatttaatgtccgtatatttggtaaaaatggtaatatgtatggatatctccagaaaagttcaccacctagcaatatctatgcctgtgaaaggatccagaatatgttgcattaaaaaattatatatatgttggatgtagtccaatgaatgtcatgactcagaagaaagtacaataaaccatgttccccatagatgaccagttgtctccacaaaatgtacatttgttataaaatgcataagaatgaactaggtgtacttaaaatggatctacataggtttaatctacttggcaagaaaaacatttatattattagatagagaaagtggttgcatcaattacagcaaataaatgacagtatttgttttttatttgtcattattcttaaatcctctagaggcaaaatggttaatgaaatacttctcagcctgcatttatatgccagccttttaaataaaatctgtaaatattcaaatacaatctatgcatattctgtagtaatctttaaagattatcaataaagttatagacataaacacatacatgcatgtttgtgtgtgcatgtatacacactacaaaggctagtccttgcaaaagatgagaggtatgttctcattgttcattatctattcaaaaccactagcttactgctacactgtgcagaatcaaacaaaactttctagaacataccaaaaggcgaaattcaatcatcgtgtttgctatttcaaaaatctgaaaaatgttgcttagtaacttgtctgcaagtaggttaattgaattcgaataattattttaaaatactttgcaaattactttgtcctttcatttttaattttacatctacattactattgatcaataccttgcttgagacaaagtttagggtactttgcagttttcatcttttgaacaagactggcaagtagtgggtattaaatgagcattggccaatttaaatgaatactctgaggaaaataattcatcccagttatccgaatattcaaaaccgagttcattttatttatttatatatatatatatgtgtgtgtatatataaatatatatatttagtacatatatatgtactctatatattatctatgtagacacaaagctaaatgatgtttactgtgccacatttttactgtcttttggataatatgatttttaattttttaaatattatgttttcttgagaccagatatatatatttgatttttaaagtatgttttcccccagggcatctacacgaatacttctcagatatggttacttagcaaaaaaagttctcagccaggtgcggtggctcacgcctgtaatcccagcactttgggaggccaaggcgggcagatcatgaggtcaggagatcaaagtcaacctggctaacacggtgaaaccctgtctctactaaaaatacaaaaaattagccggtcgtggtggcgggcgcctgcagtcccagctacttgggaggctgaggcgagagaatggcgtgaggccaggaggcggagcatgcagtgagctgagatcgcaccactgcactccagcctgggcgagagagcgagactccatctcaaaaaagaaaaaaaaaagaaagaaaaaaaaattatcaaatagtatgaacacaaattaatttgatgtgaacttcttgacacaaaattgtatcaagagttagaagaacatgttaatgcattagcatcaagcattaaacatttactcttacagtttttcagttttaagtaattaattttattaaattatatattttagtataatggaaggctgatatccaatttttaaagccagcttttattccacatgttttactcatttattctgatgtaatgacatttttctagtgttaatagtcatataaaatgtttctgctctgtgagtttcttcactaattcttgtgtttaagttttctgagtttgttttaattcactcaaaattatttgttcactctctagaaattcattactcttgcaaataatcaaatcactgtttaagacaattaatgtgttaatcaaccttgtttgcttcaaacaacaaacccacaagttagaccaattttaagactaattttattgaaccagagaatttaatatggcattattttcctatatgttttaagaagtaaatctttaggccgggcgcagtggatcacacctgtaatcctagcactttgggaggccgaggtgggtggatcacgaggtcaagagattgagaccatcctggccaaaatggtgaaaccccgtgtctactaaaaatacaaaaatttgctgggtgtggtggcacgtgcctgtactcctagctactcggaaggctgaggcaggagaatagcttgaacccgggaggtcaaggttgcagtgagccgagataacgccactgcactccagcctggtgacagagtgacactctgtctaaaaaaacaaaaaaaaaaagtaagcctttattttctaataaaacgaagaaaaaataaatacgtatatatcttagttcaatatttttaattcaattggtgactgatcactatgactaactaatacattgaagcttttaaaaatgttattatttccctggcttatttatacgaattaagtattgaatatgtgtataaacattaaaacaaataaaaattaaacatcatatgcagttacaacaaatgatttctaacattaggacatggatttttatggaaagggagaaatattttttatactttctttgatcttcagttcaggtgattttaaataatttaatgtgcttgtttctgcacatattcattaaacatcaagagtgttagaaacctatgtataactaagaaatgttgacctggagaaaaaaaatattgtttcacctcttatctatatttgatattaattcagcaggttgacaatataacaagagcctgtgaacgaagctattgatttacttatgagggacttaaaatatctagtttactagtgacagtcagaatgcaaattaatagagaaaaagaaactcacttgttacgacttcaaaaactattctatcattctatcacatatctattggtaaatgtttaatgatacctgaattaaaattacataaaattagcaaggtatattgataaatgtttaatgagacctgaattaaaattatataaaattagcaaaataagttcatatggtattatttataatatattttttaaatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacaatccccagagtgtgatgttccccttcctgtgtccatgtgttctcattgttcaatttccaccaatgagtgagaatatgtggtgtttggttttttgcacttgcaatagtttgctgagaatgatgatttccagcttcatccatgtccctacaaaggacatgaactcatcatttttgatggctgcatagtattccatggtgtatatgtgccacattttcttaatccagtctatcattgttggacatttgggttggttccaagtctttgctattgtgaataatgctgcaataaacatacatgtgcatgtgtgtttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccatatcctctccagcacctgttgtttcctgaatttttaatgatcgccattctaactggtgtgagatggtatcacattgtggttttggtttgcatttctctgacggccagtgatggtgagcattttttcatgtgtttttcggctgcatgaatgtcttcttttgagaagtgtctgttcatgtccttcgcccacttttcgatggggctgtttgtttttttcttgtatatttgtttgagttcattgtagattctggatattagccctttgtcagatgagtaggttgcaaaaattttttcctattttgtaggttgcttgttcactctgatggtagtttcttttgctgtgcagaagctctttagtttaattagatcccatttgtcaattttggcttttgttgccattgcttttggtgttttacatatgaagtccttgcccatgcctatgtcctgaatggtaatgcctaggttttcttctagggtttttacggttttaggtctaatgtataagtctttaatccatcttgaattgatttttatataaggtgtaaggaagggatccagtttcagctttctacatatggctagccagtttcccagcaccatttattaaatagggaatcctttccccattgcttgtttttctcaggtttgtcaaagatcagacagttgtagatatgcggcattatttctgagggctctgttctgttccattgatctatatctctgttttggtaccagtaccatgctgttttggttactgtagtcttgtagtatagtttgaagtcaggtagtgtgatgcctccagcttttttcttttggcttcagattgacttggcgatgcgggctcttttttggttccatatgaactttaaagtagttttttccaatgctgtgaagaaaggcattggtagattgattgggatggcattgaatctgcaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattatgaatgggagttcactcatgatttgcctctctgtttgtctgttattggtgtataagaatgcttgtgatttttgtacattgatcttgtatcctgagactttgctgaagttgtttatcagctttaggagattttgggctgagacaatggggttttccagatatacaatcatgtcatctgcaaacagggacaatttgacttcctcttttcctaattgaataccctttatttccttccactgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttatgttgtgtctctgccaggctttggtatcaggatgatgctggcctcataaaatgagttagagaggattccctctttttctattgattggaatagtttcagaaggaatggtaccagctcctccttgtacctctggtagaattcggctgtgaatccatctggccctggactctttttggttggtaagctattgatcattgccgcaatttcagatcctgttattggtctattcagagattcagcttcttcctggtttagtcttgggagggtgtatgtgtcgaggaattcatccatttcttctagattttctagtttatttgcgtagaggtgtttgtagtattctctgatggtagtttgtatttgtgtgggatcggtggtgatatcccgtttatcattttttattgtgtctatttgattcttctctttttttctttattagtcttgctagcagtctctcaattttgttgatcgtttcaaaaaaccagctcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggcatgttgtgtctttgttctcattggtttcaaagaacatctttatttctgccttcattttgttatgtacccagtagtcattcaggatcaggttgttcagtttccatgtagttgagcagttttgagtgagtttcttaatccggagttctagtttgatagcactgtggtctgagagacagtttgttatcatttctgttcttttacatttgctgaggacagctttacttccaactatgtggtcaattttggaataggtgtggtgtggtgctgaaaaaaatgtatattctgttgatttgaggtggagagttttgtagatatctattaggtctgcttggtgcagagctgagttcaattcctgggtatccatgttgactttctgtctcgttgatctgtctaatgttgacagtggggtgttaaagtctcccactattaatgtgtgggagtctaagtctctttgtaggtcgctcaggacttgctttatgaaacttggtgctcctgtattgggtccatatatatttaggacagttagctcttcttgttgaattgatccctttaccattatgtaatggccttctttgtctcttttgatctttgttggtttaaagtctgttttagcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggaccatttagtccatttacatttaaagttaatattgttatgtgtgaatttgatcctgtcattatgatgttagctggttattttgcttgttagttaatgcagtttcttcctagtctcgatggtctttacattttggcatgattttgcagcggctggtattggttgttcctttccatgtttagcacttccttcaggagctcttttagggcaggcctggtggtaacaaaatctctcagcatttgcttgtctgtaaagtataatttttatttttaaatgtttccttgatgtgtctcttttactgagttctaatatgatgaatcaccaaatacagataatcatagcattcaatgaagagaagttaagtgagttaattaacaggtgtttataaagctgtggtgttatgctttcactaatctttccttgtggcaaatattgtggcacattatagaaaaaataataaaactaaacaaaactaaaaataagcagttcccaagtctccaagcacaagacagagatgtctataaatttaactgaacaacttttccagtttatgtcagcaataaagggatatctaaatggagaccagaatgagacagaatcgtttgtccttctcagctgattctctctggggctcactcttctccccagttggttaatccattgttttcttcacacaggttagacacagaggagaacctttggagatgagaaatttgaactttatatttttcttctttatttctacaggctacactgaaaacagttgctctgtatcaggttagccataagttagagcaccaacttaaattaccttgaaatacatcaactttttataaattttctgatttagagatttcaaaattacttctgctattaatcaaattttccttagacatgttttccattattattgtaatattatcattattaaaataatagtagtagctacattcttttacacattattcaattatggtaagtaatttgcatattttttcttatttaagatctatacaacagttttatgggatggtggtgttaaaattatttttccttggaataataagaataaatatttgggatacctggtttggattactgcattggagaaaaacgtacttcaaagcagactatcattgttaagattgttgcatttcttgagttaatcaagagtaagaccacatttttaatgaatatctcttactatataggaataatctttcttttttttttttttctggttttgaaacagtatctctctgtcacccaggcaggagtacagtggggcagctacagctcattgcagcttcaacctctcgggtccggtggtcctcccaacatcaccctcccaagtagctggaactataagcatgcacaacaccacccgactaattttcaaattattcgtacagctgagatctgtctatgttgcccaggctggtctcaaaatcctgggctcatgtgattctcccacttcagactcccaaagtactgagattgtaggcctgggcctccaagcttggtgattctcctttttaataccttaatttgagatatggccaggcaaacagtagaccttacttctaattacagaattgggaggaaagaaagagtctgagctctgggcacacaagctgatgcagttgatggacaatgtcctgctggataacctccaaagacttggttgtaattttctcaatctccatttttcataggaacctagtagaaagcaggggacagcgaagtcatcatccaggaggaactaacatgaaaaacattttgcatatatattattattttaaaatcatttgccttaatttttaaactgcttatataaaatgaatgtttatcccttgaaatgaactacattaaaatttaatgcagatatttcaggtggcttcagctcaaaataatttgggtaatttttaacagttgtttataataagtaaatttatctttaaaggacagctgagataaataatttttatgaatttacacttacaaatttttagtatagtgttgtgcctaggggaaagtttaatacataataggtattcagtaaaaactttttgaaaaaaaaattgaagcgataaaaggttagcctggatttgccatttaatcagttcagttcagagtcttgagtatgtacatatgaatcattgttaaataaacatggaattattttgtgaattaaaactaatgtatgtacatttcttagatgatgtctaacatgcagtagacgtccagtgagtcacaaatggtgcatagtgtttacttttggaataaagtgagacagaagacaattggtattttctctgtctctcttgtataacctagcataactcacctttcttgaacataggctcatgttgagtgggaagcaagggagtaatcacatggaagaatgttctgctttcaggaattaatgcatcctattcctaaataattaactacaggtaagtatatgatagatggatggatagatagataggcagacaggcagatattctcaaacagcaattaaagtaaacattacaacttaattcaatatctcatattacagttcaagaatctgagaaaatattttctaaaataatgatattaggcatagaagagacacacttagtggctatatagaaatctcaaacttatacaaaagcaataaaagttcccctgatagatatcagtatgggaatgttatgtttacattaaaccctgtattttaaaatgacttagtattggggttggcagttttgcccccttaatcttcaatcccttgatattgcacctatgaatatgtcagcttacatgctaaaagaaactttgcagaggtgatgaagggtatgatgaggagactatcctggattagacagtttcagtctaatcactctagtccttaaaggaggagagccttttttcagctgaattcagaaagatgctgtgatggttaatattgagtgtcagcttgattggatcgaaggatgcaaagtattgttcctgggtgtgtttgtgagggtgttgccaaaggagattaacatttgagttagtgtgcatagggagaggcagacccaccctcaatctgggtgggcatcatctatcagctgccagagcagctagaataaagcaggcaggagaaggtggaagagcagacccgctgagtcttcctgccttcatttttcttctgtgctggatggttcctgctcttgaacaccgaactgcaagttcttcagctttggaccttttggacttacactactgtatgtcaggggctcttgggcctttggccagagactaaagattgcactgttggcttccctacttttcagattttgggacttggactggcttccttgctcctcagctttcagacggcctactgtgggacgtcaccttgtgatcgtgtgagtcaattctccttaataaactcccctttatatacacatctatcctattaatgttgttcctctagtgagccctgaataatacagatgctctggaaaagggagggaggggagaaattcaaagcctgagaaaatttcaacctagaggaagggggctgttatacagggaaagtgggctgcctctagaggctgagaagacctcaagccaattgtcagaaggaaaacagggacctcaatctcaaaatcaaaatgcactgaattctgccagcaatctgagcgagcaaggaaacagattatcttatattccccgaaaagccatggtactctgtcaacatttcgacttcttcctggggagacttggagcagagaaactagctgaaatcaccaaattctgacctcttgaaactgtgagataatctatttgtgttgttttatttcactaaggttgtggcaatttgttatagcaacagaaaactaatgcaggcataatggaggattcagataattacaaatttatccagctttcatttgcttacttttaaatctttccaatatgaacaacaaaaacatgttaattttgtgacttgcctcagttaacaaaaggaaagttctggtgtgaaaatgtcaatataataccgcatattttaggcaaagagaggttgtgaaatagtctcatataattataacatacatgttttctatttttatgtttactgaataaatgaaatttaacgagtttgagttaagtttctgaaaattaaacacaattgcttatatgcaaattgaaaacttgcatcaaactattttgttttgttttatatttgaaattacagtgacaatgatttccatttagctctaaagccattaagcaaggcaaatttctcaagaaaaggttcttaatgtagtccctgaagttaaatgtaacaattgtctatctaaaattgctcttggaattctacatcgcaataatcatttgcaaatgtaatatttttcagttaccaaaactattttatctttactgaactttcctgtggatgttctgaaattattccttcccttcctttaattgcagatttttcaaatgtagcttccagatagcagcttccaggtagcaatcatgatctaaatcactgaagcctgtgtagtgatgtgtatagtctcttagtccctaagaggttccacaaatatcatctcctatacacgttttgaacctcctagacgatgatacaaagcacttatagtcagactattcagtcctgggagatttttgaggtctaaaatctcacagtgattatttggttcttgtatttgtagttcatcaagtcacacagttcatcaaattcatttctggctcagaccttgccatatttaggggctaaaacagagccactacctagagtttgcttgaattctaaggccaagatcatagtctttgttttcttgttgttgttgttatcttctatatgcatttagtaatctcatatcactgggaagtctggaatgtccaaaagcctagatgatgtactgtggaactcacatgatccctctgataagggtgagagtctatacagggatagatacaatgaataaactaaaccttaatccactccctgtataattgaatctgttttaaacaaaccctaattttttaattaaagctcctctgatcattgaaatcaattgtatttgtttacctaaaacaagccatggacccgaataaggagtagattagaatacagaccaggaatggagtaaagaggtcaaaagtgaggaatgactaatttgcaaaataacaaattcaaagatagtaacaaatatcccagcctcaaagttgtaattaataatgataataatagtaataatagatatatattgactatgtgtgtgctcggcagtgttttatgtattgtatggactcataagaacagagagcccctggctcaatggaaatgggcatattatgtaaaaaaaacacacacacacacacacaaaaaactgtcttgttaaaaaccaatatatttcaggttttcttttctttctttctttccttctttcagcctgcctttctttctctctctgccctttctttctttctctttctttctctctttctttcatctctttcctttcccagtttatcttcatataaatattgattacctgaaattggtgctactgtaacaatgacaataaaatgcacagtatttactttaagtctgggcagtaaacagcaagggaactcttactggaggctgtaagaaaggcaatttgtattacgcaagagtgaaacataaaactgtcacttgtgataccatgaaagagagaaaatatcccagtgaacttgtagctttaggtcaaaagttgaacaagtttaacaaagagaatttgtgatggttgcatttgtaatggtactgagaggtgacagcgtgctggcagtcctcacatccctcgctcgctctcggtgcctcctctgcctgggctcccactttggcgacacttgaggagcccttcggccgccgctgcactgtgggagcccctttctgggctggccaaggctggagcccactccctcagcttgcagggaggtgtggagggagaggtgcgagcaggaaccggggctgcctgccgcgcttgcgggccagctggagttccgggtcagctggagttccgggtgggcgtggtcttggcggccccacactcggaacagctggccagccctgctggcaccaggcaatgagggacttagcacccgggccagtggctgcggagagtgaactgggtcccccagcagtgccagcccaccgatgctgcgctcgatttctcaccgagccttagctgccttcccgcggggtagggctcgggacctgcagcccgccatgcctgagcctcccacccactccatgggctcctgtgcgcccgagcctccccagcgagcaccaccccctgctctacggcgcccagtcccatcgaccacccaagggctgaggaatgcgagcgcacggcgcaggactggcaggcagctccacctgcagccccggtgcgggatccactaggtgaagccagctgggctcctgagtctggtggggaggtggagagtctttatatctagctcagggattgtaaacacaccaatcagcaccgtgtgtctagctcaaggtttgtgagtgcaccagtggacactctgtatctagctgctctggtggggccttggagaacctttatgtctagctcagggattgtaaatacaccaatcagcaccctgtgtttagctcaaggtttgtgagtgcaccaatcgacactccgtatctagctgctctggtggggccttggagaacctgtgtgtggaaactctgtatctaactaatctaatggggatgtgaagaacctttgtatctagctcagggattgtaaacgcaccaatcagcaccctgacaaaagaggccactcggctccaccaatcagcaggatgtgggtggggccagataagagaataaaagcaggctgcccaagccagcaatggcaaccccctggggtccccttccacagtgtggaagctttgttctttcgctctttgcaataaatcttgctactgcacactctttgggtccacgctgcttttatgagctgtcacactcaccgcgaagatctgcagcttcactcctgatcccagcaagaccaggagcccaccgggaggaacgaacaactccagacgcgctaccttaagagctgtaacactcaccgcgaaggtctgcagcttcactcctgagccagcaagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccaccaattccagacacagtactataggaaagagatgagcttggaaaataattcaatggttttcatgcaaaaatatgatggcattgtttagaattttaggggtgtgtagggttgaaacacatttttaaccacaaccattaaaaagcaaaattgagaaatgatttgatcagcaaaggtcaatcaaaactcagattcacagtaaagtcaagtgtatgactatcacactcactgttaaaactatacagtagtttaagatgatgctcagtcaatcctttcagttcaacaaatagtgcaaggaaatgagactgaaggtaagcctgttctacagattcctggcaggatcaaggtacccaaaattaaatctaaagggagagtcatatcattaaaagaatagtatgttttataaccagaagttatgacacacacacaaaagacttgaatctttaagggggttattctgaagctgtcatcacagggttaacaagaattctggacagaaatatagttacaagtatgcattagtcaggctgcaatttgattcacttccttgtaaccaaaatcaaagtcactagatatcgaccatttgcatgtccattgttcttctaggtaggatatctgaagttagaatcataagacttttaagaatcctgaattccagcagaacagctgatgccaacccgaaaaccccacatgagaactaaatcagcatgagaatgcagtttcttcttctccctgtctcatgactgcaccctgcactcttcaactaatcaacaatctccacacatcagtccactccaaaacctttaaaaaccctaccctcaaactcctcgagaagacggccttcaggtttcctcctgtctctttgtttggcggccctacaattaaacctccttctctgctgcaacctgatgtcttggtgtattgatttgtcttgtgcatagggcaatgggcaatgaaccttttgaggctataattccactaagtcatccacctctctggaataaaaaataaaatgacctcaatattctaaagatgtaaaacaagcctataaaaaaatcctgcacagcctccagagaagacaaattctcaaattccctctttaagtgaagacaagaaggataatagaaagttaaagaactcccaaaggtcaatcccatggatgatggagaacaaggtacagaactggattgctaatcctaggaagtgaaattagggtctaatcaaggaatacacttccagtgtaaaagcacctcataaattccacacagctggatttcagaattgctgttgaccaatgaccattatatctcctgttcttcccatgtcaaaatggtcactgtggttgtcttgtgtctgcttcactatgtaatatttggtaggggaaaggggatcattgacacttaggtcaataggaatcacatccagacttcatttagagactatcacattacctagattcacggattttagttagatactaagattgcttgggactttgtgttccccccgcctggggaaacaggagaaacaggagaagtaaacagttacaccttatggaacatcttctccattaatattttcttaatagagcatttttctgctttttctatccaaacttagtagaacttacatatttctcaatgtaaatattttgaccaatatttatctaaaaaaatttcaaaaactcaacagcaatattttagcaaaaccggtatatgtgaaagtctcaggttgcataacaaatacatttgacagaacttctaaatcatatgcagatatcttgaaaacttgcagagtatcaacaaaagaaataccattcttatatgaagcacatcacagtgtcattgtcagttaaaatattctctgtgactttgtacttgtgttgaacatcttgccacattactttttatatttctatagtacttgtctaaaatagtaaaacaagtcctccaaacaataaagaaatttgtataaaaattattgagaaaagctgtatcaatggaagaaaacttactgaatgcaaaagaactgcttgttaacaaccgtattgtttggtagttaagaaccaaagatgtaagcaatttatatacttaggcaatagttcataatgtgtattctttaatgcattttaaaaagtaatatattggttgtaaatatttgactgatgtgtaactcattaggaatatttttcatttaaattattaagaaataggctacttgttagtattttcacacataaacctctaattcgcaggaataaattactgtgattaatgggagacccctgtaaaaaagaggatcaaccaagtttttggtgacaatgaagacagatgtgaccattatttgtgctgttgaaaaatatcctcattctccagcccaccttctggacacaaggtagttgcacttcctgaattctgtctggaggatggggctgggtggtgagtttcagtccgtgaggtggggtggaagaatgcatatcatttctggaccaaagtacttaatccactatgatatcctccagtgtgttatttcctccagctactgtgaaaagtaatattagctttggtccttgaatgaggatggcatatacaccagatgggctataatggacacctaacatgaatggaaaaaaaaaaaaaaatcctgtgttgttttccctctgtggggcaagtgggaggtgagttttacttgaaaaatctagtctgatctctgtttctctacaacttcattatgactgaacaagcacaaatactgtcatctctactctgatttactataaaagacttgtaattgatttttctctttcatgttcataatctgcaagtcttctttccatagagggagaataaatttttttaacatgcaaataagattgtgtcagcagttctaatgtgcctatggataattcgagtagagtataagtaaaatttactagtaggtgttccaggaactgtgaggccaaattttagaaagtccattattatggatgttagagttcccaagcataaaagagaataatgaatggaaagaaaggttataattcagttagtggctaaagtcactgaatatgtacaatgtggcagacactctttagttctcacatcactctaattctcttacaacttctcctactttatatatgaggaaatttaatgacagaaagattatggtaaacaatatgtcttaggtaacacaattgttaacgtaatagaagtgggattcaaacttgccacagagcctaacacttaactgccaaaaaccaaaaaaaaatcctgaaagttctatggacagaaccaataaaaagtaggcaaaatgagctcatgaggagtttatgaaagtgcctgttacaatgctgaatgcaaagcaactgcatgctttgtacttatattcttatctggatgctttataggtaccagattttctctgctcgttcatcagtagacagatgaatgttcctgatttccacttgacaagttaatgcattttggaagtgtaaatactcaaataaaattcaaaatcaatgtctaataaaatttttctgagcctggactccaccactagacaacgtatgcatgtaagaaatccgcacttatactcactaactctataaagacaaaaatacaaattttcttctttttcctatagtataaagagctcccttggtgcgggtgagcatgttattattcatgctctatcatattccaaatttcattttatgctacaggttagcatatcaattactatcctcattttccattgaaaggtcagcgttgctgtttgtgtggtttttgagcagaagaaatatgcattctgaacagtgttataaatgtattagttattccttaataacttattatgctacttggatgactataagaatgtaatatataccactaggtaagttatattttctcaagtagaaacaaagaattgaaaaactagaagattatcttatgatacctagtttaacttccatgttccataggtgaagaaattgagtcccaagtaagttaaataactttccctgaatttcagaggatactagtaaatagggataaattgaggaccataactgagggcccttgaatctgtgttccatgtagcttatgtaattaataaaataaaagcctcaatgttacacagcaaatatgtctatctacagaaatttattaaatagtatttttaatagtaaatgagaagtcaaaaaggttggctcatataaagatactatataaagtatttttcttgctaccacaacgtaatcattgcattgttagggttgtgttttctctgaactatccatcataagatttattttttgacttttgtatatctaatgctttctcacttagatcttctagtaattcacatctgagttcactttgctctcaccacttttctaagcagggttaggctacaatggtaacactttaccttcttgcagtgtgctatatttcattttgtaattatatgaaaagacattgtaaaaaagaggaaagaaaagctcaatgtattttacagaatgcattttgtgccaagtctgaagtaccacatacttgtgaataccagagagttttcaaagcattttcattttatttcacattatttcatttaattctcccactaatctgtagaggtaggcgaagtaggttttaatgtctctgttttatagatgagaaaacttgtcattggaaggataagtgacttgcccaagttcacactggtattaagtggtgaagctgtccattattcagtgcttctccctctacagtttactgagataatcagtgttgcttaatagtagctgcctagaatacatctactataattatgaaatacctaccctcaaagccacaaactggcccttttccaatttctcacacttttatagagcagaggtcagcaaactaaagcccacagatcaaattggagtccttcctacttttgtaaataaagtttattaaaacacaaccacagtcattcatttacatattgtctatggctgttttcccgctgcaatggcaaaggtaagtagttgggagaaaggtcacatggtcccaaagtcttcagtgctcttcggcctttgccttgaatgtgtgctgacccctgctagagaatatgaaaagctaaagtatacttccagactcttgcagctattctttcagaaactacagaaatctctaagtaatctttccaggaaatgtttttaaaataaacagacttgactggcttggctcttcttttctttgtccctttcctatatttgcttcttccaacctgtattgtgaacaacacctgggattgcagtcattacttagtatacatgaagagacaaacatatggacaaatgaggacggatagaaagaaaacagagttagggtgcctaactacatttctgagcaacttcttcagccctggacttcgtggatctataaaggattctctacatatgaaatacactgttagtagtgttacttgattataatttaaaaaaattataatggatgcattcaaatgtcctgtcatttactgagtcataacaatagtgttagcttccatgttaaggccactaaatattgaatcactttaggattcagcattttactcctttatctacacccactcccttagcgatcttatataacctcatgaatatacagtgtttatgtgatgattaatcttaattctatcacaaggccagtcatctattcagctagctactcggcaactctacatggaagtttatccatatttcaaacttgacttctgcaaaacctgatcctcttgaagatttccccattccagttaatagcaatttaatgtttcaatgcttgtgccaacaactgtggagtcatccttgatttctctctgtcatctacattccatatttttagcaaatctagtcgtaaccccatcaaaatatttcctgaggccctgcaagctgaagcttagtccttgttatacaggtgagaagaatatgtcagattgccagtgccttcctcttctataactaaaagttctttgagtctaacatctggataaattgtgcccaacattaaacttcatttttcttctgtctctatagaaatgcctcttattaaaaatcaatttgccttcatcacagacagaagcctagaccacctgagatgccatctcctcatattggaaacagctgtttaactgaactgatctagtttcaggactagtctgcagttcatttaagtgctgtgctaaaactgttggtaaggttatcaacatctttgtcacataagcctaggaacactaactgggaaccccatgagtagatgcagataactgcaaagtggttttatttttatttcccttgtgcataacccacctcaaccccacaactatgcctcttgtcaacaggaagaagctagagtgaccatcagccttttcccatctctatagccaacaccttaagagtaaggtgctatggagcccaaagcagggtttaaaactacctttgcaaattatatcagggagaaaattatgacagtaaaagagatctgatttaaccaccccgccccatcttgcctttcccttcaacattcctgagcttaggctaagctaactttgagagacatttagtttatatgacttttatcttattttgttatttttatagagatgaggtctccctatattgcccaggcttgtatcaaactcctggattcaagcaatcctcccaccttggcctcccaaagtacaaggattacaggcacgagccacagcacccattcaatataaaatttagttttaaatgataataggcctcccccaaaactcaaccacctttgtaaatctaatgaaacattatcaggctagggggaagagctaaggtgtggtctgatcacaagatatgcaacatcactatagtatattgcccttttgagatatttgttcaggttttttgcctgtctgacacctggacctgattgctcctatggctccacatggaagcaactccgcttaagaggatagctgtgccctcctacaatttcatctctgcctgaaccaatcagcagcaagtacccattacctggccaccccatcccttccctcaaactgtctttgaaaaactgctaacctaaaagcctgagatgagattgatttgagtaacaaccccatcttctgtgtagtgtggcaggccttgtgtcaattaaacttttcttcagtgcaatgccatggtctttatttatgcagcgggcaggaagaactgatcaagcaattatccttctactcttgtcttatttggcctattctctatacctcagtcagaatgacccagtaaaactgaaaagaagacaaggtcatttctctgcgcaaaatttttcaatgatttgctgtctttcttaaacagaagcgaaaatctttgacaacaacctacaaaatgttttgcagtcagtcccacttcctccccaaccctaccttgttatttccatgacctcaattcatattatagcctctttcattcattgtcctctggctacacttttttgcttgcttgtcttcctgaacatgccaagcattctcctgcctggaagtctactctggttattctttgtttgcattgctcttcaaccaactagctacatggatatctcttctcttgcaaatttctgctcaaatttgattacctcagtgagctcttccttgactattctgtataaaacagccaacaattaaccacttcccttaagatgacagcaagaatgaggaaaataaaaataaaaataaataaaagcataaaagattatccacttctctttcccattagtacttcctatattctctaatcttccattctttatttctatcattaatgttttattatgatatataatttatgtactataatatacactactcttaagtatttgctttttctccttaactcatgtcttctatgacactatatactttacttttatttatttagttatttattttttgaggcaggatctcaattctgtcacccaggctgcagtgcagtggtgtcatcacagctcatcaatgcagcctcaacctcccagcctcaagcaatcctcccacctcagcctcctgaatagctgggactaccagtttacaccaccacagttggatatgttgtttttttaaaaaattttgtagcgatggcatccccctatgttgtgcaggctggtctttaagtcctgggcttaagcgatcctccacctctgcgtctaagattaaaggctaagcttaaaggcatgagccaacacacttggtcacatttatttattatttactatatgtcttcctgaatttaatttaaaaacgataaaggcagaaattttgtttgttttatttgtagagaacccacagattttttagtaagtttctggtgaataatttaatatgcattttctcatttaatcctcacattaatgagttatttcctccacagaaaaaaggaaaaaactcaaatttattatatttaaaataattggcattggtcacattgctagtaactagtgatggaagtgacgaccagtgtggagcagctgctgcaaggatgctggttgcacagcatgagacatggacagggttgcatgttctgcagagctggtgggagccaggagcaggcgagagcccagacccctacttagttgatgaggcagaagcccgtgctccctggcacagctgcagccacccagctgtggcgctggactctagcatcactgcactcttgggggcccaggaagctacttgccatagcaggcttgaaagtacctgctcctgctccctggcctctccccacttccagcacccactctggcatggagcaaagttgtaaccaagcctgggcactgttgcaactctaacaagtgtgcgggcactcgggacagggctgacacaccagctccctgctgcctcagcctcctccagacttcgggcaccaacaagcacaggagggaggctggcgggcgtggtgagtggtgagagcagctcagcatgggcctgcagcacccctcaacacaaacagcctgggcactgtggacagcatgttgatggtggcaagaagcagacaggccctcgggtggaaaggggtgcatcccaggtgaaaccccaccttcaaggcagggatggcctgaagcctgggggccgggttgtcagttccagctggagtccactacccagagtgagaacttacggtgcttttttcgggcctgccaatgacagcccatggacaaataagcgcatatttcctcccttctgagcccactgaaaccctggactcagccagactcagacatatgtcaggactaccagctgtgggaaggaactacccacttcaggtctcctggagtgataaggatgacctgtctgcagaaaggagcgatccactaggggtctcctctgagctgttctgttgctcagtaaagctcctctccaccttgctcaccctccagttgtccgcatacctcatttttttaagaggcaggacaagaagtcaagaccaactgaatggtgggaatgaaagagctgtaacacaaacagggctgaaactccccccgatcgccatgctgtgggcgatgaaaaggagagaagagctgaagaggccctttggggacgccagacctaggggctccccgagccagggccgtgacaccctctttggggctctgtggttcctggcgtctcgaagcttctgggtgccaccgcagtcccctcatccagacacaggtgcccacagtggaagctgcttgtggtacatctgatccagccacagccttacacagagcccgcacctgtgccggtgcctggagctgcccaccgcgctgcagcagccagcatgcctggctgtgcgcagtgggtggaccccacgctcactttctcacatatcccttgccactccatgcctggcttacccttggccggcgtgggatcctagccggtggtgcaagccaagcacagcctggcaggctgactgggcagaacgagccagtgggcccaagcaaaactcaggcaaacgtgccactggccacagaggtttccagctggaaaagcaacaccctaaggaactcaagacagcagtgttgccaagattttaatttagaaattgtgaagtcacacaataccctcttaattaccatgctctatattctcctagctgctctgtagaaaaaagttcagacaaaacaaatagtaacatgattgaaatggagattggcaggatactagaacaagcagatatcaagctacttcagaacaatatcctcttagttgccaaatctaagagaaaaagtaaataagctcataataaaatacagagaacaaaaaacctgagaatgtatgattaagataatatcaatatgagaaaatactacatttaaaactagttgtcagtggaaggaggagtagagaaaggaagagaatagaactctattaagtcaagtttcaggaagaattttccagtctgaataaataagataagttattagggaagtaataaagggtcacttctagaagaataaaaacctgtatatgtttatccattaactcaaaaaaaaattattcaatcctttcatcttgaaagagaaagagatgcatttaataatggattatttaaatgcatctctttctctttccaaggcccaaataatgttatcacaaagtaacaccaacaatgtgaaaacccatagaattgtgactacaaaaattgagatatttcagcacacttttagcggatctaaagtgaatttaagaggtaggaaccatttagtagagccaaaaacgataaaacctgaaattctctagagtaggatgttaatgaatggtgaaagattctgaataaggaagcaaaaattgccatggaaagcagggaatgaggcaagattataaaaacacagaacctgttttttcctcaggactcttatccttacctcaagtacacaggttccgttgctgtttgagatcagtgttttatttgctaaataaatatggagcagaggatccagacttgactccccaggtgtaagagaagagtgaggcacaaagctggaaaaaaagaaataagaaaaattattttatctttcagtttcttctcatcatccctaagctctcccacatcttatggagggatataatcccctcctttcagattagccagtatcctgcctttagctatagtcctacatttattgtctgtgtaattactgagagaaataagatggtaattaactttcaaaatgggcagtatacctgtaacaaagtctttgaaagcaactgacatacaaaaattctacaaataaaagtaagtgtaagctcaaataatacaatagtacattatttatagaataatgcttttcccattccattgtattttaaacctatgaacccaaatgccatactggaaagaaatgttagggaaatgtcagcagtaattcagtgggtccatgaaagggcttcaacttggcaggaaacctctaaaattatatgcaggatcatatttgtattttcatagtgatggttttcatgagagtatctctaaatgaatttcaaaaataattctttcattaaaaagagttttttttttcctttaggaaactttttaatacataggctatccgtgaaatatgtatatgtcttcagttgctgttgaaagcaaaatcagctactcctctgtctgaaaagtattttacttcatcttcattcttgaagggtattttcaaggcatatagaattcaaggttgggagttttgctgttattgttctttctgtgttgttctgggtttttatttggcatgttgagaatatcattttactgttttctgacttttattgctgctattgacaagtcacctttcaacttaatattttctcttgggccattttttaagatttttttatggtgtatttgatgaggtacagtttcattataatgtttctagttgtggatttatttttatttcttttttcctgaaattacttaggatccttgactctatggatttctgtcattgaccatttctgaaaaattatcagccacaattttttttttacccttggccagtaaaatttattatctgtgccctatttctttttttctcctcttaggacttctgttgaaataatgttacattttctcactctgtcctgtatatactttattctcttcctgtattttccttttatttctttgtctcccatgcttgtggtgttttttacagtgtaaacttagcttagctagaaatatgttttccatatgtgcttccctatatgcttccaggttatagtgggccaaaatagaagttggtacatgatttggaaagtggagaggaagcaacagccataacctctgttggttgttttggtgttaggctgtaagaaccagaagcatcaacgctcagagaagcaaattcaaaattaaccatactcttcccaactctgcatttgtaatattcacctgctagccctattgaccaagagtgacctcaggcctactccatctcagatgcaaaggcaataccctgacacagatgtctccactagttctccttaatggtcccattctgcaagtcagccatgcctggtttctgagatctctggcaagttctaatttgtccacccatactggttcttcagagaggaggagagcaaatttttctgatcctctaactcacccattctgacccttacttacccagtgtcttgtgtagttgtctaaagttttagtgctataataaatgtcctattctgtattacttacagtggtagtgctcacatggttgaactttgtctgtactgcgtactgttttactgcactctttttaagaacactaacttcacatccttgtatataattagctatgaggtctatgcaatgaatttttaatttattaaattttggagatctttatgttctttatatccttttttacatctgtagcatcacattttatttccctgtttctgttgatgtccttaacttttgtctttgacttctttaagttaaaaagcttaagagtttcttctgccttgacctcctgggctctagtggtctttctggcctggaattagtcatctcacagagtaatccacgaaaagatttagaaacaactgagctcgaaccaaagcttggaccagttcctaagtaataaataagttctccttgtttaacatcacactagattgtaaagtccttataaaaaatagatttgcttattttatccataactgaatatatagggcctcgaggagttctgagtatctgagaggtactcaatacatatttgttgaataaaagcatggccaaaaaaggataaattattttgtgctctccctgatgatttcaataggatgtacttctgggtctatttattttgttgtttgtgtttcggtgggtacatgcttttggtgtgtttttactttatgtacctggctacctttgatcgagctaagcattacacataattaactgtataattaagcataattaagcactgcataattatttgtaggaataattagaggactgagatgaaggaaagccttcatccagagaggatttctgtttgtttcagtcaacgggggcattacttgtcctcagtcacattcaacaatttgaatacgttagattactgaagcctccagacttttaaaattgggctacaattcttcaagaaagccaatcattttatttttttttattcacctttgtcccaaaggtgtatttattaggtagcaacttattgtgggacacttacctgttagactcttcattttgttctatattttttaactatagataggtcaatacaaatattcacatttatgtaactaacaaatacttctattagttctagttttccctgtgatttcagtctaataagtatttcttttcttacaagacctgcagtgattttaagaagatattttaaaatatatcttacgcagatttttagaagtttttaatagaattgtttgtacaaacaatcctcccattatgggaaacacctagcctccagaaaataactttaagaataatttagagagctttgattaaaaatgtagataggaggcaggactagcttgcagttcctgcttggacagacagagcagtgtgtgaagacttacatcataaaattttgctccaagaactaccacaggaaaataccaggaaagctgagagaattatctgaccctttgaaggaactggattgctactgcaggctccctgagatgccaaaacattgtgagtgtacttgctttctcagcagggatgctggtggtctgaggcaagttctcagccctggtcaccagctgcctaaaaatagactcagtgttgttggggggacacagtgggagtaagactggcctttaggactgtgggctgtgtgggagcagggtgagtcctgcgactgctgactttcccccacttctttggtgacctgtacgactcagcagaggcaacctaatacacctgggaatataactccattggcctgggaaccacattcccattccacacagcagctgcagcaagccccacccaaggagagcctgaactaagacatgcctatccctgctaccacccggtggtctttctctaaccagtgtagttgccaaagaaaaaggacataatctcttgggagctctatggccttgtccactggctgagaaacctgaatacttaaccagacattcctagggcaagtttgcatcctccctatagtaccacagctgatgcactcttgaaagtgccacctcctgcctggagggcaaccaacacaaaaccagtgcactgaacaaaaacacaaccaaagaccctcacagagtccacctcactcccctactatctccaccagagcaggttactggtatccacagctgaaagacctgaagatgaatcacatcagaggactctccagtaccagcccagagctcagtacctctgcttggtggctagatccaaaaaagcgaaaacaatcactgaagttcacctctcaagaagccctatccctagggggagggggtacaagaataccacatcaagggagcacgcggtgggacaaaaaaatctgaacagcagctcttgagtcccagatcttccctctgacatagtctacccaatgagaagaaaacataaaaacaattctggtaacatgacaaaacaaggttttttaacacccttaaaagatcataccagctcactagcaatggatccaaaccaagatgaaatctctgaattgccagaaaaaaattcagaaggttgattattaagctcatcaatgaggcatcagagtaaagtgaaatccaacttgaaatcaaaaacatgatacaggttattaaagaaaaaaccttcagtgaaatagatagcataaataaaaacaatcacaacttatagaaagaaggatacacttagagaaatccaaagtgtactggaaagtctcagcaatagaatagaacaagcaaaagaaagaacttcagagcttgaagacaaggctttcaaattaacccaatccatcaaagacaaaaaagtaataaataaatgaacaaagcctacaaaaagtttgggactatgttaagcattcaaacctaagaataattggtgtttccgtggaagaagagaaatcaaaaagtttggaaaacatacctgagagaacaatcaaagacaacatccccagccttgctagagatctagacatccaaatacaaaacactcaaagaacacctgggaaattcatcgcaaaaagatcattgcctaggcacatagtcattaggttatctgaagtcaagacaaaggaaagaatcttaacagcagtgaggcaaaagcatcacgtaacctataaagaaaaacctatcagattaacagcagatttctcagcagaaatcctgcaagccagaagagattgggggtcctatttttagcctccttaaacaaaacaattatcagccgagaattttgtatccactgaaataagctttataaatgaaggaaagatacagtcttttccagtcaaacaaaagctgtgagaattcgccactaccaagccagcactacaagaaccgctaaaaggagtgataagacttcaaaataaaccaaaatagaacctccttaaagcataaatctcacaggacttatataacaataacacaatgaaacaaacaaggtattcaggcaacaaatagcatgatgaataggataataatacctcacatctcagtactaatgttgaaaatgaactaatatagggactttagcactccactgacagcactagacaggtcattaagatacaaagtcaacaaagaaacaatggacttagactataccctacagcaaatggatttaatagatatttacagaacattctacccaacaactgcaggatatacattctgttcatcagcatatggaacattctacaagataaaccatatgataggccacaaataagtctcagtaaatttaagaaaatcaaaattatataaagtactctctcagaccacagtggaataaaactagaaatcaactccaaaaggaaccttcaaaaccatgcaaatacatggaaattaaataaactgttcctgattgatcagcagtcaacaataaagtgaagatggatattaaaaacgttttgaactgaataatagtgacacaacctatctaaccctctgggatacggcaaaagtggtgctaagaggaatgttcataggattcaatgcctatatcaaaaagtctaaaagggcacaaatagacaatctaaggtcacacctcatggaaccagagaaacaagaaccatacaaactcaaacagagcagaagaaaataaataatgaatataagatcagaactaaatgaaactgaaacaaaaaaactacaaaagataatgaaacaaaaagctagttatttgaaaagagaaataaaattgataggctgttagtgagattaaccaagaaaagaagagagaagtttgaagtatgctcaattagagatgaaatgggagatattactattgataccacagaaatacaaaagattattcaagtctactacgaacacctttatgcacataaactagaaaacctagaggagatggttaaattcctggaaagaaacaactctcctagaatataccaggaagataaagaaactctgaacaaaccaataacaagcagcgagattgaaatggtaataaaaaaaattcccagctaaaaaaagtgcggaatcagatggattcacagctgaattccttcagacattcaaagaagaattcaaacgaattctactgatactattccacaaagtaaagaaagacggaatcctccctaaatcattctataaagccagtatcaccctaataccaaaaccagagaaggacatcacaactacaacaagaacaaaaaaactgcagaccaatatccctgttgagcacaaggacaaaatactagctaatgaaatgcaacatcatattaaaaagataatccactatgatcaagtgggtttataccagggatgcagggatggtttaatatctgcaagtcaataaatgtgatacccaacataaacagaattaaaaacgaaagtcacatgattatatcaatagatgcagacaaagcatttgataaaatacagcatcctttatgaataaaaccttcaacaaaagtggaatagaagggacataccttaaggtaataaaaaccatctatgacatacccacagccaacattatactgcatgggaagaagctgaatgcattccttctgagaaccagaacacgactagcatgcccactttcaccacttctattcaacacagtacttgaagttctagctagagcaatcagaccagaaagagataaaagacatccaatttggtaaagaggaagtcaaactgtcactgtctgctgatatgatcgtatacctagaaaaccctaaagacttatctaaaaagctcctagaactgatgaatgactcagcaaagtttcaggatacaaaattaatgtacacaaatcagtagctttgctatacaccagcagcgaccaagctaagaatcaaattaagaaccacttttacaataacagcataaaaaataaaatacttcaaaaaatacctaaccaagaagatgaaagacctctgcaaggaaaactacaaaacactactgaaagaaatcacagacgatacaaacaaatggaaacacattccatgctcatctcatgggtagaatcgaaatcatgaaaatgaccatactgccaaaagcaacctacaaattaaatgcaatgctcattaaaataccaccatcattcttcacagaactagaaaaaacaatctgaaaaatttatacggaactaaaacagaggccatatagctaaagccagactaagcaaaaagaataaatctgcaggtatcacattacctgacttcacactatactataaagccatagtcaccaaaacagcatggtacaggtataaaaataggcacatagaccaatggaacagaatatataaccctgaaataaagccaaatatttacagccaactgatctttgacaaagcaaacaaaaacataaagtggggaaaggacaaactattctacaaatgatgctgggataattggcaagccacatgtagaagaatgaagctggatcctcatctctcaccttatataaaaatcaactcaagatgcatcaaagtcttaaatgtaagacctgaaaccataaagattctagaatataacatcagaaaaaccattgcagacattggctttgccaaagagttcatgactaagaactcaaaagcaaatgccacaaaaacaaagatattgtaaatagatgggagttaattaaccaaaaagcttttgctcaacaagataaataattagcagagttaacagacaacccagtaattgggggtaaattttcacaatttatatatccaacaaaggactaatatgcagaatctacaaagaactcaaacaaatcagtgagaaacaaacaaaaaaacaaacaaaatcttagcaaaatgtgggctaaggacatgaaaagacaatcctcaaaaaaagatatacaaatggccagcaaacatatagaacaatgcgtaacatcactaattatcaggaaaatacaaatcaaaaccacgatgtgctaccatcttactgctgcaagaatggccaaaataaaataaaaaataatagatcttggcgtggatgtggtgaaaaggaaacacttttacactgttggtgggaatgtaaactaatacgaccactatggaaaacaatgtggagattccttaaagaattaaaagtagatctaccatttgatcacgcaattccattactaggtatctacccagaggaaaataagtcattataacaaaaagatacttgcacgcacatgtttatagcagcagaatctgcaattgcaaaaaatggaatgaacccaaatgtccatcaatcaatgagtggataaagaaaatatatgtgtgtgtgtgtgtgtgtgtgtgtgtgtgtgtgtgtataccatagaatactacacagccataaaaaggaatgaaataatggtatttgcagcaacctggatggtattggagactattattctaagtgaagtaactcaggaatggaaagccaaacatcgtatgttctcattcatatgtgggaacagagctatgaggacacaaaggcataagaatgatacaatagactttggggacttgggagaaatggtgggagggtcgtgaggagtaaaagagtacacattgggtacattgtacactgcttgggtgatgggtgcaccaaaatctcagaaatcaccattagagtacttattcatataaccaaacaccacctgttccccaaacacctattgaaataaaaaaaaaatcaatttataaaacaaacagagaaaagggaagaaaaaagaaaacaaccttcattcacatttaactgaaattggtggctgaacaacgcactattccacctaggcttttacacatgtaagaaagggaacaaaagatttttaaaaagtgtccaggcctggtggctcatgcctgtaatcccagcactttgggaggctgaggagaaggtagatcacggggtcaggagatagagaccatcctggctaacatgctgataccccatctctactaaaaatacaaaaaattagctgggcatggtggcacacacctgtagtctcagctactcgggaggctgaggcaggagaatcacttgaacctgggaggccagtgagctgagatcgcgccactgcactccagcctgtgcgacagagcgagactctgtctcaaaaaaaaaaaaaaaaaaaaaggaaaaaagaaaaacttaaacaataaaaattgacattacttgcaagacccaactattttctatgatttcctttattctagcaagagttttgtatgtgttttgttttgtttgttttgttttcaagattggacgccttttcaaagaccttaacctatgtgtttgtgcataatgtgtatagcataggttcttttctgaaagtgtgtccaatcttaaaacacacacacacacacatacacacatccatgtgcatttgtaataactgaaactaaaagaagctgattactaagaatataatgaaccttattgtttactcttcatcaaacatataatcatcaaatatccatttaaattataaataaaaataagtgatttcataagataagtttgatgccagaaacgaggattgaactggtttgatccatgaaatgctgatacatgcaaaatagaactccatttgtaatttctttaaagtaatactccattcttttttattagaccattgatgagttcgctcctttctctagatcagaactatttagattgtttttttacaaattcagtatgaaggaatttgttttttaataggtgtgaatagcatcgatgtaatgatgtgtcattgagccccacatttctgtcactagagtggtaaaatgacacagaggatgaaccaaaagtcacctgtagatgacaatgggtgaaagaaaacacatttaatttacatagaaacatacagaatgtcaaaagagttaaaattcatgaataaaatttcattaaaaatgcattctaaaatattagttaaatatacactacttaagaatgatttaaaactagcattaaatgtattaaaatggatatattttgcaggaaaaggatgcctgtgttttcagtgttttatctgaattatttaatggtttacaaaactttctgtgaatgaagggaaagcagttttttatctgagtattctcagtgttatctgagcattctcattgcctacataacttattctgaatgaaggcaggcaaaatagagagaaaagactgagtatctataccatataatactttaaatagaaaacattagccctttgttacatatctataggctgaataagaactcaaacacagctcttccaactcaacacacaatgctctctttgaggtctgaaggttataaggctatactcataacagattctcagtctcacaattaaactaaaatctaggcttgaagagattaacactatttagcatgccaggctgggttgtaacacagtagccatatatttattttatttcattttgattttagacctgcagtgtattgccagaccccaggtgagtttgaaatattgcaatggttatttcagaatactttgtgtggctttactgtcatttatgttaaaggtaaacaggattctctgctcgatcattgacatcaaaggcaaaaacgaatgataaattattttccctctattcttgcattttgagacaatttttgttgaagttcaaatttacaagcgtttcgggaggatgttttcttctggggaaacaacattcacagcagtccagactgagggtacacagagagcaaaaacagctctagctgctgagtgtcctgcttatactctcacatttgcccatctactaatctctattactgttttatcttatttttacagatcctacatatctaggaggttccttttaaaatgcaaataaaatatctaaatgggagtgtcactgacttcattatcattcatcaacaccataacagggattattttatcacattagtttgcttcagagagttgagctgcaagaaaatgggactgaattcacttatgttttgaaaatgaaagtgctggataacaaggtagcagttttcaacaaatttaaatataaaaacctttattaatataataaaatgtctaatgtctattaaattatatagtggcaaaagtcttagagaattcagggacatgttaatattatcaattataaattgtactagagaaagctactccaaatgggtggaaatcaaagaagctgatcattttccaaggaatgaccttgcatgcttttacctaaaggaactgtttaaatttttagatcagaaaaataagtgaaaaaaaacagaagaatggtctaaaatatatatacttatttaatgttactgtcagaaaatataggcttgtaagagagcttggatttcaattttagaaagaaacttcggtttctttggagacaatgtttatattaattcaatagtgtttctgtacatatatatctgatattgactgccattgtctcttctataactttctttgagtcctaggtttatatttaatcttatgatatcttcatgtatatctcctataaatatttcaaacttaaatttttaaaagcataagacatcatttcccctctccagttgcaaaactcttccttctttgtaaatgaatgaataatacagcaaccactagaggatgcaggctagaatcttggaagtcttactttatttcttctcttatctcattatgtccttactttcatgtttacttttgaaactatccagttctctctttttctgtaaaaaatccagagtctcctatcatccagtcaaaatttctgctgtagttgtgtaaccagtctctttaatccaaggtatattttcagtgctatattagcagtcatactgaaaaaataaactaaccattgttatttgggataatttattatgcagtaataaataactaatacgctaaattgagaactcctggaaagagagaaaaacatataaaagattctttttttttacactaaatccctaggctccatctcactttgatggtattagacacaatagaagctccatttttttctgatgtatgtagaattaaaataaataaaagcaaaacatcaataattaaaacaactataaaaatgtgtagctcaaactagagggaagctggaatggcttgaggaaggaaaatgataaatgaaatcaaagaattgattcatgtgaaataaaagaaaaatgctttttgcaaacaatactgctgactaaagggtatacatcttatgaaatgaaataatttatttttttgctcactgaacactatgatggagttatagatgcagaagtaattttgtagttgactttgaaaattgttttgaaaagtagaagaaacgagttagatgtttattgaggcaattggaggaaaaattgtgctgaagttaaggaggatagggaggaggagacaggaagagaaagaaaatatcccagagaagtgtaatggtggtggcattggatggcttgttggtgtcacttttttcatattttgaaattttttaatgtatgttcaaatcacagaaaggactgattccacttctgtgtagttagtgtaaatatagagagcacctactcagtgaaaagaaaattaataagcttgaataatttagaagaagatggaactcttagctagaggtcactaaaaaaagagaacatcaggaatgtaaagacatactagggagaatattgaactttcccctaaaatacagtaaaattttgagctgatattgtctagatctttaaggcaggaagggtgcagatgaaatatcagttatctaatatcaacatgagcttagtttaatgaatcatgagattgtacttatgttaaataactacattttgaatcagtgataactatccaggatataagaaatcatttattttccataacaggactgtaatgcagaggtttggctacacagatgatggagaagccaaatatctcccagtaggaagtcactaccaatactaattaggagggataaacgaagaggaggttcaacctaagccagaagatagtgttaacaggcagaagctacaatcatgtggacatgtcctgaaaaagtgggagccacaaaggatacacagattctggatactacctaattcagagagaaagggcgagggagagagaaataccctgtgttttctatttcttcacttaatttttatctgtgcctacctttgtccaaaaccacccagaagcagatgacagggttgcccagaaaatacaagattatcagtcctgttacacagagcacagcaagaaaagaacaaatcattggtcaaacacacccaggatgggcatagtttatatgtaagggggaccaaattatcaaataacttgataaaaagagtgaatctagagatataaagtaacaatgaagataaaattgccaccaaacaagtttgcctagcacaagctttgatatacactgatttcagagccccattaggatactggtgccactgagacaattaaatttcagaacccatttaattttatacaggaacccacttcagctcagatatcatatcattgccgtattcacaacatttaaattgatttgcgggcaatccaacttttaattctgactcatgtaagtcttctagatttacagcaacaccatgttgaactgcactggtttgtcatctctcccattccaggatctgtttatattcagcactgtatctcaaggacaggcaaatagagtcagatttttgacatagccgaagagtggtgactttagagaaccctatttcctcttataagagctttttaggaaataaccagttactagcaggtttaatgcattggcaaagtccaagtgtcctctacatctcacatcctttgtgtcatctataaggacataggaaggcaacttccagaagcaaaaatatgtctgtatcttctgccctcactttttaggtcaacacagccaccacaacccgagctgccattttcatttcctgccatggatatctgacagtccttcatactgaagaaaagtaagtttcattgatataaaaagttataggattattagaagtatttatacttatttttgtttttagcatgcccactaaatacttcagagttagtcataaattgacaagacaacccctcggctttactcatttcattatttattagttctcaaaacaattttctcaaagtgtgaaagtttcttttaaaaaaggtagcatgaaactatttcagccagaaatagcctatgaattcatagtatatgtgtcactttcctttgcctttctgtaatagttactcacagacctgagcttctgtaattggcttattttattacttggaataaataagattgtatacaagaaatcctgtaggagaggaaaacacaactcttgggcgtggatattattctttgacaacccaaagatttttccaaatggttaataaatggaccattatcttatttactcttgaggaaacttcttttccagcatctgaggtaatgacttcccagtttttgacctgccactgtaaggtttaaatttggttttcctcaaaactgatagatatcagaaattacatctaaagtgttaaagattctgagctacatagtactgggtgtcaaaaggttacagagacatccctataccagctgagagtccattaaaaaggtcactcacttctgttctcacaagtattgttcactgaattgagtcaagaaacgctcaataaaagggaaaaagaactaaaattgttcctgagaattacctgacaaaagtgagatcaccgaaagaaatgatttaggaccataccacggagagacacaaagtggtaccagagaccagctcattaagtttaccatatacaactatggtaatttgtttttaaaagatattctaaaacaggtaagtcaaagtttcacatatggaaatatgtccaaattaaaatgtgcttgtcttcctgaagagtctgggtcattcattaaaaaaaaaaaaaaaaaaaaaaatgtttgtccaagattttagagcaggaataaaatatcttcatgagaattacttttctattcataacaggaatttgtagtaactcaatgcatttttataattaaaatgtattattaattttgtgtaatacaaatgaaattggatttagagataagtttctggatgacattgaaaactcagtattagaaaaattccaaataatttatagagaattctcaataatttatttaaatactctgccatcaagtagatacagcataactgctcaccacttaagtgtgagatgcatatagtgacttccttctaaagaatatagtatgaaaatgaggggaaaaataacatctgtacaatcaagatacctggaaaatactgctttagtgagttaatcaaggttaacatcattaataagttgttgtttatagtatatatagtatatataccaattataaatatatgttgatagtgtatccccttgaaatggtacaatgaaaatggcactttacctctttattttccttgaaatagataaaccatatctagccatgagaaaaacccagacttaaggatttttcataaaatatctcatcatgttcctcaacacttttaaaataggcctactttgttttattgtgctttgctgatgctgtgtgtttttttatttgtttgtttgttttttaacaaattgaagggttgtgttaactgtgtccagcaagatgtgactgaattgctgcaatcttatgatcaaatttggagagatgagagttgctttttatggatgagcaaataacatggtttcttgagatgtaatctattcctggcgaagatgctgtgaacaatgttgaaataacagggatttagcatattacataaagttagttgagaaagcagtggcagggtttgagaggattgactctaattttgaaagaagtacattggtgtcatttttccaacaccatgtgctcacttcgtgtctctgcgtcacattttcgtaattctcaccatatttcagacgttttcattattatatctgttaaggtgattagtgacctttggtgttaccattgtaattgttttggggcaccacaaaccatgcccatataagatcacaaacctaatcaacaaatgtatgtattctgactgctccacccactggcgattccctctttcctccccgtctcctcagtctctctattctttgagaaacaacaatattgaaattatgccaattagaaactctacaatagcctttaaatcttcaagtgaaaggaagagtagcacatctctcatttaaaatcaaaagctagaaatgattatgcttagtgaggaaggcaggctgaaagctgagataggttgaaagccaggcctcttgcaccaaacagttaaccaagttatgaatgcaaagcggaagttcgtgagggaaagtgctatttcagtgaacgtatgaatgataaaaacaggcttatggctgtgtgatctggataaaagataaaaccagctaaaacatttgcccaagccaaagtttaatctgtagcaaggttctaactctcttcaattacgtgaagacagagagatgaggaagttacagaagaaaagtttgaaagtaactgggaagtcattacctcagatgctggaaaagaagtttgaaactagcagatgtttgttcatgaggtttacagaaaggagtcattcctataatataaaactgcaaagtagagcagcaagtgctaatgtagaagctgcagcaagttattcagaagatctagctaagataattgatgaagatgattaagatgaacaatggattttcaatggaaacaaaacagtttaatatgagaagaatatccaaataggaatttcatagctagagaacagaagtcaatgcctggtttcacagcttcaaaggacaggctgactttcttgttagaggctaatgtagctggtgattttaaagttgaaactgaatctcatttactattttgaacattttaggccccttaagaattatgttcaatctactctgcctgtcctctagaaatggaggaacaaagcctcaatgatagcacatctgtttacagcatgatttactgactatgttaagcccactcttgagacatactgctcaggaaaagatttgtttcaaaatattactatttatagataatgcacctggtcactcaagggttctaacagaggtatacaatggagaagcatgttgctttcatgcctgctaacaaaatatccttctgtagcccatggattgaggagtgatttttactttcaaattttattgtttaagaaataaatttcataaggctacagatgccgtagatcgtgatttctctgagggatcttccggaaaagattcaccattctaaattccattaagaacattagtgtttcatggtaggaagtcaacatatcaacaatactagaagtttggaaaaagttgattccaaatctcatagatgacattgaggacccaagatttgaatggagggagtaactgcagatgtggtagaaatagcaagagaactagaagtgggagaggagctgaaagatgtgactgaattgctgtaatctcatgatcaaacttgaagagatgagaattgctttttatggatgagcaaataacgtggtttcttgagatgtaatctattcctggtgaagatgctgtgaacagcgttgaaataacagggatttagcatattacataaagttagttgagaaagcagtggcagggtttgagaggattgactctaattttgaaagaagttctactgtgggtaaaatgttatcaaatagcattgcgtgctacagaaaaatctttcatgaaaggaagttaattgatgtatcaaactttattgttgtcttattttaagaaattgtcaaagatatcccaaccttccttcatcagtcagcaaaagccaatattgaggcaagatcctccaccagcacaaacatcataacttgctggagagtcagatgatcactggaattttttagcaagaaagtatttttaatttaagatatgcacattgttttttaggcataatgttattgcacacttaatagattacagtatagtgtaagcataagctttatatgtgctggtaaccaaatagcttgtgggatttactttattgaggttgcctggaactgaactcacaatatctatgaggtatgcctgtattatcaaaagcaaggaaagtctgagaaactgtcacagtctatatgagctcaaggagataagaccaccaaatgtaaaataatgtcctatataggaccctataacagaaaaatgaaatgacataaaaactataaaaatctgaaaactgtatggacttttgttaatcataatgtatcaatatcagttcattagttgcaacagatgtatcatggggaaactaggtgtgaaatttaagagaagactaatattcctgcaactcttccataaacttaaaactattataaaatgaaaagtttatttctttaaaaacttagattagtaaaatatagttaaaatattaataaactccctgaaaactatgaataatgataactatgactaacatgattgtattttgagtgatcaatctactcagatattcagtatatttcaaatttaatgtttgcttaatggaaacatacttaaaagtaaaacattgcccagaagtaaatgaggaaagttaaattttaaattatgatacacatgtaacatatatggaattgaactgcagcctttcctaactttatatggagcatctccacctccctacttgccaattccaacactaacccaactctaagcacactggcaaatcatattgtgtttacagatattgtcttgggatggggataaaggaaagaatacattgtatctcatatagcaagcattataaaaatgatctttaaaccttttttttcttttttttaatgaaaggtctagaaggtttgtttagctttattctcacactctccagaatctttttctttttctctttttgaagaccacatgggtgcagctttattccactcttagtttatctagatcctattgtttttgtagttaatttaaatctctcttgatttatttaatttatagccttacatatcaatatcctggaagaacttgaaaatgttcctttagatttttatttttaagaaggaaagataaaagtattgcagataacttttttaacttcctttattatttgctctgccacaaacaacctatataatattcagtatttttttccaggattaacaaaaggaaactttgttttcaacaatttttatggtgcaggagtactatctggcaatacaagtttatttgaaacagaactgcatgacactcacatattaagcactttatgaaggaaaaccgtaagaaaatatcctagaaagtaaaatgttggaatataaaataaggaatcctatgctaaatctctgcctttggtgatttcaatgattgagaccaaactcagatttccatcaagattcgtaaaacttatcctgccattgttgaattcactactggagtatatatactgttcctggtcaatttttagaaacacctgagctgataaaagttaaaagaatcacgaggagaactggaaatactgacttataggagataataaatatccttagattcatatactatgaaaaaatgttttgctgtcttcttagctgctatgctttctatttcttttttttgacacacaaacattagaattttcaaacaaatttactaattttatgaacttactattttatttatttattattctatgtacagtattccattactatacaatgaagagtatattttctttcatttttaggtggttaataaaataattcacacaaggttatggctaatcaaattattgtagtcaagaagtcagaattgcagataacagctcttggaagtccacccctaagtatggagggtgttcatgagtttaagagaaattttcgtgaactgactagtcacataaactggtttctactatagttggggacaggactggctgtataaatgacagggtatagtgcaaaatgaagataaggggctgcttattaaaaatttattcagaattttaaaatggtgtcaaaagatcatgaaaccaacagcaagaaccttttgagcattgagtcctgtgcaaatgtaaaaaatcatgaagctggtcctgcataggggtagtgagaattagggaataaatactattttccttttggtaacttagtgatcccctgttttaagtatgaatccataatcttaaactattttctcttctttggtataccattgcatgtactatctctccttttaagcttttctgcttttctcttgtatttatttaatttataaaccttcaaataaatgaaatatgatgaggggacagttcctcatgtagcacttagtcataggtaaggagtggaaaagcgcttcatggcactttattttaatgtttaatttatataactatacgcctttttgaaacctgtaaggacaaacaattgaacatctaaagacagatatccatatgtactgtaatttcctgaattctacatttttgggaaaaaagatgttcttctatggtaagggaaatatatgtatactcacacaaacacactcacacgcaattatatatttttagtaccctattacgtttgaatataacatgaaataacagacatatgcaatgcttacggaaaattgatatattaactttctgatactgtgatcaccttaatttcttgataattcattttatttgcatgtgaagctttgtaaacttatattttgaaattgaaagagtcaattagaaagcacctcaggactcatagtgtccttcttttattgctttgtaacacactgcttttatgtaattgctttaatactctactatgtagcactagtgtgacaatgattattatgataatgatgataataaaagcgatatttaataatataaattgtaccttgaaataagctgtaagtacagtctacagagcttaaatgctaaattctcaaaataactcggtctataagtggtagtcttttatttgtttttctgcagctcctaaacactttccaaaatgtattcagaaagtgattataatggaaagatggtcttccttaccaaaggaatgtttagatcctttctgagacctagggactatatctcacctccagagaaccataggtttatataaccaccatatatgagacggtaaaatattaattacaacaataagcatcttttgagaactttttccaggctatatcagaagcaaaaaaggttttgtttggtgtttgttcttgctttgttctatgccccttccatgtagtgaccattattatacatatcttgagggaactgaggcttaaaaagattatataaatttaaacagagtaaatttgcacaaggctatgctacaatgttaaaatactttcacagaactttataacttacaaagtattttcctatttagctcaataataaacacataaggtcacttaggctccaataataatacaattttgaatgaatgagatattcttgccttatacttccatggaagagaaaggaattgcattatacactatttccatgatttagttacagacatattgctatgtgaacagaaaggaggataaggcaaattctacctggaactttcggatgatttcatgagtggtcatttgtaccacttctcccaagcagttttagaattatatgagcaaatgtatgaagatggtaaaaatctgtgcctgcacaaggaacaatacacagtctggtttggttagagaatagaatacaaaatggcagctattcttggaaaatgcatattaggctgatctataaaactttgaattcctacttatatgtacaggatctttctgtgtcagttttgaatggaggcataatgaaaggatggagaggcaagaaggaggttacttaaaaggctacagctaaggcaaagttaataatcaccagagattagacagtagggaagaaactggatgcaaattcaccacactcattttactttttttctggtcacaccatatttctagacttcctttaagtaaaggttaaggataaattaaggttaaggataaaaaaaaaggcaaaagtaaataaattatttgcaacctatcatacatatctaacaacagaataaaaagataaaaggtactgattctgaacattcccaaaatttaccacttaatttctggaagaggtttatcttctactcaaatttagtgaagagagaaggtcactgtggcttaatgaaatggctcatctccaagctaatgtccaatctcatatcagccaaagtatgatcaccaggttacattaaggatgagcttgatatatattttttcactcaaacacccatcagctttgcaatgcaatattctctctcaaaggcaagggagacatcgatgttaaataaaaaacaaaagaatttagaacaatctattttgcattgttacatacttatacaattgcaattaatatttgctttattttaatctaccataaaattgtctgtaaatggaatttctcctcaataaatgagtgctccacatcttttgccccatctttcagctcaataatccatgctcagggtggatgtggaaaccccgtattgaagaaggcagcatgtcaagaaccacagtgttgaaatgactacatgctctgttataaacactaaaattttaaggtttatctttaatatctgctagcattatctggaatgctaaacagtactatagagaaaaaataaaagggaaggtggaagaaaaataacaagttagtcaaggttgttataaaatgtgacgatttagataaacttaacaaaattttacctctggtaaactaggatgttggcactataatacccaaaatgggatacataagaaaaaatgaatctactctgaaatgtaatgatgatcaggctaagcgtatgttagggtttagagggagcgcccctaaaatataagaaaaatatttgaaaataatactttgaaactatttttgacagctcaaagaagcagcagcttctttcttgaagcagcaaagtaatcatacgggggtaatcacaatgtttcttatgctcttatatgcactctacagtttggcattgtttatcaatttcattctttccagcgattagagcctctaaaaattcatgctagtttagaagtatgtctgtgtttaggtatctagagaacaggaagagagttcgatatgttgctcagcagagaaaccaattctaagagtatatggcacaggagtcaaacccttagaaagattgttagagccatgaattggtataggaccacaggagacaccatagaaaaataagagtagagtgtcatcaggctatagtcccatttacaaaaaggaaggctaattagcaaaactaaatatagtcaagagataggagaagaaacttaaagaaaggaattatcactagcaaatataatgagaatataccaacttggacttatccttactggaggcatcagggaaaccaaatgggttcattggccaaagtgggcagaaagatagctttgaaatgcatctgtcatggtttggatcatggtacaaaagcaagttaaacttatgtagatacatcattagtagataaaatctttatttatttatttatttattttttgagacggagtctcgctctcttgcccaggctggagtgcagtggcacgatctcagctcactgcaagctccgcctcccgggttcaggccatttcctgcctcagcctccctagtagctgggactacgggcgcccgccaccacgcccagctaattttttgttttttcttttcttttttttttttttttttttttgagaccggagtcttgctctgtcatccaggctggagtgtagtggcgcaatctcggatcactgcaagctccgcctcacgggttcaggccattctcctgcctcagtccccagaatagctgggactacaggtgcggccaccacgcccggctaattttttgtatttttagtggagacggggtttcaccgtgttagccgtgatggtctccatctcctgacctcgtgatccgcctgcctcggcctcccaaagtgccgggattacaggcatgagccaccgcgcccggcccataaatttttatatatttcaaccaaaattagaaaaacagaataataatagtgaaagaaccagaaagtgacaatcttcaccaaacgttcagtctcaaatggtatgggcaaaagcacaccatgcacacagaagaaagggcagactgagatgaatgtgggtcattagggttcaagaagtgttatggaaatgaagggagtaaagaaaagaagaacatcaatccaggatacaaaacccatggataacttcagacaatgcatttttacagctgtgaatattttaatatgatagctaagtaaagcaaacatattaaagaaagttgaagagaggagttacaaaagaagtattgtctagaggagtcagagggaaatataatttgatagagaaaagaagacaatggcattaataagcacttagtatatatgagaaagttgctagagaggatggtgggcagaggagaaggattctctgggttcaatatgaaatttctccacttataaattatttcaccttagggaagttattcatttttaatatgctcacaaataaacaggataataatttgttttcatattatttctttcagagggagtaaacagagatccttttaataattatgatgtgacaacaggtgcaaaacttagacaaactaaggtatctgatcaccatatttactaggcaaaatattgaggttaaaagaatttgtgctttgttttttcttttcagttttcaacgttctcatcccagtagataacaaaaggtctgtgacaagatgggacatagcaattctgtctctgtgatctgcccatcaggaaaagagctcttaataatccaggctaaccttttctgcagttaaatgtacccagtttcctccttcagtggtatgatcttagacatcagctttctttgagggaaatcttcatagagacattgagagaaatctttacaatctaaaattacataatggaataggtctgtggttatagttcagttttaactagggacatacaagtcataatgtcttaacttcaaatatcgaaaatccataagaatttaaggtatgagaactgaaggacagaaaaggcagtcttatttgtgctatgagatgttcttaaatccctcacataattgcaccaggaagtatactttctttcttcatttatctcttaaagctcggtcttaagacgaaggggctaaaggcctgagtttcaatttatatttgtttcataatagcagtgacccctcaagaaatggccactaaactgtgggaaacgatgaattcctacacagtaaaatagattattttcttaaaaatggcacaaggttttatgagaattacagcagaaacattgcttagcatcatgcatggcatgtactaaatattcagtctatgctacttaggtatccttgatgttataatatgaaattgtggatatttgtaaatatgcagtctcctaatacatagttgtaaaaatgtgtgaaggtgtccagtgagcaattaatagattcttaaataatattccattcttacccttcatgatttgtatggaagatttagagaatgaaacaaaactctgggatctgtaccttttaactgaaacaaccaccagaactaaatttacataaccatgataaataaatctctaaataagataagtatggataaactttgtaaactttctctttttaagatacaaacaacaataatagtgtgggttatttcttcataaatcatatacactcccagttatttgtgtcaaacttctctcttgtgcctgatggtttccaattcaaaacatggtaatatttttccagtattcaaaggaagttctgatttgtcagtacatagaacttaccatctccaggcatacgtattgatggaatgtaagttaacaattcaaatctttttttttttttacattgggtggtaatttggatttatgtttctttaaaactaagtcattggtgtcatgttcatttccctatagctaagattccatcatactgaaccagaaagaaatagtatgtgtgtacaaaaatgtaagaaatcagtactccaagctatataataggttgtcaaacattattctcataaaatatctatagacacattggccaatatttacttattttttatagtaatgtagaagcaatagtagttaaaaacagggactttggagccagaataatctgtattggctcccatctccatttcttatttgctttgttctctaacaagtctcaaaatttcttgtctcagttttctcagttttaaaatggggataattatacatatgctttacatagcatatttaaattactaattactgtagtaattaaatgttagcataactaaagtttatacctgtcgggtagtaaatattatgtggttgtactaaatagtaagctgtggttgtcaattctaatattcttaatagtacacacttcattgtgttctacagatattgattaaatataatttttgagaaatttaaattttgacttttctctaacatattaaaatattctaaaatatagaattgctgggttcatgagactatagaaaccatatgtgaaaataaagtaatatcagcatcctatagacatcttctagaatcatagaataaaaaaggttctttatctgttatttgtatttcattttattaagctaagaaagattaaggataaatactcttgaaaaatacataaaaataataaaaattaaaaataaataaaaaatacataaaaaatataaaaaatagaaacgtaaatctacattgccacccaatgtaaaaaaaaaaaagatttgaattgttaacttaaattccatcaatacatatgcctggagatggtaagttctaggtactaacaaatcagaacttcctttgaagagatttattaagagatttgatgaaagtgattttaaaaatgcaaacacagaattaatctcttgctctgactactgccctatctcctaatttgttgttctacttctgttcttgctcttacttattctatttttcccacagtagccagagcaatttttgtaaaacatgaaactgattatgtgactgttctgctaaaactcttcaaattcttccactgtgcttaaaatacaactaaattcctcacctttgtttacaaaactcatgtaatctgttccttgcctaatgctctcacttaaattcataccattctctttctcacttatttggcttcacccataactttctatttctggaacacatttatgttcatttccagcaaagacactttgtaattgccatttcctctgactggtaagcattggatctagattttagcaccattaccatattcttatgattcagatcttaactcagtgacgcctcttttcagaggactttcccaactaccaaatcaattgttgtttaaattccattcttatcacgaatacccttattaattgtcagtcacattactcttgtagcatattaacatgattgttctcagaaattatctgttcattcatctacctcttgattgcaagattgcaagctccttgagaccaaagattttgctggcattttccactggtacatttttcccacccagaacaatatttcctaaattacagtatcacaatacatatttgtgtaagcaatgaataaaaggacataaatcaaaagagaagcttgttgatatgctaatatgaagatgctgatgttcaaacagaattttatcagtaaatttggaataaaaagtgttggaaaagatattcaatggtaatggggtgagtggttgatatgtattgtacaacagcaactgagaaacattaagtgtgaatagaaatatcagcaaatgcaccattgaagtagtatcagtagtacacaaagccaattcatcatgaaatagtttacactctaactcttccataagtttcatatttggctctttctttagatcccctttgcccactttattttgggctatcatatttcttcctgttttctaattaggtgttgtctttatactgtgaatcttagtcttacttgaatcaatgattagtagaaatcactgttgtgactaacatgcttcttcacatatgtgtttaaaagtaccctaaaatcaattcatttaaagtgaaagcctgactgttttttaaaatatctttcaatactacttcattatcacattaaataggcaataaccttgcacctcattattttatattgggtcttggctaactgtggctcttggactaaatccagctggccagctgtttttgtaaacatgattttattgaatcacagccacacctatttatttattgtctatgactgctttcactctacaatgacaggatcattgcaacagagactgtacagccaacaaaacaaaaaaatatgtattatctgccctttatcagaaagcttccttgtccctactttaaaccactgttttacagagattaaaaactatataaaattcaaatcattttcttccatcagctttactgagtcatatctgtctctctccctttccatacaatataaagattacctttcaagatctcttattagcctttaaacattgaagacattggcaaacagacactactttgttttcactagtttcttaataaaactgttaattgacaagttaccttatttagcaggaagccaataaaccacagtgtaaatcagtagattacgctgctttaagcttttgaaaaaatgattagtctcactaaagggttgggcaattactgccactgctaactaattttgtacctggaaataaagatctgcaatttgttgcccatagctatagcacacagcctgttgacttagtacctatacagttataaactatggattctaagaaaatttaaatgtatgatgtttatttaagtatatatggttatgatgttatctaaagtacatttattatgaatttcttggtatataatcattcatgcagataggaggatctctcattttgcaataaaacttttaattttgacccacacaaggtaaagagatgctcttgaggtacctgcttctaaactacaggcgatgaatgtgtgtgtggactcattggtgaatcctcatatataaacaaagtagatgatatattcatgctaaaaggaatctgacttggagcgaaggcccttttctagaggcataagatttagtcatacaaaaacacttaaataattttaaaggcatcagactctctgtacagtagggattataaaagactgaaatttcccttttgtaatagggtttctggcctctctggccctccagaaatattaggtatagcttaaaatcagagaaaaataataccaattgccagagaatgctttgtccttcatgatgtcaatagctgtccctcactggttgctctgatctcttctttctgtcagcttctcttcacctatacacagacaactatgatttgcaggccagaaatgtaagagctatgcatattggtgccacattaaatccatggtcatcaccattaaatgagtccttaatatagcaagaccaccttgtttcattttttctgtaaactcctgtttccctcattactatcattgtgtaaaaactgtgtgtcaaatagagttattaacacccgcacagttggacatatgcgagttaactatggctttgtcacacaggaatggcatgatctggaaaaaatgggttaaactctccatctcttagttttttctcctgtaaaatgatgacaataatgtttataacatatacttgtgatagcattaatggtacatagcatatagttagtcctaataaaaatgatttattgtctccatcatgcctctctgactcctcctcctcctcattgtttttgaacatgtaacccatatgctactctttcacctgagaaattagaacaaatacaacaagattaaccctgcacctttctgtttctccttttatcatctttcaatggaggacttggcttctttctaagggccatttctctctgtcctctagtttagatgccttctaattgaatgctatttactgttcaactacttgttattttcttaacatttccttgtaatataaacactctctcattaaaagtcaattatggaaccaaagaacttctgttgcatatctccttttgcatggatggaccttttggtttcccttatctctttgggtttaggggtggtaagggattcccattgttgctaggcatgaggtatttcaacattctgttaaggtttcctcactctgttcacacttctgtaaatagttatttcattgaaatatcatattaaactctgtgtgtgctactgttctgtgccaggaccatgactgatacagatgcctatgatctttatggagtcagtagaagtgttagtctaagtttctgggttaatcatccaaactctattaatagcttattacatgccagatactgagaaatttgaacaattgataatgaatgctaacttaagactaataagatcaaacaatcagaccttatttcaagaaaaaagccctgctacttaccttaggaactaatttctcttcttttccaaaatatatgccatttcaaatgatcagtttaccctcgacactagaatattttctcttcatcattccatatttaaaaacatttatttaacataaaaagagcaagttaattacaatccttgtttccttggccacagttatagctatctcacagaggagaaaacacattttatatgaatggcacctatatttcttttcaccgagacacatttaacaacccatcttttaaagcacaaagaaaggagaaaaccttcagaaatatgtcttttcaaatgttgttaaacattgatttgtctgattattataacttgagatagtccttattgtagtaattgaatacttaaaatttaagaatttatgccatgttatatgttaattttatgcatccactttctatttctcctgttccagcctcccacatcctaggacatctgtgaagataacaaaattgcaaatgccagatggtagtatgatcattaaattaaaatcagttccactcttgtttcaatcatgaaacagaacgatcaaatttgtaaatgtttctattttggatattattttattttacatgaaaacaaagagatgtactttaaaaacattacattggtaaattacagtatttttttctctactaatcttattttgtaaggttctaaaatttggttgactaacacttgtgttctgcaaattagtttacctaaaaagaggaataaataataataaactttgaacaaaaaaaactaatataaaatactgttatatttcacataactaatggaaaaaaaattctgacaggctttcttgacacaaaaatattaggaataaattttgttccttgttgcagggtgaagtaaggaagatggttgaataagtaccaaaccctcctctgaaagggacaccaactcaacaatatgcaaaacattctcctttgtgagaaacccagagaccagccaagagactcctatagcccaagtgagtatcatgccagccacactgaagttgatgggaaaatttgtggcacccacttgccaaagccctgcccttagctcagaaatgtgcaatcagaaggaagatcctaactcctcacttctccctggggaggaaatagaagactggaacatatgtctaatgttcagatttggagggaactagctaagagactgatttcttccctatttgaatctaagtgctgacaggaaagggtgtcagataagaaaccagtggaaacagaggcagccctttgaactagcacacactcagttaccatcatctttctccccagctcagcataacagtttcacctgacttggcatactgacaggaatttgaatgctctagatgcttgaggatactgaaaacaaacataagagctccagaggacctacagtatagcagacagaagctgattcaacttgacagtttgtccctcagggggaaaagagaagaataaaaggtgtgtcaaatattctgactttcgggaggagctgcctgaaaaactggttgtttacttgctagtctcagagcactaaagggagctggcatactctaaatgcctgaggccaatgaggagaaaaagaaatgagtgacttacagtaacatcaaaggatcttcattagtggagacagacaccataagaaggaggaaatttcagcttctaaaaaaggaaaccagtaaaatctccctaattaggaatttacaaattcacagaaaacatttgagagacccgcaaaatatgtagctgggtcatttcaagaaaaactttccctgtttggagctggtccacaaatactgggagagggggctacttttcaaatgcatagatcccaacaaaaagtaacaaggcacatgaagaaactgttgtaaccaacagttgggcacatgagccaagcaaagtatcaaaaaactatctccagaaataagtcctaaagaaatggagatatatgaattactcaacaaaaaattcaaaattaaccattgtaaagatgctcaatgaatacagaaaataaatacataaaatgacaacatcaacaaagacagaaaattttcatgcgagtccatgtgaagagaccaccaaacaggctttgtgtggcaataaagctttttaatcacctgggtgcaggcgggctgagtccaaaaagagagtcagtgaagggagatggggtgtggccattttataggatttgggtgggtagtggaaaattacagtcaaagggggttgctctctggcagcaggggcaggggtcacaaggtgctcagtggggagcttctgagccaggagaaggaatttcacaaggtaatgtcatcagttaaggcaggaaccagccactttcacttcttttgtgattcttcagttgcttcaggctgtctggatgtatacgtgcaggtcacaggggatatgatggcttagctcggatcagaggcctgacattcctgtcttttatattaataagaaaaataaaacaaaatagtgttgaagtgttggagtggcgaaaattttgggaggtggtatggagagataatgggcgatgtttctcagggctgctgtcagtgggattggggcagcgtgggaacgtagagtgggagagattaagccgaaggaagattttgtggtaagaggcaatattgtggggttgttaaaagaagcatttgtcatatacaatgattggtgatggcctagatgtggttttgtatgaactgagaaactaaacagaagatacaagatctgaataagagaaagagaaaaacaggtatttaaggactaagaattgggaggacccaggacatacacttagagagtggccaagggggttcagcgtaagtttttgggctctatccttgtcagagttctcctttttaagttggaggctgagcttgatgaggcgtgtttttaaaagaccattagtccattctacgtttcctgaagattgaggacagtaaggtgcatgaaagttccactgaataccaagagcctgagaaactgcttgggtgatttgattaataaaggccggtctgttactggactgtatagaggtgggaagaccaaactgaggtattatgtcttacagaagggaagatataaccgcggtggccttttcagaccctgtgggaaaggcctctacccatacagtgaaagtgtctaactagaccaagaggcattttagtttcctgatatgagtaaagtcaatttgccagtcctgggcaggggcaaatccccaagcttgatgtgtagggaagggagggggtgcaaaactaataaaaataaacacacagaaattttgaaactaaagaataaaattatataattaaataattctctagaagaactcaaaagcaggcttaattgtgcagaagaaaaacagtgaacttttgaaatgacaagcaaaaagaaaaagaatgaagagtgaagaaagcctaaaagactgatgtgactccatcaagggaacaaatacacattatgagagttttagaaggggaagagttaaagaggtaaaactcttgttggaagaaataatggcagaaaacttcccaaattggggcaaggaaatgaacaaccacgttgaagaagtccagtggcataaactcaaagaagacaacaataagacacaatgtaatcacattgtcagaaataaaagacaaagagaggattttaaaagccagcacaatattgcagtgaggcgagatcacaccactgtattccagcctgagtgacagagcaagactccgtctcaaaaaaaaaaaaaaaaaaaaaaaaaaagcagcacaataaaagtgattcattatatacaagaaatcctccataaaactaacacaggattcctcagcagaaatattgaaggccagaaggactagaatgacatattcaaagtgctgaaataaataaaattgccaaccaagattactatatggaacaaatctgtccttcaaaaatgaaaaagaaataaagacatttccagattaacaaaagttgaggtagtttataattatacttgccttacaaaaaatactaaagggagtccttcaattgtaaacaaaagaatgctagatagcaacaaaaaaaacatattaaagtatacagcttggtagcaaaggtaaatatttaatgaatacagaatccttcaatactataatggtagcatatgaatcacttttagttctggtgtataatgaaagtattagtataaaaatacaactaaaataaatttatacacaatataagaaagtataattgtgacagtaacagaaagtgtatgtgtggaggaggaagtaaatatgtaaagttttttgtatgcaattgaaattatgtgttatcagcttaaaatagattgttataattataagacgttttatggaagccccatggtaactgcaaagaaaatatctataagagatatgcaaaagaaaataagaaagcaattaaacactgacagtataaaagtcaatgggaagaaaagactgcaagagaggaaaagaggaacaagaaaagctacaagatagacagaaaacaatgaataatatggcaataataagtctttatcaataaatattttaaatataaacaaattaaaatccccaataaaaagatacagagtagctaaacagattaagataaaaaccaaaaccatgatttaactataagcaccctacaagagactcactttagctttaaggatgcacataggttgaaaatgaaaggatgaaaaaaagatattatgtgtaagtggttagcaaaagaaggcagaggtagccatatttgtatcagacaaaatataatttaagtcaaaatctgtcataaaacaaaaataacatcttagaattataaaagggtgaagtcactaggaatgtataccaaatatatatgcacatagcacccaaatatgtaaagtaaaataggcagaactggagtgagatagagagtaacatgatgatagcaggaaatcccacactccccttttaattatggatagaaaaccagatagttgaccaataaggaataagagagcttgaacaacactatagtctgattgaacccaactgatacatagaatcagtctacacaaaaccagtagaataaacattcttctcaagtgtacatattcttctccaggtaagaatacattgtaggttgcaacacaatcttaagaaatttaaaacgattgaaatcacaccaagtatctttcttgcacacaactgaataaaaatagaaatcaatacaagaaggagaagtggaaaatttacaattatatgaaaactaacacactaccaatggatcaaagacaaaatcgagggaaattagaatatgtactgacacaaacaaaaatgaaaacctaacataccaaaatttatgagctgtagcaaaagcagcactaggaaagaacttcatcgtgataaacacctacattataaagaaaaggtatctcaaataaacaacctaactttataccataagaaactagaaaaagaagaacaaaataagcccaaagttagcagaaggaaggaattttaatgattagagcagaaacaaatagaaaatagaaaaacaattttaaaaatcaacaaaaataagaattggtttattgaaatatcaacaaaattgacaaaacctcagctagactaagacaaaaagagagagtattgaaataaaattataaattgagacattacaactgatgccacagaaattaagattataaaagagtattacaaaaattatacgtctacaaattgaataacgtcaaagaaatggatcaattcccagacacatacaacctactaagactaaatcatgaagaaatagaaagtgttaacaggcatatatctagtaagaaaattgaatcaataagcaaaaacctctcaacagaaataaagtctaggactagatggcttaactggtgaattctaccaaatatgtagagaggaattaatgtcaatctttttccacttgctaaaatattgaagaggagacaatacttccaacatcattttatgaggccagccttattctgagattaaagctagattaaaaacactagaaaaaaattgcataccaatattccagatgaatacagatgtaaaaatcctctgaaatttcctagcaaaccaaattcagtagtatcttaatagaatcatataccatgaccaagtgggatttctctcagggatgaagggactgttcaacataggaaaatctatccatatgatacaccacatttacagaattaagagtgaaaaccacctgatcaccttcatagatgtagaaaaaatttgacaaaactcagcactgattatgattaaaaaaattaaaaaaactagaaattgaaaaaaaaatctcaacacgatgaaggtaaaatatgtaaagcccatagctttatcacagtcattggtgaaaaaaaaaaaaaaaaaaaaaagaaagaaagcttttctggtaagatcagggataaggcaagaatgtgcactcttatcacttctattcaacatagtaccagaagtcctagctagagaaattaggcaagagaaagaaataaaaggcaaccaaatcagaaaggaagaaataaaatcaattatattcacataggatatgaccttacatgtagaaaacacaatagatctcatataaaaactgttagaactagtaaatgaattcggaaaatttccgggataaaaaatcaacatatagaatcagttgtgtttctacacgttaacaaagaacaattttgaaaaataagttaaaaacaataccatttacaatgacatcaaaaagaagaaaaaaatacttgggaattatcttaaccaagggaataaatgactataaaacattgatgaaagaaattaaaggagacacaaataaatggaaagatatcctgtataaatattggaagccttaatattattaaaatgtcattaccacccaaagtgatctatagggttgaggcaatcccatcaaaattccaatgccatttcatttttcagaaatagacaaaataatcctaaaattcataaagaaccacaaaggacccccaatagccagacagtctcatgcaataacaaagctagagggctaacttcaaaacatactacaaagctacagtaagcaaaataacatgatacaggcataaaggcagacatataaaccaatgaaacaagtttgagggtgcagaaataagcccatgcacatatagtcaactgatcttcaacaatacacaatgttgaaaggatagtatctgtgttagtccattgttgtgttgctgtaaaggaatagtggaggctgggtaatttataaagaaaagagttagttgccaaatggttctgcaggctgtacaagcatgtctccagcatttgcttctggtgagggattcaggaagcttataatcattgtgaagggaacgggagccagcatgtcacatgatgagagcgtgagcaaggggatgtggggtaccacgctcttttaaacaactagatctcgtgtgaactcagagtgagaactcactcattattgcaataatggccattaatgagggatctgcccccatgagccaaacattccccacgaagccctatctccaacactggggattacatttcaacatgagatctggaggggacaaacattaaaattatatcagtatcttcaataaaaggtgttgggaaaaattgaatttttttcacatgccaaagatattcagatgcaatagaataaaattgtattcttatctaacagcataaacataaattaactcaaaatagattaaagacttaactataagacatgaaactataaaattcccagaggaaaacatagtggaaagctttataatgttggtgcaggtcacgattttatgaatatgacacaaaaagcacaggaaacaaaagcaaaaacagacaagtgagactgtgtcaaactaaaatacttcaacacagcaaagtaaaaaatcaacagagtaaaaaggcaacctgtagaatagaaaacaatatttgcaaaccatatgtctaataaacaaacagcaatatccaaatatatgaggaacttgtaaaactcaatagaaaaaaagaaattatccaattataaatgggcaaaggacatgaaaatatacatctccaaaaaaaaaaaagacatacaaatgacccacatcttcatgaaaagatgctaaatctttttaaacaggaaaaaacagatcaaaaccacaatgaaatatcaagtcatccctcttatagatggccgacatcaaaacaaaacaaaacagaaaataatcagtaaggatgtgataataataatcctcagtaatcctcaataatcagagaggatgtgaatacattgaaacccatatcccctcttggtgttactgtaaaatcgtgctggggctataagaaatagtgtgaagatatctcaaaaattaaaaatagaactactatatgatctagaaattctactcctacatacttatctaaagtaactgaaagcaggatcttggagagatacttgcactttcatgctcactgcacctttattcacaaaaaccaagacatgaaaacataaatgtccactgacagatgaatgtttaaaaagttgcatatatgtgtatgtgtatgtgtgtgcatgtgtgtatgtaagtgtatgtataaaatagaatattattcagctttaaaaaagaaggaagtcctgtcatctgtaacaacataaatgacacttgaggacatcatgctaagtggaaaaagccaatcaccaggacagatactgcatgattccacttttatgagtcaccaaaaaatagtcaaactcatagaagcagaaagtagaatgttggttgccagagtccgaagaaatggggaaatgaggagttattgtctaataagtatagagtttcagtcatacaagatgaaaatgttttagaaaccttttctacaataaagtatatatagttaacaacactgtactgtataactaaaaaactgttaataagatatatttcatgttgtgtgagattttttcaccacaataaaaagtattccttgttatgacaaattaaaaacaagaaaatcactacagtatagtaaaggaaactgcatcctgaaatatttatgaattatttgagatcatgttgtaatctgttattaatctcaagtcgtacaatagcaatttgtttcttctaccaatttctcacaaagtgtggtctgcaatagccttcagtcagaataaaaactctggtatctaagaacatctccagacctactgaatcagaattatggtggatggtacacaggaatctgtattttaagtattctttccaggtgaaaattatgtacataaaacttgtgacgttgctttatatgaaagcttatattcatatatattatgcgctcctaaattttcacacacacacacacacacacacacacacaaagcaaatgttctcaatcaatataagttacattgaagttaaattcattgtttgactttgactctaagatgtgggtcacgtatcttcactaaactcttctaatcttactgatcacacttgataatccatactaatttcagatctagaaaattaagtaaaactattcaaagttccttaacaatatgaactagatttgaaagttccaaccactttcaacattacataagatcctgataatcatactatttgttttcaacctcagaaatagcaaaaaaatttaattttgaaaagcaaagaattgatggttttgaactttattaaaagcatcatcagcattttattcattctatagtaaagaaaataatataagaacttgaaagtctattaatgacagtaaagtaaactagtttattttgttttctaagattcaagaaaaatggatcacttctatggctaaactaatatcttgaaattcctttattatagacctaaaaatgtaaatatggtttaaagactgcaatttgtttaggttagccctgtgattgactctgatttatatgctgagttcaatttcagctttctattataaatgacctaataacaaatattctcacaattctcttccgacagaggagatgtggggattcctcaccatcagcaaagaagtgatcaattctgcagaaacaccagctgggctaactcaattcaattcaattcaattctcacactctacctcgatgtagcaactgagctacatctaactctattcaattctcacactctaccttgatgtagcaactgagccacaggttgaaggttcagtttcacgagattgcctcccactggccaccggtgatcattttaaccttcagccccaactcatccctagagccttggtctatctggcaaccaaatgtcatcatctatgggggccaacagctgtcagccaacttattagcatattagaagactttggagattctaaggattcaattcaattctctaactcaattcagttctcacactctacctcgtagcaaatgagccacaggttgaaggctcagtttcatgagattgcctcccattggccaccagtgatcattttaaccttcagccccaactcatccctagagccttggtctatctggcaaccaactgtcatcatctgtgggggctaacagctatcagccaactcattagcatatgaaaagactttggagattctaaggattttaggagttgtattccaggaaatggggtcaaagaccaaatgtatatttcataataccacactttgaagaaaaatttaagtgaaattaaatcaatatcaatatttcagtggaaagcttcagtgaggaagataatttaacaaaggaattaactttttgctttacgttaatgatcttcacgatatagcagagctgaattacaatggtaggctacaagcctttatttaaattttccccttagacatgaacaatgtgttttatgctagcagaagacatgagactcctgggccagagacaaaagaccttattacttatggcttaacaggcagcataaatatcattctcctgtcctctgaccaagacaattttaatgttcccctcagcttgagtaaatgctaaacagatttcttcttgattttaggcccctgacttccttcgccctttgagatgtaaagaatctttgagcctcttgctagttttatagctcacgtatatttgtcttaagaacttgagagccatccttctaaaaatctaatcattaagaaatatagtgcctctacctgtcaagctctgtgagagagtaggactctgactttggtaagtgccaatcagcaaacacagcctaatcacgttgacccctacctaacaaatagtcttcaatacttttccactaggctactccagcaattaaaaactctcctgccttttgtttcagtggtgttgagttcaatctctcccctactgcaatagtcttaaccacaattgcaatattgttgaataaagtttgcctccctgtttagctgtcaggtgcaatttttctttgaaattctgaagtctcttgggagcaatgaagagtggtccaggtagaagctgcagtaatagtttgtttatgtcactgctgagaaatacaagcataggaaactccagtttcatcagagggttgctagcaagtctgtccaatcttagctacggagtgggaagaaaacatggtatttattatcctgattaggagacaaatcttgtctctgacccaaaaggaaaccttatctgtatcttccaaggcttttagctatcctaacatatgtcataaataattttatatataagagttaatacttacataataaatgtttgttcatttggtatattataatttgaaaatattaaaatatagttatttcttgaaatacaaatatttttattattcaatcacatattagtttatttaatacagtgttcaacaaacatttttatagattgcctaatatatatcacatgctatgatcaagagctataagacacagtaaattcatgctctccgggagctccaatatagcagctaaataattttctagttgtgtaccacattcaaagaagtcagagccagagcacagagacaaatacagagtttcaagaggtgatgctaaatttatcagacaaggagaaggaaaggccatgtatatagtaaaaagaaagaaaagaaggtaaaatggctttaatatggagtatctgagggaacagtaaataccatatgagagtggctagaattacctggaaatataaacgcggtcatggcagaaaggaaagtttaggccactatcaataagttgggctttatttgtaaatgatgtggtgtcatttaagcattttatgcagaacagtactatgttcagatatggatcaaagagaggcaatgctctacactgagactgttattagaaactgtcatagtcttgaattaactacagggaatataaattcccaaaccttctttacccatggtgtattcatttcaaaaatatatttgatgtgtttttatcactcacgataaaaattgccaaattgtttctcaaaaatattttacagcagtattatatcttcattagaatttagttttaatgtcagcacatctgatgaaaaatagtctaaagtcaaaattatccttgtcagtttctgataaaggtgccattttgaagatccacaatctgtctttcaaagtactaggttactccagcaatgaaaaactatcctgccttttgtttcagtggtgttgagttcaatctttcccctattgcaatagtcttaactactattgcaataatgttgaatacagtttgcttgcctgtttaactgtcaggtgcaaattatccttgtcagtttctgataaaggtgccattttgaagatccacaatctgtctttcaaaataacaacactacttttttctccatggtaaaacagtttacaattcctccatggaaatatcagatgaagtagtggcttgtatttagggtccatgttttattaagataagtactctgtttttaaaaactagcagcacattcagtgcttactgaagctcacagtatcagggacatgagttggaactgacaaggattgagagagcagcagattcatattttcttccacaacccactgggtctaggacatatactcagcagaatggcaggcaacatttccaacagtatctgaatgtatccactccctctctcaaccatgtataattaaagccaagtaatttaaatagaaccagtgcaaatggactatactgtgtttttatttcattttctttgcaataatgctaattttggaccaaagttttaggcaaagggtatcatcactgttaaaaggggaaaaagctggttttccttttggtttctgtttattctttagtggattgtagattaatattcattgccttagaatttattaaagtcatgatacttgccaatcaatttttgtataagcaatttgtttggtggagatgtaacatgataacaataaggactgatttattgtcttcaaattctgataaaaccaggattgaaaacaataggagacaaacattctgctatgttacagaagggtgcgagacacagtcatgcaggatttagttaaaaatagcaaatcctcttatctccccaagctctacaagaaaataataacattttaatggattatttgaagggaattaataggctataaagaaagctgtggcacttcctctgtcagatggtgggagggggtccttttcctaaagccaaacgtgggagcacgttcaaaagaatgtagagaggacacccgccagcaccttctttctcaaacaatgtttgctgagctgcagaaatgtatagacgctatatggtacagaaatgaagtgttgtgtgagagtttttgatacacgtttgtgtgtgttctagagaatttggtaatatacatgaacctaggggctgttttccactggagaagtttaaaagcagcagcagtctgttttgagatacttcccatggtaaggtgaggagagaagggtcagcagttaaacatgtgtccttttttttccaccttttattttaggtttaaggggtacatggttaggtttattacatgggtacatcgtgtgtcacggggttttggtgttcagattatttcatcacccaagtaataagcatagatatgataagtagtttttcgttgttgttgttttctcttcttttgtttttcttttgtcttcaacctcctcccacctcccatcctccaccctcaagtgggccccggtgtctgttgttcccctctttgtgtccataggtactcaatgtttaactccaacttatgaatgaaaacaggcagcctaaagatgtatagggcttctatggcctgaggagatgatgcggataatgggctggctcctgttatttttatgtagtccaacctataatagggttagagtgagggtaataagatatggaaggaatgttttcacatgggtcactctataagggcatagcctatactagacaggtgagtagggacaaagtccctgtagcacttccaaaaaacagcaagcctgatatatgaagaagaacctcaatttgaatgatggacacatagagacgtcaatggccatatttcagcagcattttttctctaattcctttgctcacttcctctattgtttcttaaacctagaatcaagaatcaagtctgtgctgggaagaaagaagctacgactacgacatcaaattgaagttttgtttatataaactagacattttaatgtctgaatgtgtcagaattaccataataaaatttttcttttaattgaaattgattggaaagccaatagatagacttaaggttcagcaaaaagaatttactagagtataattgaaggcaaggtctggagaaaagtaaagtattttcctatttatatcacatagagttcaaccttcattccctgttcaatataccagctgcaagagtattaatcatttggcatatttgccttaatattctctttttgttgttttaacctctttttatttccattacagcgaaatgtgtgtttccatgcatatgtgagagaagacagttaatatgtccaaatttcatattttcctttgtaatctatatcttttatgtactgaatgagtcattcacattctagaaggtacaacaatgttgcaatatattctcattaaaattctaatgccttcaatcctcaaattaatattctaaacattaaattcatataaaatatatttgatcactgttctaaggtaagtacagaagaccatatggtgtgcttcccagatctccgttcaagactgaaaaacttattcccccatctactggaagtgcattgcgagattatttcgagctcttcctcaacttcaggaattgttctacctgaagaatgttgccttgattaagatcatgttcttcccagtgtcaccctacatctaatgatagccagatgcaggtataaaacaaacaaacagactgaaaacctaatcctttcttttctacttaagataacctgaagggacatctctagaggtctttatttagactgtatcagagcccattttctctggcgttcttcccggctcttccccagaagacaatgctaagagcccttaattgatactgatgtctacctctgcatcttgaaaaatctaatatgggacagaaaagactgaaatcagtcctcctccaaggtcagaagccatttattacaatgccattttttagtaattattattttctttctggtgctccaatggctccttgatcatacagtaaggaggcctatgtagtggagtcgacgcgattatgtggttatgcacgtgtatgcttctgtgcttgtgctagcacacacacaaacacatacgaatacataaacacacatatataacatatgctcacacataaatggggagaacaggaggattcatatgtttgttaaacaaactacaaaatgaaagataaatacaaatgaacttttaaaatatcactttaaggaattcttatttatcccttgggtaatgggttgtttttaaagcaagaaagtattattatctgaattttttcctaaaaggcaaatagtagccatgtgttgtatacataaacaggaccaatgcaaaggtcattataacacatgaggtgagagatgatgaatacctgaagctgggtattgacactggtaaaagttaagaggtactcattggaagctagaattgatggggcttggtgacaacatgaaaaattgaaagggagctttttttttaatgttataggctatttaaatcgattttattagaacacaaaaatgttatttttaatttaaagtattagaagtataattattctatagaaataaaaggcataatatattctttagtcacacatttatacctagactagtttcac

SEQ ID NO: 33 - DNA, 3090 bp, Homo sapiens
ttataaaatgacagagtcaattctccgttactctccattactcgcatttcaatttggtggctcacttttcagtgtgaatcctgtctttaatacacactgttcaagagtggatgccaacttcaagtggttcctggctgtcaagggccttcccattccactccataaaatggaagggcccactgacatattttaatggaagggtataaaaaccttctttgttttaacatacattaaacacttgttaccaaacatgttggaggaatacaaagtgacagtctgtgatacatttaagtaattgtaattcagattggtttctccctattaccactttcagggcaagtgaggcaaaaatctaactaccctcaccatcccgactcctatcccagcactcctgcgtaaacatttacatcatttctaattctcacaccgaagtccttcctatcacctacatcttgctactgcgagggacataaggaggttagggaggtgagtgggtggaggtatgggcagggacaggggtaggggtttgagctgacatagtacatacaacaggaattaaaggaatcagaatcacattgcaggttgtgaagtagatagagtctgtgtattgaagttacacagctctaagtctaaatcctcagctctgaaactttttagttgggtgacagttgacaagttactaaacttctcagagcctcagctttcttacctatataagtggttaataatatgtacatcctagggctgtagtgagaattcaattacatgtataagttgtaaatactcagtatacactcaaatatagtgctgtatttgtattgggtgaatatgtggaaattagggagttctatgcttttgatagagacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatctagagtgagaaaaggaaaatgtgtcacggatttttcttatactgaagacatgaaaaataaaaactgtataaagttatataaataaactttattcttcatgcacactaacaaaccaagaaaatatggttctaagtaagtgaaagaaggattccctaaaacccaaaatatttccctcaccacctgaaactctgctactagatattaattcttttgaaaacatgaaagtttttgatcctcatgaaaccacattaaaaatgtttatttccctgaaagcctaagtgagacttcattggctaatacttttgtggggattagaaagacaggacttctttcatttacactggatttgatttacaatcaaattaatatttggaataaaaaatatttccactttctgtacacatttcctcccattctgttcacagaaggcaccactatgatcacatgcaattgcccactatcaaaggaaaactctttaagttacaaaaaaaaaaaaagtaaaatgaaggactgtctttatattacaattatagttttaaaagagcagctcttgcaggacactaaaaacgtgatacaactttctaacgtcatattgtcttatcgtagaaatacacctactataagaaagcataggacagctgtaacaataaagccacattgtcctaataaggttcctttaattatggaactcctcatttgctaaatccctttttattgtttggtactctggagtgccttgattagtatttcctacttcaggaagtgatgccaaggtgggagaagccaaaaaacacacaaaaaatccccaaatagataattgctatctgggacttatatgtgataaactttattttgcaatagctaaaccagcactttctcttccttaaacattttcccagatttggggtatggctcggttcatttattttctcaaacttacctctaaatctacctctactatgaagactccctagaccaaatggaaatgagccatagatttctactacctctgcccttaaaaacaaaaccaaataatatatattgtgtaattcattttaaagataatctaaacttttgagcacaaaaattgtctctcatgttctgcagaaaatatgtacataataatacattttctatagatattaactccatagaaaatatgttaatgaatcagaatctagattttcgcttgtttctctttcctgtgcaataaaaggatcacaaattcaaatgcctacatgtgtgaagggcacatgtaagacaatagggagcagtacggactacggtaaacaggagaatgcaatcccctctaaaggcattcaaattaaaataataaataagaactttgaaattcttcatagaccaaatttactccacagttttcaaattctacatatagtccagtgaaaactatattttgtcctgcttgtttagaatcataacattttctctctgggtaaccctgtgccttcctcacattgtagatacagtagcagattggcagatctctctttcctttgtgcaccaaatctgtgcacaagactgtagaatcaaaatgggacttggagttctggtttacctaccctctgccccatccacaggggtgctgagcagtggcctgggggtggtggtggcctcagatgaggtagtggcaggcagatcatcagcccacgttggctctggagccttatcatcttcatcctggtctctggtgacactcaactacacaaaaatattcacattttgtgtttctgataatatcaagtaaaaaaaatactagtttgcttttgggaacatataaagactagttcagccatgctgtgtttccctagctctctgatactaactatttcaaataaaactcaggaaataatgcccctcctctgtgtcatgcatccctcaatacccaagttgtggattttcccaccacttggtgtgggtgtatttctgtgtacacacacatatacacacatacacacacacacgcagcccacctccaggcacagatttttgggtgctgggacatccaaagca

SEQ ID NO: 34 - DNA, 4990 bp, Homo sapiens
ttataaaatgacagagtcaattctccgttactctccattactcgcatttcaatttggtggctcacttttcagtgtgaatcctgtctttaatacacactgttcaagagtggatgccaacttcaagtggttcctggctgtcaagggccttcccattccactccataaaatggaagggcccactgacatattttaatggaagggtataaaaaccttctttgttttaacatacattaaacacttgttaccaaacatgttggaggaatacaaagtgacagtctgtgatacatttaagtaattgtaattcagattggtttctccctattaccactttcagggcaagtgaggcaaaaatctaactaccctcaccatcccgactcctatcccagcactcctgcgtaaacatttacatcatttctaattctcacaccgaagtccttcctatcacctacatcttgctactgcgagggacataaggaggttagggaggtgagtgggtggaggtatgggcagggacaggggtaggggtttgagctgacatagtacatacaacaggaattaaaggaatcagaatcacattgcaggttgtgaagtagatagagtctgtgtattgaagttacacagctctaagtctaaatcctcagctctgaaactttttagttgggtgacagttgacaagttactaaacttctcagagcctcagctttcttacctatataagtggttaataatatgtacatcctagggctgtagtgagaattcaattacatgtataagttgtaaatactcagtatacactcaaatatagtgctgtatttgtattgggtgaatatgtggaaattagggagttctatgcttttgatagagacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatctagagtgagaaaaggaaaatgtgtcacggatttttcttatactgaagacatgaaaaataaaaactgtataaagttatataaataaactttattcttcatgcacactaacaaaccaagaaaatatggttctaagtaagtgaaagaaggattccctaaaacccaaaatatttccctcaccacctgaaactctgctactagatattaattcttttgaaaacatgaaagtttttgatcctcatgaaaccacattaaaaatgtttatttccctgaaagcctaagtgagacttcattggctaatacttttgtggggattagaaagacaggacttctttcatttacactggatttgatttacaatcaaattaatatttggaataaaaaatatttccactttctgtacacatttcctcccattctgttcacagaaggcaccactatgatcacatgcaattgcccactatcaaaggaaaactctttaagttacaaaaaaaaaaaaagtaaaatgaaggactgtctttatattacaattatagttttaaaagagcagctcttgcaggacactaaaaacgtgatacaactttctaacgtcatattgtcttatcgtagaaatacacctactataagaaagcataggacagctgtaacaataaagccacattgtcctaataaggttcctttaattatggaactcctcatttgctaaatccctttttattgtttggtactctggagtgccttgattagtatttcctacttcaggaagtgatgccaaggtgggagaagccaaaaaacacacaaaaaatccccaaatagataattgctatctgggacttatatgtgataaactttattttgcaatagctaaaccagcactttctcttccttaaacattttcccagatttggggtatggctcggttcatttattttctcaaacttacctctaaatctacctctactatgaagactccctagaccaaatggaaatgagccatagatttctactacctctgcccttaaaaacaaaaccaaataatatatattgtgtaattcattttaaagataatctaaacttttgagcacaaaaattgtctctcatgttctgcagaaaatatgtacataataatacattttctatagatattaactccatagaaaatatgttaatgaatcagaatctagattttcgcttgtttctctttcctgtgcaataaaaggatcacaaattcaaatgcctacatgtgtgaagggcacatgtaagacaatagggagcagtacggactacggtaaacaggagaatgcaatcccctctaaaggcattcaaattaaaataataaataagaactttgaaattcttcatagaccaaatttactccacagttttcaaattctacatatagtccagtgaaaactatattttgtcctgcttgtttagaatcataacattttctctctgggtaaccctgtgccttcctcacattgtagatacagtagcagattggcagatctctctttcctttgtgcaccaaatctgtgcacaagactgtagaatcaaaatgggacttggagttctggtttacctaccctctgccccatccacaggggtgctgagcagtggcctgggggtggtggtggcctcagatgaggtagtggcaggcagatcatcagcccacgttggctctggagccttatcatcttcatcctggtctctggtgacactcaactacacaaaaatattcacattttgtgtttctgataatatcaagtaaaaaaaatactagtttgcttttgggaacatataaagactagttcagccatgctgtgtttccctagctctctgatactaactatttcaaataaaactcaggaaataatgcccctcctctgtgtcatgcatccctcaatacccaagttgtggattttcccaccacttggtgtgggtgtatttctgtgtacacacacatatacacacatacacacacacacgcagcccacctccaggcacagatttttgggtgctgggacatccaaagcagatgtgaaagatgcaaagttgagaggagtttattttcattcttagccactgctatgagaaaataaccactcatttctttaacatttttatggcctttctccatttcctaacactagacgtcttaacaatatattccaaaatatttaccatgaactcagtcaattttgagattgggaattagggtagcagaagacaataatacagctgaaataaaaacaatagtggccactttttgattgcttacccaaatctcagctgcagacacctttgcctgctctattatcagaccccagctaataccaaatgctgtaggatgcttaacatataagatgctctaagaaatgtttgatatctaaagaacaaaggatttttgtttcaaaagcaaattttctggactaaaatttccaagtttcatccaaatttatgatatataacgaaacaagaaaggcattttactttttttttaaaaatagtgcctttatagtagaatgatttataatccttgggtatagacccagtaatgggactgctgggtcaaatggtatttctggttctagatccttgaggaattgccacactgtcttccacaatggttgaactaatttacactcccaccaactgtttaaaagtgttcctatttctccacatcctctccagcatctattgtttcctgactttttaatgatcgccattctaactggcatgaaatggtatctcattgtggttttgatctacatttctctaatgaccagtgatgataagcgttttttcatgtttgttggctgcataaatgtcttcttttgagaagtatctgttcatatccttcgcccattttttgatagagttttttcttgtaaatttgtttaagttctagtataaagacacacgcacacatatgtttattgcagcactactcacaatagcaaagacttgaaccaacccaaatgctcatcaatgatagactggataaagaaaatgtggcacatatacaccatggaatactatgcagccataaaaacatgagttcatgtcctttgcagggacatgggtgaagctagaaaccatcattcttagcaaactaacacaggaacagaaaaccaaacaccacatgttctcattcgtaagtgggagttgaacaatgaaaacacatggacacagggaggggaacatcacacaatggggcctgtctgtgggtgggggcctagggcaaggaaagcattaggagaaatacctaaagtagattacaggttgatgggtgcagcaaaccaccatggcacgtgtatacctatgtaacaaacctgcacattctgcacatgtatcccagaacttaaagtataataataaaaaatcatgtcagtcattcttgacaattaccaggagctagacaaatcttttatgggaataattatattcttttgcaaatttttccttggattccagctgtatgcaattgaatcagtcattcacctgagtcctgacacttggttatttatccttgcaagagtttctcttatttgtttgtttgcatttttatttatttaaatagtcaaatctgtgactgagatagttttttatgcttttttacccagggatcctggtatgctgtcatcattaactgccgtctgccagctaagctgttctattgcttttgattttttttgtgtgtgcatgcatacatacacacacaagagggaaaaagtaattagtactattactcatgtatgcgtattttttacagtgattaaattactatcaggtgacttagagcaaagatttttccatttggattggtcattagccctatataaagggcacacaattcaaatacaataggaaattttcactgtcccctaaacacaacttttggtacaagtggagacaaaactgtggattacttgag

SEQ ID NO: 35 - DNA, 1193797 bp, Homo sapiens
tattctgttggcagaaatatcagaccagtgaatggagtaaccaatcttagtggatttagagcccagagacactgtgtcagtcagaggtcacctttactgtgagggtacatctttctcctgcagttaaaattgtccttgacttccgtttcctcctgagatcacttgtgaaggagcttcaaaaaatctggttttttggtttgtttgtttgtttgtttttttgagacaggttctcactctatcgcccaggctggggtgcggtggtgcgatcttggctcactgcaacctctgcctcccaagctcaagtgatcctcctgcctcagcctcctgagtggctaagatcacaggtgtgcatcaccatgcccagctcattctttgcatttttggtagagatagggtttctccatgttggccaggctggtctcaaacttgtaagaaaaagccatcatgcaagtaataccacgatttgataaagtgtggtggcaggtgcacaggtattattttgctcagtattctcctaatgtttgaaatactttatgatttaaaaataatttaagggacaggtgcagtgacttacacccgtaatcttagcactttgggaggctaaggcaggcaagtcgcttgagcccgggggttggaaaccagcctgggcgacatagtgagaccccatctctacaaaaaaaagaaaaaagaagaaagaaatgaaaaaaacttagctgggcttggtggcacgcacctgtagtccaagctactcaggaggctgaggtgggaggatcacctgagcctggggaggtggaggctgcagtgagccatgattgctcccctgtatgccagcctgggcaacacaccgagaccctgtctcaaaaacataacaatttaaggtgaatagatttacagtcattgtagagcccctaggaaaacaatgtcaaaatctataccccccgccaaaaacaagttgactttttcaaacccgtgaaaacgtatgcaaatgaagtctttccagtgaataaattaacaggccatgtggaaaccgtcctggtgattccaatttcatctctcttcttaagtgtttgcaaagtaacctcataccttaacatgagcagaagagatagaagataggtttttgcttgcaattggattcctgagtacccattccataaacttaaactgcagtcatgacagagaattaactacatagcttggaaacctatacaaataggcaagtatttcctatcatcactgttttgctatcctttgcttatgagctagaaagaattactttgtaaatactgctactaagtctttactaagtactgctacttagtaaataactacttagaaaatactaaagcatttactgagtatcagtacttagcaaatgactacctacagaatactaaaacatttacttaatagccatacttagcaaatggctacttacataaaatgaaagtatttactgtgtagcagtacttagcaaatgactacttacaaaatgctaacatatttactgagtagcagtacttagcaaataactattataaaatactaattaattacagattttgtgcaattatgtagtagtgctaaatattaaaatacttagtatttttaaaatactaaagtatttacaaattactaaagtatttactaattagtagcatttacaaaaaagtattttcagattggagtgtatggcatgatcatggctcactgtggcctcaacttccaggatcaagggatcctcccacctcagcctcccaagtagctgggaccacaggtacatcctaacacacccagctaatttttaagttttttttgtagagacacggtctccctaggttgtccagactggtcttttgaaaattttaattttaatttttttccttcattttctctagttaccatgctgcattttattttatttctcacagttggtgtacacactgtgacattattcataatagtccagtgggatgttactcctcaggtcacagggggttaataccctgggacagtaatcctcatattccagggcggtgatactcctaaagtcacagggtgtgtaccccgtgatattattcgtcctattctagggggacattactcctaatgtcacagagatgtacaccctgtgatattattcatagtatgccagagggatattagtactaatgtcacaatgcatgtacaccttgtgatattattcataatatcctaatgtcacagggggtgtgttccctgtgatattattcctaacatcctagacggatattgctcctaacatcacagggtgtgtacaccttgtcatatcactcataatatcctaaaactatgttattcctcacttcacagggggtgttcgccccgtgatattactcgtaatagttttgtgggatgttactcctaatgtcacacggggtgtacacagagtcacacagtgctatgacctgtaatattctatagaaatgttactcataaatcacaggggctgtacctcctgcgatattatttgtcatgttctaggggaatgttactactattgtcacagggggtgtacagcctgtgatattactcatcatatcctagtgggatgttactaccaatgtcacaatgcgtgtacaacctgtgatatgatttgtcatatcctaaagagatgttactactaaggtcacaatgcttctacaccctctgatattattcgctatatcctcgggggatgtcactcctaatgtcacacggggtgtactccctgtgatattattcatcatatcctagggggatgttacttttaatgtcaccgggggtgtgtatcgtgcctattcaatgcctgtgatactattcctaatatcctaggggcatgttcctcctaatgtcacatggggtgtacaacatgtgtgtacacctgctgtgatactattcataatatcttaggggaattttattcctgatggcacaggtggtgtacaccatgtgtgtataccgcctgtctcattattcataatatcctagggggatgtttcttttaatgtcacaaagggtgcacaaaatgtcacagaaggtgttcaccttgtgatgttatctgtaataccctagaaggatgttactcccaatatgtcacagggttgtacaccctttgatattacttgtaatcacatagagagatattacttcaactatcaccatggatgtacacacatggtgcataccccgtgatatgactcgtaatatcctagggagatacgactcctgatatcacagtgcgtgtaccccgggtgtgtacacccttgatattagtcgtaatatccagggtaaagattactcctcatatcacacagtgtgcacaccctgtgatatttttcatcctactttagggagatattgcttctagtgtcacagcgggtgtaccccttgtgtgtgtactctgtgacggtattttttatatcctagggaggtattactcgtaatgtcacagtgggtgttcaccctgtgatatcattcttatttgaccttgctgcctttttgaacccacactacaaaaggaatggaacagataagaagatattgagattagactgtgctgccgtgtggccgccgcaggacacctttaacatccctgtttctcaggctgtagacgaaggggttcagcatgggggtgacaaccgcgtacatcactgaggccactgcaccctttctgggggaaaatgacacatccgaactgaggtaccctccaacgcctgttccataaactcagcaaacaactgacaggtgagacccacaggtggagagggctttatacctcccacctgacgatgaaaccctcagaatggaggaaacaattttagagtaagagaaaagggtccccgagatgggaagaaaaccaaatatggcggcagggaaatacatgattatgttaatggtgaaggtgtcacaacatgcaagatgggggagttgagaagggtcacagaagaaattaggaatttccacatccttgaagcaggtcacttgtaaggcaatcaagttgtgcagctgggcatctaaaagactgagaaaaaaaaagacaacaaaactaggaagccacagaaacacgggttcatgatggctgaatgatatagagggtgacagatggctacaaaccagtcataggccatcacactcaggagcatgcctctcttccatgcctccaaaaatgacaaagagagacatctgagtcaggcagcctgcataggagatgactctgctgtgagattggatgtccacaatcatcttggggactgtggtggaggtgaaactgatgtcaggcaaggacaggttggagaggaagaagtacacgggggtgtggaggtgggagtcagggctgatggccaggatgatgagcaggttccccagcaccatgaccaggcagatggacaggaacagcccagcgaggaccagctgcagttctggatcccctgagagttctaggagaaggaatagagagacatctgttagattctgtggctctgcatagtttggataccttttgcctagaaaagagggttgcaaaatgggaaacaagtaaaccaacacccggcattgattgtgtctgcattttgaatagaagcaattcacaagtcatgttttcagatttcagagcaatccacactcagcaatattttgcagttctgataaactcaattgtcttctagtgctttcatcattgatttctgtgttattcacttcttgctgtacacacctgccttagagacaatagattcaagaatgttccaagaaccagatcatcatatataacaaattcataattgctagaaaatacagcctatcttgtctgaaggaaaatatgtaataaaaccattctcttcactttaagaaaaaagttatcctaattaaaggaaactaagaactcaaatattttatttcatactactagatggatacaaattcccttgatttagaacatttataaacactgtagaacagctgagaccgggccaggcgcagtggctcatgcctgtaatcccagcactctgggaggctgaggcgggtggctcacctgaggtcaggagttcgagaccagcctcaacatggggaaaccctgtctctactaaaaacacaaaattagccaggcgtagtggtgcatgcctataatctcagctactcgggaggctgaggcaggagaattgcttgaacctgggaggcggaggttgcggtgagccgagatcaagccattgcactccagcctgggctacaagagcgaaactccgtctcaaaaaaaaaaaaataaaaaaataaaaaaaacagctgagaccatgtcatctggaaatgaaatgaaagttgatagttcataagcagaaaatagttccacatgccggttaggtcctagtgatttcatcattatgtgttctgacttttctccttcaagagagtaattgcttcctcaaatcggtgggtcttctttgaaaattcacgtaagctctaactcctgtccttagcttaggtggacttagaattttcatcagaaagtttggccggacgcagtggctcactcctgtaatcccagcactttgggaggccgaggagggtggatcacggggtcaggagatcaagaccatcctggccaacatggtgaaaccccgcctctactaaaaatacaaaaacttcgcccggtatggcggcgcgggcctgtagtcccagctactcgggaggctgaggcgggagaatggcttgaacctgggaggcagaggctacggtgagccgaggtcacaccactgcctccagcctgggcaacaggagcaaaactccgtctcaaaaaacaaaaaaccaaaagaatcaagtaagtcgaagtcacactgatgacagccaatttttgtgaaccaaggaagtatcaattcaataattcacatagatgttgacttttgctgtctcctatgtgccaagcaagatatcggctctggggcatcagaaacaaaagatactcacttgttcctctcacaatactcagtacttactgagataaggacaaaagtaaatgtcctgtctggaatgcagagaaaccagaacttcaggtcaggggatatttccgttgaattgtatggagttgaagctgaaaatattcacggatgtacctaaaattcactttgccttgactttacgcatccatcacatagagatcacgcagcgggcacccacgatcggtttcatcatcgctcacttccattggatcaactagaaatcagctcagatgagagtgctgagtctcagaggatgggcctctcaccccttgccatacagaggagtagaaaaggtggtattccaaattcatggccagactctaagtcccgggtactatacttcatggtcttccaactttcaaaaagttgtggttttggttttggttttgtttttgcttttttgagacggagtctcattccgttgtccaggctggagtgcagtggagtgatctcggctcactgcaacctccgcatcccaggttcaagctattctcctgcctcagcctgctgagtagctgagatgacaggcgcccaccactacaccaggctcattgttttctatttttagtagagacggggtttcaccatgttgtccaggctggtctccaacacctgaccttgtgattcacctgcctcagcctcccagagtgctgggattacaggcgtgagccacagcgcccagcttccaaaagttttcaacagagctcagaggtcttaaccacaggcacatctgaggagcattcacaagcaattcacaaggaacatcttcacacttgctgaccatacaccgccagcagtgtttctcagttgtgtcaattccaaaaatctcagaattattacgtgatttacttttttgctatacaaggctttctgtacatactactttagagaaaatccactgaagaatattagaagaccaaaacgtcatatataagaaatccatgatctcagtaaaatacggcctgctcttttcagaaaaaatagaatgcaatgaaaatgttcttctctcttgaagagaaagatctcagtctaattgaaagaaattaagaagccgtgaaatacactctattttattctgacaccgtgctacaaattcctttgatgtagaatacgtaaaaggacgatacaagagctaggaccgcattatctaaaaatgaaatcgaaacttagagttcttcatcggaagaccttttcacatgccacttacttttcgtatttattatcatccttaggttttctgacatcatttcttcataaaagtacatgcacactcaaatatgggagctgtgtttccaaatgaattgaatctataactctcggccgagcgccatggtgcacccctgtaatcccagcactttgggcggccgaggctgatggatcacctgaggtcaggagttccagaccagcctggccaacgtggtgaaaccccgtctccagtgaaaatataaaaatattagccgggcgtggtggcggctaaccctagctactcgggaggctgaagcaggagaatcccttagaacctggaaggcagggattggacaccctgtgataggatttttgatatcctagggagatactgctcctgacagcagagtgggcgtacaccctgtgatattatttgtaatatcctagaaagatattgcccctaatatcacagtggctgtacaccctgtgatcttaattgtaatatcctacagagatattactcctaataatacagtgggtgtacacgctgtgatattattcataatatattatggagatacgactcctgatatcacagtgagtgtacaccatgtttgtacaccctgtgatcttatttgtaacaacttagaaaaatattaccgctaatatcgaagtgggtgaacaccctgtgatgttatttgttatctactaggtagatattactcctaatatcacagtgtgtgtacaccatgtgtgtacagacagtgaaattattcgtaataccttaggaagatattactcctaatatcacaatgggtgtacacgctgtgatattattggtgatcccctagggtgatacgattcctaatattacagtgggtgtacactctgtgaggttatttgtaatgtcctaggaagatatgactcctaatatcaaagtggatgtacaccatgtgtgtacactctgtgatctaattcatattatcccagagagagatttctcctgatatcacagtgggtgtacactctgtgatattatttgtactatcctagagagatattgctcccagtatcacagtgggtgtacaccctgtgatatgattcataatatcctagagagatattacctctaatatcacagtttctgtacaccctgtggtattattcatcatatcccagggagatattatccctaacatcacagtgcgtgtacagcatgggtggacaccctgtgatgttattggtaatatccaatggggatattacccttaatgtcacagtgggtgtacagcatgtgtgtacgcactgagatgttactcgtaacatcctagggagaaattacacctagtgttacagtgggtgtaaaccgtgtgtttctattctgtgatgctattggtaatatctgagaaagttattagtcctagtgccacagtgggtgtataccatgtgtgtccactctgtgatgttaatcgtattatcctagggagatagttcttataacatcactgtgggtgtacatcatgtatgtactccctgtggtcttattggttatgtcctgggttgatatgacacctaatatcaccatgggcgcacaccataggtgtacattctgtgatgttattcgtaatatcctagggagatatcacttcttatgtcatagtgggtgtacagccttgtgatattcctggtagtatccttgggatgtattactcctgttatcacagtgggtgtacaccctgtgatagtatttgtaatatcctagcgacgtatcactgtataccctgtggtattctttgtgacatttgagggagctatttctcctaaagtcagagtgggtgtacaccctgtaatattcttcctgatatcacagtgggtgtacaccgtgagtgatttttttttctaatatccagcgggggagaggatgatattgcttctaatatcatggaaggtatacacccccttgtgatattgttcctagtatccagggaaggagaggatgacattattcccaatagcactgggggtgtaccacctcccgccgggatattgttcttaatatccggaggtggagagaatgatgttactcccaatatcccagggggtgtacaacacacctgtttgtagacaccccctttgatattgttccaaatggcctgtgaaagagtcaatattactcccattatcgcagggggtgttcagccctgatgatattgttttctaacatccagggaaggagagtatgatattactcccaatatcgcagggcttgtatacctttttgtgttattgggcccaatatcctggaaaatagaggatgatagtactcccaatatggaaataattgtgcagcacccctgtgatattcttcctaatatccagaaaggaaaagaatgatattattaccaacagcgtaggaaatgtacacccgcgctgtgatatctttccccatatccaggtgcggagaggatcatattacttccaatatcgcagggtgtgtacaccccctctgtgatctcgttggtaacatccaggtttggggaggatgacatgactcccaatatcgcagggggagtcccccccatgaccttgttagtcatttcctgggtggagaggatgatcttactcccaatatcgcagggggtgtacacacccctgtgaaaatcttcctcatatccagagggagagaggatgatattactcccagtaccgcagggggtttccacagcccagtgatactcttcctaatatccacagggagagaggatgatatgactcccaatatcgcagggggtgtacacaaccctgtgatattgttcctcatatccagagcgaaagaggatgatatgactctcaatttcgcagggtgtgtacacccctcccgtgctattgttctgaataccctgggagggagaggataaggtgacattgaatatcgcagggaatgtacaccctccccctctgatacccttcctagtatccaggggaagagaggataattgtactcccaatatcgcagaggcagtacaccccgcctgtgatattgttcccaatatacaaggggggataggatgatactactcccaatatcgcaggggtgttcacatccccggtgacatttttcctaatatctaggggagagacaattacatgacagcaaatgtcgcagggtctgtacatcccttcctgatattgttcctaatatccaggggggaagaggatgatatcgaatatgaaagggtgtatacaacccccacccctaagatattgttcttaatattcttgaggggagacgatgatatgactccaaatatcgcaagggttgttcacaccccactgtgatatcctttctaatatccagtgggggagaaaataacataacttccaatattgcaggtggtgcataccccacctgaaatattgcattaaatatccaaagagggagaggatagtattcataccaatatctaagtgtgtgtacacgccccttgtgacatggtttttaatatccagggggcgggaggatgatattagtcccaacgtcacagaaggagtacactacccctgtgatattgtccctaacttccagaggggagaggatgagatcactcccaatatctcagaagttgtacatcccccgtgatattgttcatcatatccagggaggcacaggatgacattccattgaatttcatgacaggcatacacgcacagtgtgatattgttcctaatacccaagaaggcagaggatgacattaatcccaataaagcagtgtgtgtacattacccctgtgttattgcctctaatatccgggaccgggggatgggggagaggataacattccctcaaatgtagcaggtggtttgatgcccctcgtggtgttgttttacatatccagtggggaagacaataatattatttttgatagtccgattcatcctctccacctttctggaactctgaggccgggaggcggcatgcactttccgtgtgatccccaatacctttgccgtcttctgtagcaagtcagccacaaccgcaggcccgttatctgagccaatccggaagggctgtcccaatctacgaatcagatctcgaagaagcacatgggttacttcacgagctttctcagttcgtgttagataagcctccacccacccagagtaggtacgcccaagaactagtgaatacttgttacctccacactttggcatctctgtgaagtctacctggagatcttcaaagggggctgctccataagcttgtatgccgggtggaacagctggacctggcctcgcatcatgctgtcggcagctgacacatcgctgcctcaccgttttggcaagggctgacaaaggcgagatggagaaataccagcctaacaactttttgcagtgactcctgacctagatgggtggtttcttgcacagccagtacaactgcagctcctggcagctgtggcacagctactctcccatccggtaaccaaatccatccttcctccatcacttgtccttccctctacctggacaaagtccttttctcctttagaataagcaggtccaagatcaggtgcttgagggagcagaggagctgtgactgatgcctggaaaggggcagatgctgcttttcgagcctctgagtcagcgcgggaattccccaagcccaccaaggtggaagctcgctggtgccccctgcaatgcataactgccaccttgtggggtttccatactgcttctaatacatggaagatttctggttgatattttctgccttttcccccagagttcaataggcccttttctttctagcatgctccatgcacttaaagggttaaaaaggcataccgagaatcagtgtaaatgttgacagtctcaccctcactgagctctaaggcccgaatgaaagcaatgagttcagctttctgggctgaagtggcctggggcaatgatctggcttcaacaacagtgtccagggttaccactgcataccctgcacctctctttccttgggtgttgaccaagctgctcccatgcacgtatagttcccagtctactgatgcccaaggctggtcccggatgtcaggtctgctagggtcaactgagtccaacacttctacacagtcatgctcgacagggctctctgatagcgggagcaaggtggcggggtgtagggtgttacaaacttcaatggttatacggggattttcacagagcaaactttggtacttggtgagtctggcattcgttagccagtgatgtcctttagtattcattaaagtcaccacagcatggggggcctttctgttcaggttctgcccaagagtcagcttctttgcttcttgtactagcagagcagttgctgccaaggccctcaaacacaggggccatcctttagaatccccgtctagttgtttggagaggtaggccaccggcctcggccagggccccacagtttgggttcaaagtccggctgccatcttttccctctctctgacacataggatgtaaaaggctttgtcagatcgggtagccccagggctggggctgacataagtttctcctttaactcatgaaagacttgctgttgttgggatccccattcaaaatgttcccagtcccccccccctgccccttggtgacctcatacaaaagcttggctaatactgcaaagtttgggatccgcagtctacaaaaccccacagctcctaagaattctctcacctgccttctgctcttaggctgggctagattgcaaatgacctgctttctttctgatcccgggctgcattccccctgtcggatagtaaatcccaaggaacgtacctgctgtcggcagatctgagctttcttcttggacagcttacacccacagtcctccaggtgtcggcatagggcaatccattcccttggcgcatccgactgccgtggggtgtcccagcaaaagctcatcaacctagcggagcaacgcgcagcctaggtctctggtgggaaacttctggaggtctcgagcccacgcctccccgaagatggtgggggagttcttgaacccttggggaagcccggtccaagtgtactgagtagtgacacctgactccggatcttcccactgaaaggcaaacagcttctggctctcaggggctaatctgataggaaagaaagcgtctctcgggtccaagcaggtgaaccagctgtcctcagctggcagcaaccccaacaatgtggacgggctaggtactgttgaatggaaagtcagggtagcttgactaagcaagcgcgaatcctatcccggcctgtagtcctaggcccatggcttgggaacaggcaggaggggagtattccatggagactgacagggaactatcattccgaaagttcttaggtgcttaagatggacctggataccttgaagagcttctctggggaccgggtcctgtttttgcttaagcggctgggccccagtcttaactggccaaccctggagggttgtcttctgcctgtactcttggccaccgcttagccagagctggtcttctcttggcccggctcagttcagaaaagtctccattcctcctctcgggggaccgtaagggtcataatgactcccgtggcgggtcactttagcagcaaagagctgtgttctgtcaaagagagagcagctctcagcttgctaagctagtcccttcccaaaaagggcaagggacagtcaggcatgtacaaaaactgatgaatcacttgatgtcctcctacagtgcacatcccaggcaagtagaaagcttgctttgctgaaacccccatggctccagtgaggtcaagagtctttctggataagggggcgaccggggtggttactagcgaatgttcagcaccgctatctacaagaaaatcaatgtctctaccctcgactgtcattctgaccagaggctctttggggacactggagcccggtctccctcagtccaataacccttctgccaggttgagccgggccccttcctccttgtccagggcctcctgctctgagtcaccttcttttcttttgagctgagggcatttgttcttccactgtcctatttctttacaataagcacactggtcacgctgcaaactctgacacccaagctgagtttctttcccaaggccccccttcccttgcttctttggggggacagctctgattgctgcagctaacaaacaggtcggcgtttcgccgggcctgaccttcattctctttgggctttccctcgcggcttactgcatccctgtttacaaacacctgcttagctatttctcatcaatgtgatgtattcatccctgcaagcccagcctgcttctgcagttttcttctaacgtcttccgcgctttgatggactaaagccatgtgaatcatgcgctgattttcagggttatcgtgatcaaggggagtatacataccataggcctcacacagtctctggtagaattgcgctggactttctacttttccctgaatgacctcagagaccttgttaacgtttgtggccctctgagctcccctcttgaatccttccaagagagcttccctgtctcggtttagcctttgcatctcctctctttcatgtgggtccaactgggggtgggttcctggtaactgggtgcttccatactcttgggggttttgataatcagctggtgcatgttcctctagccacttagttgctgcgtgaagccctctccgccttttgcctttcatctctcttaaagaggaacatgagcaaccggtggcgatcggcccaggtggggttgtgggtctggataaccgtttggaggaaatcaattagggcttgtggcttttcgctctaggacggggtattgttttcccagttgagaaggtcggcagaggtgaagggctggtacacaaaaacacgcctctccaccacgtgaccatcctcctctctcccagtatgccgctgctctctcaggggcatttggatccccgttttgggtcgtaaaagagctgccgagggaggggtggaatggcgcaatgttacttaccgcaattaataatcttaattattaattgatactgataattatcaatattaataactgatcatataattctgaaaatcaataccgataatgataattcgtattaaagagttatactcacgataacaataaatgaatattaatgattaatgatgcatggtcttaaagagtgatattgatcttattcattagaaaactgtcatattagctcctaataattaacattaatattaataatctgaacactatttttaacaatgatttcttaatattaatattaatattggtaatacatattcatgttaataaaagaggaagaattaatatgaatattatccctaatacctcagtgggtgtacacccacctgtgatgttgttcctaatgtccagggagggagagagcatgatatgacgttcaatatcgcagtaggtgtacacccacccggtgatattgatccgaatatcatctccagggggtggcgtatgacgttactcccaagatagcagtgggtgtgcatccacccggtgatattcctcctaatattcccggaagaagagaatgctattactcccagtatctcaggaagtgtacaccccttctgtgacattgttcctaatatccggagggggagagggtgatattactcgcaatatcgcaggctgtgtgcacccaccctctgatattgttcctagcagccaggaagtgagaggacgatatgactccccatacagcaggaggtgtacacccatcctgggatattattcctaatatccacggaaaggagaggctgatatgactcccaatatcgcagggggtgtacatccagtctgtgatattgttcttaatattcaaaggtggagaggttgatattactcccaatatcacagaaagtgtacaagcccgtgtactattgttgctattatacagaagaagagaagatgatatcaccccctcatcgcaggaggtgtacacccactctgtgatattttttccaatgtgcagggcaggggaggataatactcttcttcatagcacagggtgtgtacagccccaccgtgatatgatccttaatattccaaggcggagaggatgatcttactcccaataccgcagaaagtgtacacaaccccagtgatatggttcccatgatccaggagagaagaggatgatgttactttcaatatcgcacggggtggacacgctccggtgatattgttcctaatttcaacgtgggagaggatgatactacacggaatgcccctagggataaaaacactcctgtgatattgttcttaatatcaaggggaaagaggatgctattactccaaagagcgcagaggatgtgcacccgtctgtgatatagttggtaatttccagaggtggagaagatattactgacaataacgtgaacacgctgtgtgaccaccgtggatcgtcatatccagggggggagagggggtgctgatatgactccccgcatcgcggggggcgcccgcccccctgcgacgtgaatcatcatatctagaggggggtgatatgactgcccgcatcgcgggggcctcatccccttgcgatgggggtcctaagagccagggggtgataggggctggctcttactccccgtaccccagggtggggccttacccccctgcaaaggggctcctaagagccagggggagagaggggctggctcttactccccgtatcgcaggaggtgggtacaacccctgcgatattgggagtaatgtcatcctctccgcatgaatataagaaacagtatcacaggaggatgtacaccccctgcgatattggaagtaacaacattttctccccctccggatattcggaacaatatcacagtgggtgtgtacagcccctgcgacattgccgctagtatcttcctctccctcccaggatagaaggaacaatgtcacaagggggtgtacactccctgcgatattggctgtaatatcttcctctcccccgctgccctttaggagcaatgttacacaaggggtgtacacccccggctatattgggagtgatatcatcctctccgtccctttatattaggaacaatatccctagggagtgtacacattctgcaatattcagactaatagcatcctctcgccgcctggatattaggatcaatatcacaaggatggtgtgcacccccggtgaaattggaagaaatatcatcatctccacctttggatgttagggacagtatctcggtggaggtctccaccccctgcgatattgggagtcatatccgctcccacccaggatattaggaacaagatgaccgaagggatgtacacccactgcgctattttcaataatgtcatcctctaccccccggctattaggagtaacatcatagaggggtgtacactttctgcgatatagggagtcatatcctctcccccacggatatcgggaacagttctattaattattaatattaataaatataataacaattaatagtaatcatcaatattaataattacagtagagacagtaaaacagtacagatgaaaaatattaacggttactattaataattaatagcaatatcactattaataataaaataatgatatcactaattaatgttacttcaatcaatcataagtgatgttggtaataaaacaataattaatattaagattaataactaatattaaaagtgacattaatcttaataattaattttaatcatgcataatcatatcttgaaaataatcattaatgattaataacgttatactgttaattaatattaccattgataattattaataagactgatgtttaataattcagaatattattactgctaataccacagggggtgtacacctacctgtgatattgttcctaatatccagggatggagagcatgatattagttttcatatcgcagtaggtgtacactcaccctgtgacaccgatcctaatacccagagggtagagtatgacatgactgccaacacagtaatcaatgtacagccacccggtgatatcgctcctaatattcacggaagaagcgtatgatattactcccaatatcgcagggagtgtacacctcttctgtgatgttcttcctagtatcccgagggggagagggtgataataattccagcatcgcaggctgtgttcacccagcctgtgaaattgttattaatatcctgaaagggagaggatgatattactccccataatagatagatatgactccccataatagagcaggaggtgtacacccaccctgtgatattcttcctaatattcggagaccgagaggttgatattactcccaatatcgcaggaagtatacacccccatgtgagatggtccttcataatattctaaggcggagggggtgatatgactacatatatggcagaaagtggacaccccccagggatattgttcccatgatcctggagggaagaggatgatattactttcaatatcacagaaggtggacacgcccccactgatattgtttctaattgcaacgtgggagaggaggatatgacacgcgatatccgagggagtggaaacacccctgtgatactcttcttaatattcagggaggaagaggatgatattactcccaatacagatgggtgtacaccctctgcacaccgagggtgtacacccgtctctgaaacagttcataatctccagagggggagatgatattgctcacaatatggtaaacaggctgtgagtccaccgcggatcctaaaaaccaggaggggggaagaggggctggcccttactccccgcatcgcggtgggcacctcacccccctgcgatgggggtcctaagagccgagggggagaggggctgttccctacattggggcactgaggtccctgttttcttgcaagctgccatcggggaccactctcggcttccaggggcctccttgtaggtggcaccatggccacttgccctactccaagcctgcagaagagcacctctctgccatgtccctttcttttaaaagacttgcctgactggttcaggtccattaggtagcgtcccacttgattagctcaaaagtactgtagcccatcacattcactcacaggagggcattagcggggtgtggacaccagggagtgagaatctctcaggccagtttagcattcagttggttagcgaggttcagtggctcacgcctgtactcccagcactttgggaggctgaggcgggcagatcacctgaggccaggagttcgagaccagcctggccaatatggtgaaacccagtctctactaaaaatacaaaaattagccaggcttggtggtgggcgcctgtaatctcagctacttggaagcctgaggcaggagaatcgcttgaacccgggaggtggaggttgcagtgagccgagatcgtgccattgcactccagcctgggcgatacagcgagtctcaaaaataaataaatgcgaaggctgccgagcgcagtggctcatgcttataatcctggcactttgggaggccgaggcaggaagactgcttaaggccaggagtttcagcctagcatggacaacacagtgcaactctatctctaagtaaaataaaataaaataaaataaaataaaataaaataaaataaaataaaataaaataagtaaaataagaattcagttggttaaaagaaactcactaggtccagcccacaatcaagggatggaaattacacaaagttgtgaagagtcaagggtgggagatcgctggcagcccttatagaagctgcctatctcacatacctgttggacagcttctctctcctagctgggggtatttggagcgggtgtcgaatcctgctcttttgtatgtctgttgccttttctcgcggtgatgtgtttcctttgcgttctgtaattttggatcatgagctgagcttcagaggggctttatgtggggaatcctgggtggccaggtttgagggagccacctagagaggttttctatttggcttttccaggggccccagggtaccagtaagcgaaggcacctgttttttttttgagacagagtttcactcttgttgcccaggctggagtgcagtggcgcaatctcaactcactgcaacttctgcctcccaggttcaagctattctcctgcctcagcctcccgagtagctgggattacaagcacacgaggcgtggctaattttttgtatttttagtggagatggggtttcaccatgttggccaggctggtctcgaactcctgacatcaggtgattcacctgcctcagcctcccgaagtgctgggattacaggcgtgagccaccacgcctggcccaaagcaactttttagtgttaatttctcaactctggcattcctagaccacacaggtagcatgacttcattgtaggagttccacatttatataagagaggcctgaaaacgcaacgatctcatgggaaacttgttcaccacctaaagctcaaattttctcacctctctctgttcccctgggtggaaatgtttctgtccctttctctaaaggtgttgcatttctgtggccccaacttcatcatgcttgactgtaaccctgaccccctgccttgtaagggcttccaacactcaacccagccctgccctcaggcagttgcagcaccagctcctctgtccccaccttggttctcactcccctcttcacttctggccttaggggacttaacttgttttctgaagaactcagctagatatttattttattttattttattttatttatatattttttgagatgcagtttcactcttttgcccaggctggagtgtaatggcgtgatcttggctcactgcaacttctgccttccgggttcaagcgattctcctgcttcagcctcctaagtagctgagattacaagcacctgccaccactcctggctgagttttgtatttttagtagagatggggtttcaccattggccaggctggtctcgaactcctggcctcaggtgatccgcccacctcagcctcccaatgttgtggaattacaggcgtgagccaccatgcccggcctcagctctatagttaaaaggacatttgtttcttacccagcattcctaggtgttttgaagagggagacttctcaggttatctaacctgctactgagaacttaaagatagggaaaatcttggactggagattcttggaatcacataattgaaaaatcccagccgggcgtgatggctcacgtctgtaatcccagcactttgggatgccgaggcaggtggatcacctgaggtcaggagtttgagaccagcttggccaacatggtgaaacttcgtctctactaaaaatacaaaaaaattagcctggcttggtggtgggcgcctgtaatccccgctactcgggaggctgaggtaggagaatcacttgaacccaggagacggaagctgcagtgagctgagatcacgccattgcactccagcttgggcaacaagagtgaaactccgttgcaaaaaaaaaaaataaataaagaaaagaaaaagaaaaatccccacagtgcagatcgacaaaatcacagagttgctttgggagcgagggtggcaatcagacacggaggccatgacacagcctactcgtccactcaggggtccagaacctccacccagtcaccttatccgggggtgatggagacaggggaggtgccacctacgccagtgtcatctcttacaatgagctcttctcctgctcgaaacgagccagcctgctgagcttgctgccagggcccgtcgcactgcctgcactgtgtttcccgtcgcacagcctgtgatgtgtgtttcccgtcacacggcctgtgatatgtgtttcctatcatgtgtgcacgtgcattgtcatgtagtgtctgtcacaggtgttacccgtcacgtgtgtttgcatgttgcatgtgcgtggcctatcaggtgtacatatgtgttgtttggcacatgtcagcatctgggcattctccgtgtgccaggagcagccaggtggcctgtgaaaccttctcatgggaaatgcccagatagaaagagcacagccaggagccaagaccctgagtggccactccatgtgcctggatcaccttcaagtctgctcaacatcagagcctctgttccttggcaccatggacattggaattgactcggaactgggaagagctgtaggcccactatccaggtacccgctccccgtttgcccagcatcccaggggcccacaaccttccaaatatcaccttgccctccattcagaggtgaatcatccgagcgtcaggttgcccaactccgactggtttgctggaggctgcctgtaggatgtcgccagccacctccagagaacactcagtccacagatgccgagggggaactggaagcacacagtgctggccttcacccagtttacggtggcacctcgggaccgcttctgagtctgcttgtcgctgaaggtcggcatgaggaaggcagcgttccctcccagatttagaaaatgtcaagtctcccgccgcacccttttgtgtttcttacagggtctggggcgcttgcagctgccacactaagggctccaacatgttccgtcacacactcaacagagaaggaacctatggctcagatgggagactccctatccaaggccacagagtctggccccagggaccactagaggcttcaagaaccaaactcacatgagggcagagaggagagatggggccagtttagggctgggagaatccatagagcgatgctgaagcgggcatggagcctggaggtacggacgagggtctcaccaaagtcaggggtagagaggctgtggggagtgaggaatggtgtgggccggccccgggcctgctggggtgcagctgggggctccatggccctcccacggccccgacttgtcctcacccaaccgttcagagctcttcatggcgggggtgtccctctcctctggccacaagaggagcgggtggaggaacggcaccttcaggccttgtagggggtctgcccctccaccagcctgtttctcttgggcatcgcagctgaggctgtagccaggaaagggtagtaaccgagcgtacctggcctccaaccactacttccaaggcccctactgggcacagggtgaccccaccgtggctcggaagtggaccctgtccgacgcgggggtggtcgctggagggccgaggatgcctacacaggcccctggagggtgtgccttcggagtctgtctcgccctctggacccatgggggaccagcaacgccgtcacaccctcctctgtctctgccagccgctcccccgctcccttctcctggctgaggctggcaaaggcaggcaggcatgggggggcggggcctcaggagggaggaggggctggtgggcggggcctacggacacctcgccccgcccccagtggggctccgcactccccacaccccgcggtccccctaggtcagggcctctcaccaccgcgcccagaggccgggccagccgggcgtgcatcccaggggcgctccgtcccccgcggcctgggactctccagtcaggacagtacaaaatctctttatcgctcattttctgtaaaaaatcgtggctctcggcggaccctggagataggaggtgcaaagggcgctcacacgcggcccgggtccgcggccgagagctggggggatctggagcggggccgggtcgcaagaagaccctgaccctgctccggcgctggggcgcgtgctaagggcccgcggggtatcagctgtattttcgaacccctgtgcttggccggggagttcccaaggctccactccgccttggagggggctgcggaagcccggaggtgacccgggctctgggaggggcgtccccaacgtgggggaagggagacaggggccttcgaagacagcgcgagactcggagggggtccccccgacctaagacgtggtaaactgaggccggcgaggagcgaggctgagtccggggaccaggcggcccctcactgctcctccggcccgtcgcccccctgcgcctgttcgtacgggcagggccggcggccgagtccagcgggctcggggccaggcctgggccccgggggcggcgcctcctcctccgcgccgtccccatgctcgccctccgcgtcgctctcgtccgagttgtcctcctccaagtagccgtcaccgcgcaccttgtgctggggccgcgggatgcggggctggcgcggggccacgccccgccgcagcttctgctccatccgcaggtaggagaccgcggccaccaccagcgtcaccagcagcaccgccagcttagcctgggcgtaaggagagggatgccagggacccgcggccgcctcgccccgcaccttctccgcctatacccctcgctgagataggcccttccctcctccgggagcctcccgggccacgcggccctcaatttctccagcccctccacccacgtttcctggaccgcctcctgcaggcgaggctcacatccagcactgtcccttacagtcgccatgcccctggcgacctcagtgtcccacgctgtaaggggacaatgcaaatccctttgcctcttagggtgcatgcgccagtgttgataaagtgctggccacaggccctgccttcccagggctcacaacactgtgtccctgacacacccgtgggctgtagtgatgcttttcatggggttttgactataacccgcagtcaggaatgatttcacaccatagctcagtacacacacacatatctgtatgcatacttcctgctcttttcttttttccagacacggttgctccgtttccccaccgcgccccctccctcccttcccccacccactgctggagcgcagtgccatgctcacttcagcctcaatcttccaggctcaagccatcctcccacctcagtctcacaagcagctggaactacaggcacgcgccaccacgcccagctaatttttaaatttcttgtagagacagggtctcctatgttgcccaggctggtcttgaacttctggcctcaagcaatcctcctgcctcagcctcccaaagtgttgggattacaggggtgagccaccatgcccagcccactcactgcttttcttttttctttttttttcttttttctttgggagacagagtctcgctctgtcctccaggctgaagtgcggtggcgcgatcttggctcactgcaatctccatcttccaggttcaagccattcttgtgcctcagcctccagagtagctgggatcacagggatgcgccaccatgcccagctaatttttgtttttagtagagacagggttttacagcctgttacccaggctggtctcgaactccagacctcaggtgatacccccacctcagcgtctcaaaatgctgggattacaggcatgagccactgctcccggcccactccctagtatttttagttctatttttatttttatttttttttttgagacgcagtttcgctcttgttgtttaggctggatggagtgccaaggccccgtctcggctaactgcaacatccgcctcccagttcaagcgattctcctgcctcagcctcccgagtagctgtggttagaggcacctgccatcatgcccggctaatttttgtatttttagtagagacgaggtttcaccatgtcggtcaggctggtctcaaactccctacctcaggcaatccactcgcctcggcctcgcaaagtgctgggattacaggcgtgagccactgcacccggcctttagttctatttttaaaaaatgtttagcaactgggacttcctagaccgagccaccatcttttgggagcagaacatgaggagcctgctccccttcaggccatgaagggagacagacccaacatctggagaacagggtaccaaacaacccacaggatggctgtgatgcacccacaaatcccctcagagatgggcaaactgagactggctggaggtgggccagtaagtggggtgctgagttgggggccacccagtgggctgcaggaatggggccttggcccagagactggctagggaaggggtggcgtttaggaagctgtgaagccagggcaggggctaaggaagtacctgtcattgggcatggggcccccaaccctgcccagtctcaccttcatgtgcaggctggagcccaggtacacggtgaagatggccacagcctgccaccagtggtagatggtgaagatgaagtcctgtctctccttgtcttcgtacaagattcccaggagtgctgcaagcaggcagtacagggcaggcaggggagaggtgtcacctggggcctggggctgccgagctaccatctatgaactttactaagccctgtatgtgtcccagcccgggaccagaaagcgcctagaaagtgctgtgagccggtcctggcctgccccctggtggagaccctggtcaccacactgctcacacgctaagcagaagtaggagcaggttcgccaggctgtgtggatgcaggtggtcccgctccacaccacatgcgtggcctcaaaagaagaaagctctgtgcttagtcatgttctgtccccaaccccaggtgtgcagtgccaagcttgcaggcgctgtttctcctcctcagccgggactagagagatccaactgtttgcagctgccaactctgcaaatcaaacctgaagctaagcatggagaggggggcttcctttccggtgagtcctcccagggtgggcaacaagagtaatggattgggagtcagaagatgcacactcgttctcaggactgtaacgttggttctgtgggtgatttgggtacttaactccccagagctgcttttcccaatggtgagatgagcctatgcctatagtgtgctgtgttctgaagttctaaagtgagaaagtgggcatggcacctgccaaatcataggggccactattaacaccttcaccaggcactcaggacatgaacactcctgtcttggggccctgcagggtgactttacccccacagtgctgctatgaagagacaaggatcccccagggttcacctgtggagatgggatatggagctgggcagaggggatgccatgaccagacagggcacaacatgggtccaagatacccaggttggactcggcccagaattggctatccttgggcaaaacggccaagagactgtggtgcagtatgaggctccagcccctgctacagacagagacaccgagccagcctctgccctgccagcagcaggcatgacctctgccactccacacccccaaggatgacgttcaaaactgttcacagcttccgcccatcagaacagacactgacatggatgccccgcaggactgtgcccgtgtgtgctagttgtgtgtcactgcgtgtgcccatctgtgggcagggagcatcctggagctgaacatgggcccacccactgccttctgcaaacagggccctgttccccaccagcccagacctggggcctggactgtggtactgagcagactgggttggggctgcaggcctgctcctctctatacaaaggcccatgtctgtatctatgccgtggatgtacaacaggccacttgctcctaccacatgctccgtgaggcagagaccaaaacatctgctccaagtgtcacgaaaacaatgtcagggtaagccctgtcccctggtatgaaaagggagaatccctgatgtgtttttcacactgtccgtaaggggtgtccacagagccccacacctgccccgtgtagccacgagatttcacactgaccctccagtgttgatggggccctgtgcccgccctggggtgttaacggaatgtccatggcgtggaaccccaacacctgtctccagagtgtccacgccctacccatctgtcccagtgtgtccatgagacttcccttccagccccggagtgtccacaggaagccccacctgcctctgccatgtccacaggaccctatgtgaccatgggaccccatatctgtccctgcgatgtctatgtctagccaaccacccacagatagccataaagccacctgccctgcccccccccagtgcccacagctatactcactgctgagtccagtcttgttcagggcgctgcccacaccccaaagggcggctgccacacagaggatccagctgtgttgcaggacctgaggcacaggggcccagaaaaagaggatgaaggtgagcagcaggtgcaccccttctccagccacgaggggcaccgggtgtggcagccacaggcccagcagaaccaggagtgaggcggctgaggcgcccaggctgtaagccacgaggaggtaagccagccactccagccccaccgagcacacaccataaccctgcggggggacaaggggtgagtgttgaagtctggaacagcccagaccccagtctcagccctccctgcatcgcggggggtgcctcacccccctgcgatgggggtcctaagagccagggggggaagaggggctggctcttactattcctgatggaatagtttagagggactcattccctgctatcgtgggtgagatgtctatgaaaaggacaaccagtgggggagggtagcaaaattttgaataagatttctgagacccccagcacaaccaggaacagaaactccacactctgctgagcggatagtttgcacattggtctcctcccatctgcccatctcactctcctgtttgtcctgaggaggaggaaacaaaacaaggctcccgaccgtccctcaacactcacttgaaagggtggcccgtccctccacacctgtgggtatttctagtcgggtgggatgagacactgagaaaagaaataagacacagagacaaagtatggagaaacaacagtgggcctagcggaccggcgctcagcataccaaggacctgcactggcacaggcctctgagttccctctgtttttattgattattatttttattattttagcaaaaaggaatgtagtaggagggcagggtgataataaggagaaggtcagcaacgaacatgtgagcaatagaatctatgtcataatgaagttcaagggaaggtactatgactggacgtgtacgtaagccagattgatgtttctctccacccaaacatctcagtgcagtaaagagtaacaaggcagcattgctgcaaatatgtctcacctcccaccatagggcggtttttccccatctcagaattgaacaaatgtacaatcgggttttataccgagacattcagttcccagggtcaggcaggagacagcggccttcctctccctcaactgcaagaggcttccctctttgactaatccacctcagcacagaccctttactggtgttggactcggggatggtcaggtctttctcctcccacgaggccacttttcagactatcacatggggagaaaccttggacaatatgccgctttcaagggcagggctccctgcggctttccacagtgtattgtgcccctggtttattgagactagagaatggcggtgacttttaccaagtatactgcttggaaacatcttgttaacaagacacgtcctgcacagccctagatcctttaaaccttgatttcatacaacacatgtttttgtgagcttcaggttgggtcaaagttgctggggcaaagctacacattaacaacatttcagcaaagcaattgttgaaagtacaggtctttctcaaaatggagtctcttatgtctttcctttctacatagacacagtaagagtctgatctctctttcttttccctacactcactgaactgcccttcccctctgctgggccatgaccacggagaacaggtccactgtcctccctgtgtggtgcaccatggaggctcagactccgtcctcaaggctggcaagaagacagggtgagacgtgagcctcctgatacaggtgacgggagtggagcccacaggactggaacctcacactgcagggctggagtcacagactatttactattctgtggcctcgggggctcaaggcacagagctccttattagccaaagccaccgaagttccccaagctctaaggattcctcatcatcatgcaagaagaagaagagaaaagtgagtgtccatagaagttttggggctcttcctctaatcaggagaaagctggtgtgtattcttcgcttctttcttttctttttagacatccaactgctttaattttcatcttttattatgggaaaatataccaagtataaatattaaaaattataaatatatattagttcatatagaatggccagtataaacatttacagtttccacgctttttcagtttacagtttcatgacattaagtacgttcagattgtttagcaagcatcaccgtcatcgtctccagaacagttttatctttcttttttattttttattatttatttattttttaattatactttaagttttaggatacatgtgcccattgtgcaggttagttacatatgtgtacatgtgccatgctggtgcactgcacccactaactcgtcatctagcattaggtatatctcccagtgctatccctcccccctccccccaccccacaacagtccccagagtgtgatattccgcttcctgtgtccgtattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcgcaagaacaaaaaaccaaacaccgcatattctcactcataggtgggaactgaacaatgagttttatctttcaaaatggaaattgcacccattcaccaagctctccactcctctctcttgcccgcccctgggggccacctttctagtttgcaactttatgagtttaactactctagacacttgatagataagtggaatcataccgtgtttaatttttttgttttggaaacagcgtctttctctgtcaccccggctggagtgcagtggcgtgatgtcgcctcactgcaaccgccacatcgtgggttcaagcgattcttctgtctcagtctcccgagtagctgggattacaggcatgcgccaccacgcccagctaatttttgtatttttaatagagaccatattggccaggctggtctcgaactcctgacctgaagtgatccgcctggctcagcctcccaaagtgctggggttacaggtgtgagccactgagcctgggcgtgtttatccttttgggatttatttatttcactgacgataatgttttcaaggttcatccatgttgcggccagcgtcagaagttcctctctgtttttttttttttgtttgttcgtttgactttgttttgttttgtgtttccatggagtctcactctgtcgcacaggctggagtgcagtggcacaatctgggctcactgcaacctccgcctcccgggttccagccattcttgtgcctcagcctcccgagtagttgggactataggcacacgccaccacgcttgtctcattttttgcattttcagtagagacagggtttcaccaacatgaccaggctggtcttgaattcctgacctcaggtgatccacccacctcggtcttccaagacgctgcgattacaggcatgagccaccgcaccggccagaagtgcctgcctttttaaggctgaatagtcttccattgtatgaaggaactgcagtgtgctttttcattcatttgtccacgaacccttgggttgcttccacattttggctgttgtgaataatgctgctatggatatgggtgtacacaaatctgtcttccactcctggcttctaattctttctggtaggtacccacaaatgcaactgcgggaacatctgatcattctgtttctaatttttccagtaaaagccatactattttccccattccttcacggttttacattccctccgatcatattcaagcattcctacttccctctagtctcaccaatgcttgtttgtttctcatatccatcctaatgtgtgatatcacattcttggtttgatttctgcttccctatgatgagtgattttgaacatcattttagatgcttattggccattgctgtatcttctttaggaacacgtctactcgagtcttctgatgggacgctttgggtttcttgttgtttagttctagctgttctttatatatgatggatatcagcctcttttcagatatatgctttgcaaatctttttcctaatccatgagttatcttttcactcaggtcacagtgttttttgctgcacaaaagtgtctgtcatttagatgcaattcaaggaatcaaattttcttttgttgcctatgcttttggtgtcatatcccagagaacattgcccagtctgatgtcatgaaagcatggccaatggtttcttttaggcgtatgatgcttttagcgcttggggtgaggtctttgatccagtttgtgttaatttttgcacctggtgtgacatagggtccaccttcattcttctgcatgtggaaatcaagtttctccaacaccatttcttgaaaaggctgcttttccaccaatgagctttcttagcactcatgtgaaaaatcatttgaacatataggtgagaagttatttctgggctccaaaacaaacaaacaacaacagacaacagataaggatacagcatgggccgggcgcggttgctcacgcctgtaatcccagccttctgggaggccgaggcgggcggatcacctgaggtcaggagttgaagaccagcctgaccgacagggagaaacccccgtctctactagaaatacaacattagctgggcatgctggggcatgcctgtaatcccagctactcgggaggtggaggcaggagaatcgcatgaaccaaggaggcagaggttgcggtgagccaagattgcaccatgacactccagcctgggcaacaagagtgaaactccatctcaaaacaaaaaacaaaaaacaaaaaaacagcatgatttcaagagcagaaagagaagagcttaaaaaccagcctaatgagaaagttaggaagcttcttaccaaagcatctggaaatatgcaaacgattcttgtgaactaaaattttcatattgtactatcaaacagtagaactcacttattccatctttctgtattttgggacccaattatccacttgtcttcattccctatcccaccccttttcttcctagcatctgctaaccacctttatactttccactttcctgagattccttttgtgtgtaggtgtgtgatggagtctctttctgttgcccaggttggagtacacaggcacaatccgggctcactgcaagctccgcctcccgagttcaagcgcttcttgggcttcagccctccgagtagctgagactacaggcacacgtcaccacacccaactcattgtttgtgttttcagtagagacggggtttcaccatgctggccaggcgggtctcgaactcctggactcaagtgatctgtgcaactcggcctcccagtgtgctgggattacaggcctgagccaccacacctggccaaggtttccttttttcttcctacatagaagtgaggacatgaaatatttgtcattctgtgcctggcttatttcatttaatatacagacctgcaatctcatccattttgtctgcagtggagaggagtttcttcctttttaggctgaataatacttcactgggtgtgtataccacagtttcttcattgaaacaaatttctgaagagcaaatattttaaagatgtcttggaatgtgaaacttcacggatactgtgcccattttattcttttctatttcccatcttatgtatatgcaagtgtataacaaagcagccatcaatgtgtgtataaatctgtaacttcaacaaatgtaaaatgtaaatgctaagtggtggctgggcgcggtcgctcatgcctgtaatcccagcactttgggaggcggaagcaggcggatcacctgaggtcaggagttcaagaccagcctgaacaaaatggagaaacactgtctctattaacaatacaaaaaaaaaaaaaaaaattagccaggcatggtagcgcatgcctgtaatcccagctacttggaaggctgagacaggagaattgcttgaatacgggaggcagaggttgcagtgagccgagaccgtgtctttgaactccagcctgggcaacaagagtgaaattctgactcaaaaaataaggaaaagaaagaaatagaaaatgcgaaatggtaagaaacaacagcataataaatatttgtatggtgttgctggacaatgcatttgaagataatatttgaagaaatcatattacaattaatttcttttcttactcattggagcttgatgcctctaaaaactttgtcattggaaccacctcttgtgctttaaaagaaaaaaaagaaatccacatactcacacaggtgcaaggaaatcagaatctcaggtattgagacccaggcctcatcatttgtaagctccccaggtgagttgactcaaagccaagactgaggaacggcgacatggatctctacacacaactttcctaaatagattctctagaagcagtttataaagaaattccacatgaactgtggaagaggatatgaatttgatgtacagtatgtcctcacgtaacatctttgaaagtctcttggaaacttcaccttgaagcaaaatgatgtacagtgaaaccacttattcctaatccacaatataactagacaactttgaacacaccagtggtgttggaggacctcctgtacattgtttccataaagtcagttttcagggaattccaaaacgaagtgaggacttcgtgtatataaaaagatggttgtgattccacctggatgacagggttattgctcagaaactaaaagaggccgcctaggtatagaggattctgtcgtgaggtttctgctaaacaaaggatcccagaatcctcacccattccagtgaaaggcataacgaagaaagcaatattcacaaaggaaatgcggaaaggaataaaagccatcaagccacaaaaagaatgtgactaaggggcaggatttgcagatgttgagatttaatgtggttgccctttctaacccacacaagaaaaaggatggaacagatcatgagattcgactgttctgctgagcagcctccgcagggcgctttgaatgtccctgtttctcaggctgtagatgaaagggttcagcatggggtgaccacagcgtacatcgctgacgccaccacaccattcctggggggtggtgccacagctgaagtcaggtacacgccaatgcctgttccatcaaatcagcaaacaactgctaggtgagagccgcaggtggcgaaggctttatacttcccatctgacgatgacatccttagaatggaggggacgattttatagtaagacaaaaggatccctgaaatgggaagaaaaccaaacatagtactatcgaaatatatgaatatgctattgatgacgctgtcagaacaggcaagtttgagaaattgagaggggtcacagacaaaattagagatttccacattcttgatgatggtgaattgtaacacaatccaactgtgcagctgggaatccaacaggctaaggaaaaaggacaccaaaatgaagaagacacagaggtgaagattcacgatgactgggtagtgcagagggcgacagatggctacaaagcagtcataggccatcgcactcagcagcatgccttctatacatgcaaaaaggaccaagaaagacatctgtgtcaggcagcccgcatgagagatgactctgctatgcgactgcatgtccacaatcatcttgggaaccgtggccgaggtgaaaccgatgtcagcccagcacagcttggagacgaagaagtacatgggggtgtggaggggggagtcagagctgaagccaggatgctgagcaggttcctcagcactgtgaccagatacatggacagggacagggacagcaaagcgaggaccggctgcagttctggatcctctgagagtcccaggaggaggaattctcagacacctgtgagattccgtggctctgtgtgtcttggacaccttgagaaggaaaaaggattggaaaagtaaaagataaaatccagcccttaatgctggatgcaagcaattcacaaggaacatcttcacacttgcggaccatacaccgccagcaatgtttctcagttgtgtcaattccaaaaatctcagaattattacgtgatttacttttttgctatacaaggctttctgtacatacgactttagagaaaatccactgaagaatattagaagaccaaaacgtcatatataacaaatccgtgatatccgtaaaatacggcctactcttttcagaaaaaatacaatgcaatgacaatgtccttctctctttaacaaaaacgtctcagtctaattgaaagaaattaagaagccatgaaatacaatcgactttattctgacaccgtgctacaacttccattgatgtagaatatgtaaaagaacgacacaagagctaggaccccattatctgaaaacgacgtcgaaccttatagttctcaatcggaagaccttttcacatgcctgttacttttcatattatcatccttcggttttctgacatcatttcttcataaaagtacatgcacactcaaagataggagctgtgtttccaaatgaattgaatctataactcttggcccagcaccatggctcacacctgtaatcccagcattttgggcggccgaggctgatggatcacctgaggtcaggatttccagaccagcctggccaacgtggtgagaccccgtctccagtgaaaataaaaaaaaatcagccgggcgtggtggcaggtaaccctaaatactcgggaggctgaagcaggagaatcccttagaacctggaaggcagacattggacaccctgtgataggatttttgatatcctagggagatattgctcctgacagcagagtgggcgtataccctgtgatattatttgtaatatcctagaaagatattgctcctaatatcacggtggctcaacaccctgtgatcttaattgtaatatcctacagagatattactcctaataatacagtggatgtacacccggtgatattattcataatatattacacagatatgactcctgatatcacagtgagtatacaccatatttgtacaccctgtgatcttatttgtaacaacttagaaaaatattacagctaatatcaaagtaggtgtacaccctgcgatgttatttgttatctactaggtagatattactcctaatatcacagtgagtgtacatcatgtgtgtacagactgtgaaattattcgtagtaccctaggaagatattactcctcatatcacagtgggtgtacactgtgatatttttttgtaatatccagcgggggagaggatgatattgcttccaatatcacagaaggtgtacacccccctgtgatattgttcctaatatccagggaaggagaggatgacattattcgcaatatcactgggggtgtaccacctcccgccgggatattgttcttaatatccggagttggagagaatgatattactcccaatatcacagggggtgtacaccacccctgtttgtaaacaccccctgtgatattgttccaaatggcctgtgaaagagcaaacatgactcccattatcgcggggggtgttcagcccttatgatattgttttctaacatccagggaaggagagtatgctattactcccaacatcgcaggggttgtacacccttttgtgtttttgtgcccaatatccaggaaaatagaggatgatattacgtccaatatcgaagtaattgtacagcacccctgtgatattcttcctaatatccaaaaaggaaaagaatgatattactcccaacagcgtaggaaacgtgtccccgcgctgtggtatctttcccagtatccaggtggggagaggatcatattacttccaatgtcgcagggtgtgtacaccccctctgtgatctcgttgctagcatccaggtttggggaggacgacattactcccaatatcgcagggggagtacacccccctgtgaccttgttagtcatttcctgggtggagaggatgatcttactcccaatatcgcaggaggtgtacacagccctgtgaaaatcttcctattttcagagggagagaggatggtattactcccagtaccgccgggggtttccacagccctgtgatcctcttcctaatatccacagggagagaggatgatattactcccaatatcgcaggggttgtacacccttttgtgtttttgtgtgcaatgtccaggaaaatagaggatgatattactcccaatgtcaaagtaattgtacagcacccctgtgatattcttcctaatatcccaaaaggaaaagaatgatattactcccaaaagggtagcaaatgtatacccgcgctgtggtatctttgccagtatccaggtggggagaggattatacgactcccaatatcacagggggggtacacaaccgtgtgatattgttcctaatatccagagcgaaagaggatgatacgactctcaatatcgcagagggtaaacacccctcctgtaatattgttctgaatacccagggagggagagaataaggttatgttgaatatcgcagggaatgtacaccatccgcctctgatacccttcctaatgtccaggggaaaagaggaaaatttcactcccaatatcacagaggcagtacaccccactggtgatgttgtttccaatatgcaacgggggagaggatgatactactctcaatatcgcagggctgttcacatccccagtgacattttttcctaatatctaagggagagacaattctatgacagcaagggtcacagggtctgtgcatcccttcctgatattgctcctaatacccagggggaaagaggatgatatcaaatatgaaagggggtgtacatcccccacccctacgatattgttcttaataatcgtgaggggagacgatgatattactccaaatatcgcaggggttgttcacaaccccctgtgatattgtttctgatatccaggggtggagaaactcatattacttccaatattgcaggtggtgtatgccccacctgatatatggcacagaatatccaaagagggagaggatggtattcataccaatatcgaagtgtgtgtacatgcctcttgtgatatggtttttaatatccagtgggcgggaggatgatattagtcccaacatcccagagggtgtacactacccttgtgatattgtccctaacttccagagggaagaggatgatgtcactcccaaaatctcagaagtggtacatcccctgtgatattgttcgtcatatccagggaggcgcaggatgacattccattgaatttcgcgacaggcgtacacgcacagtgtgatattgttcctaatatccaggaagggagaggatgatattactcccaataaagcagtgggcatacatcaccgctttgttattgtctctaatatccggggccgggggagggggggagaggataacattccctcaaatttagcaggtggtttgacgccccttgcggtgttgttttaaatatacagcggggaagacaatagtactatttttgatagtccaattcatccgctccacctttccggaatgctgaggccgggaggcggcatgcagttttcgtgtgatccccaatacctttgctgtcttctgtacgaaggcagccaaatacgcaggccccttgtctgagccaatccgtaagggcggccgaaatctaggaatcagatctcgaagaagcacaggggttacttcacgagctttctcagttagtgttggataagcctacacccacccagagtaggtgcgcccaagaactagtgaatacttgttacctccacactttggcatctctgtgaagtccagctggagaccttcaaagggggctgctccataagctcgtatgccgggcggaacggctggacgttgcctcgcgtcatgctgttggcaggtaacacaccactgcctcaccgttttggcaagggctgacaaaggcgagatggagaaataccagcctaacaacttttccagtgactcctgacctcgatggctggtttcttgcacagccagtacaactgcagctcctcgcagctgtggcacagctactctcccatctggtaaccgaattcatccttcctccatcacttgtccttccctctacctggacaaagtccttttcttctttagaataagtaggtccaagatcaggtgcttgagggagtactgatgcctggaagggggcagatgctgctttttgagcctctgagtcagcgcaggaattccccaaacccagcaaggtggaagctcgctggtgtcctctgcaatgcataactgccaccttgtggggtttccacactgcttctaatcattgcaagatttcttgttgatattttctgtcttttcccccagagttcaataggcccttttctttctatcacgctccatgcacttgaagggttcaaaaggcatacggagaatcagtgtaaatgttgacagtctcaccctcactgagttctaaggcccgaattaaagcaatgagttcagctttctgggctgaagtggcctggggcaaagatctggcttcaacaacagtgtccagggttatcactgcataccctgcacctctctctccttgggggttgaagaagctgctcccatccacgtatagttcccagtctactgatgcccaaggctggtcccagaggtcaggtctgctagaggcaactgagtccaacatttctacataatcaggctcgacagggctctgataccgggagcaacgtggcggggtgtagggtgttacaaacttcaatggttatatggggattttcacagagcaaagtctggtacttggtgagtgtggcattcgttagccaatgatgtcctttagtattcattaaagtcaccacagcacgggaggcctttctgttcaggttttgcccaagagtcagcttatttgcttcttgtactcgcagggcagttgctgccaaggccctccaacaggggggccatcctttagaatccccgtctagttgttgagagaggtaggcccccagccttggcctgggccccacagtttgggttcaaagtccagctgccatcttttctctctctgatgcatacaatggaaaaggctttgtcagatcgggtagccccagggctggggctgacataagtttttcctttaactcatgaaagccttgctgttgttgggatcctcattccaaaggttcccggtccccacccccttggtgacctcatacaaaggcttggctaatactgcaaagtttgggatccaccgtctacaaaaccccacagctcctaagaatcctctcacctgccttctgctcttaggttcccctagcttgcaaataacctgctttcattctgatcccaggctgcgttccgacccctgtaagatagtcaatcccaaggaacgtacctgctgtcggcagatctgagctttcttcttggacaccttctacccacagtcctccaggtgccggtgtagggcatcagttcccttggcacacccgactgccgtggggtgtcccagcagaagatcatcaacctactggagcaacacgcagcctaggtctctgctgggaaacttctggaggtctcgagcccacgcctccccgaagatggtgggggagttcttgaacccttggggaagcccggtccaagtgtactgagtagtgacacctgactccggatcttcccactgaaaggcaaacagcttctggctctcaggggctaatctgataggaaagaaagcgtctttcaggtccaagaaagtgaaccagctgtcctcagctggcagcaaccccaacaatgtggacgggttaggtactgttggatggaaagtcagtgtagcttgatgaagcaagcacaaatcctgtacctgccggtagtccttggtcggtggcttgggaacaggcaggaagggagtgttccatggagactgacaaggaacaataattccaaaagttcttaggtgcttgagacggacctggataccttgaagggcttctctggggactgggtcctgtttttgcctcaccggctgggccccagtcttaactggccaatcccggagggttgtcttctgcccgtgctcttggccaccttttagccagagctggtcttctctcttggcccggctcagttaagaaaagtctccattcctcctctggggggaccataagggtcataatgactccctttagcagcaaagagctgtgctctgtcaaagagatagtggctctcagcttgctgagcaagttccttcccaaaaaggtcaagggacagtcaggcatgtaccaaaactgatgaatgactctatgtcctcctacagtacaagcccgagacaagcagaaagcttgctttgctgaaaccctagtgggtccgatgacgtcaatagtctttttggataagggggcgaccggggcggttactagcaaatgttcagcaccgctatctataaaaaagtcaatgtatccacccccaactgtcattttgaccagaggctctttggggccgcttaagcccggtctccctcagtccaagaacccttctgccaggttgagcagggccccttcctccttgtccggggcctcctgctctgagtcaccttgttttcttttgagctcagggcatttgttcttccactgtcctatttctttacaataagcacactggttacgctgcaaactctgacagccaagctgagtttctttcccagggccccccttcccttgcctctttgagggggcccctctgattgctgcagctgacaaacaggtcggcgtgtcaccgggcctgacctccattctctttgccgttttccttagggcttactgcattcctgtttacaaacacctggctagctatttctagtaattgtggtggattcatccctgcaagcccagcctgcttctgcagttttcttctcatgtcttctgcgctttgacggactaaagccatgtgaatcacgcagtgattttcagggctatcgggatcaaagggagtatacatacgataggcctcacacagtctctcgtagaattgtgccggactttcttcttttccctgaatgacctcagagacgttgttaacgtttgtggccttctgagctcccctcaataatccttccaagaaagcttccctgtctcggtttagcctttgcatatcctctctttcacgtgggtccaactgggggtcggttcctggcaactgggtgcttccatactcttggtggttttgataatcagctggtgcatgttcctctagccacttagttgctgcttggaggactctccgcctttcttcgctgttaaagaggaacatgagcaactggtgccaatcagcccaggtgtggttgtgggtctggataacagcttggagcaaatcaattagggcttgcggcttttcggtataggtctgtgtattgtttttccagttgagaaggtcgacacaggtgaagggctggtacccaaaagcacgcctctccaccacgtgaccatcctcatctgtcccagtataccgctgctctctcaggggcatgtgtgtccccgttttgcgtcgcaaacgagctgccgagggaggggtggaatggcgcaatgcgacttaccacaattaataatctcaattattaattgacactaattttcaatattaataaccgataatataattttaaaaatcaataccgataataatgataattaatattaaatagatatactaatgataacaataaatgattaatattaatgattaatgatgcctgatattaataattgatattgaccttattaatgagaaaacagtcatattagcccctaataattaatattaatattaaaaatgggaagtttttattagcaattatttcttaatatgaatattaatatcggtcattcatattcatgttaataataaaagaggaataattcatactaatattacgccctaatacctcagtgggtgtacacccacatgtgatattgctcctaatgtccagggagggagagagcatgatattacgttgaatatcgcagtaggtgtacaaccagccggtgatattgatccgaatataatctccagggggtggagaatgacgttactcccaatatagcactgggtgtacatccacccggtgattttgctcctaatattcacggaagaagagaatgctattactcccaacatcgcaggaagtgtacacaccagtgtgagacggtccttaaaaatattccaaggcggaggaggtgatatgactacatatatggcagaaagtggacacccgcaaggatatcattcccatgatcctggaaagaagaggataatattactttcaataccacagaaggtggacacgcccccagtgatattgtttctaattgcaacctgggagaggaggacatgacacccgatatcccagggagaagaaacacccatgtgatactgttcctaatattaagggaggaagaggatgatatgactcaaaacacagaccggtgtacaacctctgcacacaaagggtgtacaccagtctgtgaaaaggctcagaatctccagagggggagatgatattacgcacaatatgataaaaagactgtgagtccaccgcggatcctaagagccaggggggcaagaggggctggctctttctttactccccgcatcgcggggggcgcctcgcccccctgcgatgggggtcctaagagccaggggggcaagaggcggttgctattactccccgcatcgcggggggcgccctcacccccctgcgatgtggctcgtaatattcagtggggagagcggttgatattactccctttctcctattatgttttctctactgccacgcttagttaacatcctgggacattattttccatcttctaggatggtgtcactgtttaagtcccaggggttatacaccctgtgatattattcgtggtattgtcgcgaaacatgaatccgtatttcacaagtctctacacactctgatatgattcgcaacaccctaacgatacgttaataataatgccacaatgtgtgttcagcgtgtgctattattcttaatctcctaaggggaggttgattttattgtcacacggagtattttccctgtggtatgattcggaatatcctggaagcatgtcactctttatgtcacagggtttgtgcaccttttcaaattactcgtattacccttataagatgtcactcctcatatcaacgagggtgtacactctgtgatattatcgtcatattctagggaaatgttacttttaatgtcacagatgttgcacaccttgtgaaattattcgttatagttttgtttgatatgactgctaacgtcacacggggtgtacatccagtgatattacgtgtaatcttctatagaaatgttactcgtaaatcacaggtcctgtacaccctttaatattcttcgtcttattctaggaaaacgtgactactaatgtcccagggcgtgtagaccctgtcataaaattcgtaatatcccagcgggagttcactactaatttcacaatgcgtgtacaccctttgatattgttcgtattatcctaaagagatgtgactactgatgtcccaatgcatgtacattctgtgatattattccttatatcctcgagggatgtgacttctaatgtcacacggcgtgtagtccctgtgttctatttcataatatcctagggcaattgtactgttaatgacacagggggtgtacacattgtgatattattcatgatattgtagaaggatgttactcctaacgtcacagggtgtacaccctgtgatagtattcaaaatttcccaggggtctatactcctaatgtcacagaagataacacactgtgacattatttgtaatattctggtgagatgattctcctaatatcacaggaagtgtataccctgtgatagtattcttactattccagggggatgtcacttgtaatgtcacaggtgtcttccttcctgatattattgaaaatatgctagctggatattactactaatgtcagaatgcgtgtaccccttgtgatattattagtaatattctggggggatgttacccctaacgttacaggggtgtacaccgtgtgatattgctcccaatattgtagggggatgttactcctaatgtcacagggggtgtacagcctttgatattatttgcaatcttatagagacatattactttaatgatcacagtgggtgtacacacatgggctacacccactgggatattatttgtaatatcttagggagatataactcctaatatcacagtgggtgtagcccatgtgtgtacatcctgtgatattatttgtaatatccatggtaaacattacttctagtatcccacagagggtacaccctgtgatatttttcatatcattgggagatatttcttctaataacacagtgggtgtacaccatgtgtgtacactctgtgatgtgatagcttatatcctagggagatattccttccaatatcagagtgagtgtacaccttgtgatatcattcgtaatctcctagaaagatgttgctgctaatatcacagagggtgtgcccccagtgacatcattcgaaatatcctaaggagatgttactcgtaatgtcacgggggttgtacaccctgttatattattgtaatattctagggtggtgttacttttaaagtcaaaggggtgtacaccctgtgatgttattcgtaatatcctaggaagaggttactcctaatatcacagcctgtgatagcattcagaatatccaaaagggatgttacttttaatgtcacatggggtatacaccctttgataatattcgtaagatcctacggacatatgacttcaaatatcacattggatgtacacacatggtgtacacattgtgtgtgaacacctcctgtgatattattcataatatcctaggaaaatgggactcctaatatcacggtcagtggacaccctgtgatatgattggtaatatcctaaagagatgttaccactaaggtcacaatgtctgtacgctccctgatattattcgttatatcctcgggggatgttactcctaatgtcacacggggtgtactccctgtgatgttattcgtaatatcctagggtgatgttactttcaatgtcaccgggggcatatatcatgtgtattcaacacctgtgatactattcctaataccctaggggcatgttcctcctaatgttcacatggggtgaacaccatatgtgtacacctgctgtgatattattcgtaatatcctaggggaatgttactgctgatggcacaggagatgtacaccatgtgtgtcaaccgcctgtgtcattattcgtaatatcctagggggatgtttccttgaatggcacaaagtgtgagcaaaaggtcacagaaggtgtacaccttgtgatgttatctgtaataccctagaaggatgttactcctaatatgtcacaggggtgtacacactttgatattatttgtaatctcatagagatatatgtcttcaaatatcacagtggatgttcacacatagtgtataccctctgatattattcgtaatatcccagggatatgcaactcctgatatcacagtgcgtgtacccggtgtgtgtacacccttgatatgagtcgtgatatccagggtaaatatgcctcctcatatcacacagtgtgcacaccctgtgatatttttaatcatactttagggagatattgcttctaatgtcacagtgggtgtaccccatgtgtgtgtactctgtgacagtatattctatatcctagggaggtattactcgtaatgtcacagtgggtgttcaccctgtgatatcattcttatttgaccttgctgccttttttaacccacactacaaaaggaatggaacagataagaagatattgagattagactgtgctgccgtgcggccgccgcaggacacttttcatatccctgtttctcaggctgtacatgaaggggttcagcatgggggtgaccaccgtgtacatcactgaggccactgcactctttctcggggaagatgacacatctgaaccgaggtaccctccaacgcctgttccataaaatcagcaaacaactgacaggtgagacccacaggtggagaaggtttatacttcccacctgatgatgaaaccctcagaatggaggaaagaattttacagtaagagaaaaggtccctgagatgggaagaaaaccaaatatggcagcagggaaatacatgttgatgttcctggtgaaggtgtcacaacatgcaagatgggggagttgagaaggttcccagaagaaattaggaatttccacatccttggagcaggtcatttgtaaggcaatcaagttgtgcaggtgggagtctagaagactgagaaaaacaaacaaacaaacaaacaaaaacaaagacaacaaatctaggaagccacagaatcacgggttcaagatggctgaacgatatagagggtgacagatggctacaaaccggtcatatgccatcacactcaggagcatgcctctcttccatgcttccaaaaatggcaaagagagacatctgagtcaggcagcccgcataggagaggactctgctgtgagactggatgtccacaatcatcttggggaccgtggtggaggtgaaaccgatgtcaggcaagggcaggttggagaggaagaagtacatggggatgtggaggtgggagtcagggctgatggccaggatgatgagcaggttccccagcactgtgaccaggcacatggacaggaacagcccagcaacgaccggctgcagttctggatcctctgagagtttgaggaggaggaatatagagacatctgttagactctgtgggtctgtatagtttggacaccttttgcctggaaaagatggttgaaaaatcagaaacaagtaaaccaatacccagccttgtgtctgcattttggatataagcaattcacaagtaatgttttcagatttcagagcaatccacactcagcaatattttgtagttctgacaagctcaattgccttataatgctttcaacatcgattgctgtgttattcacgtcttgctgtacacacctgccttagagacactagcttcaagaacgttccaagaaccagatcatcatatataacaaattcgtaattgctagaaaatacagcctatcttttccgaagaacaagatgtaataaaaccattgtcttcactttaagaaaaaggttatcctaattaaaggaaattaagaactcaaatactttatttattctactagattgttacaaattcccttgatttagaacatttgtaaacactgtataacagctgagaccatgccatctggaaatggaatgaaagttgatagttcataagcagaaaatagttccacatgccagttgggtcctagtgatttcatcattctgttttcggacttttctccttcaagagagtaattgcttactcaaatcagtgggtcttgttttaaaattcatggaagctctaactcctgtccttagcttaggtggacttagagttttcatcagaaagtttggctggatgcggtggctcacgcctgtaatcccagcactttgggaggccgaggagggcggatcacggggtcaggagatcaagaccatcctggccaacatggtgaaaacccacctctactaaaaatacaaaaacttcgcccggtatggcggagcgcgcctgtagtcccagctactcggggggctgaggcaggagaatggcttgaacctgggaggcagagactacagtgacccgaaatcacaccactgcacgccagcctgggccaacaagagcaaaactccgtctcaaaaaacaaaaaacaagaatcaagtaagtcaaagtcaccctgatgacagccaattttgatgaagcaaggaagggtcaattcaaccattaacatagattttgacttttgctgtctcctatgtgccaagaaagatataggatctggggaatcagaaacaaaagagactctcttgttcctctcacagtactcagtacttactgagagaaggacaaaacaaaacgtcctgtgtggaatgcagggaaagcagaacttcaggtcaggggatatttccgttgaattgtgtggagttgaagctgaaaatcttaaggaatgtatctaaaattcactttgcctttactttatgtatccgtcacctagagatcacgcagcaggcgcccacgatcagcttaatcgtcactcacttccatcggatcaactggaaatcaagtcagatgagagtgctgagtctcagaggatggacatctcaccccttgccatacagagaagtagaaagggtggtattccaaattcatggccagactcgaagtcccgggtactatacttcttggtcttccaactctcaaaaagttgtggggtttttttggtttttgtttttgtttttgttgttttgagacggagtctcgttcccttgcccaggctggagtgcaatggaatgatctcggctcaccgcaacctctgcatcccaggttcaagctattgtcctgcctcagcctgccaattagctgagatgacaggcgcccgccactacgcctggctcatttttttctattttgagtagagacgtggttttaccatgttggccaggctggtctcgaattcctgaccttgtgattcacctgcctcagcctcccaatgggctgggattacaggcgtgagccaccgctcccagcttccaaaagttttaagcagagctcagaggtcttaaccacaggcacatcggaggagcatttttgaaacactttccagcttcctcattaggaatggaagccaaactccgaattgatgactccttggaggaagtcgagagctgtaaggaaagccaggaacaggggcaagggagagatgtgtcccaaatgatcctgtgccaattctttctggaatcctcgatgtgatctcagctgctgtttccatacttgacacagtgattgtggcactcactggtctagctgtggtctacaaggaacccccaaagggaagggcacagtgagcaggggcatccgcctgagtgacgagaatttgagaggacaggttggttgcagggagaggactggccaaatgccatatgtctggacttagactgcctggttgaaaatggacttcaccctttttgacttcatgatcaagtacgagtgatttgaaaaggcattgctccttttctagtctgtaaaatcatcctgaaatgtgcactaataacgtggagactacgcagatgaaatgaaacaagctgcatagagcacagagctcagagcctggcctttaggaaaccctcagtaagggttcatgatgccatggtgtctgtcatcatcctctttatcctcatcatcaccttcataatctttttgttgttgttagggaatagtttagagggaccgattccctgctatcatgggtgagatgtctatgaaaaggacaaccagtgggggaggaaagcaaaattttgaataagatttctgagacccccagcacatccaagaacagaaactgcacactgctgagcggacagtttgcactttgttctcctcccatctgcccaccgcactctcctgtttatcctgaggaggaggaaaccaaacaaggctcccgaccgtccctcaacactcacttgaaggggtggcctggccctccacacctgtgggtatttctagtcgggtgggatgagagactgaggaaagaaataagacccagagacaaagtatagagaaacgacagtgagcccaggggaccggcgctcagcataccaaggacctgcactggcacaggcctctgagttccctcagtttttattgattattatttttattattttagcaaaaaggaatgtagtaggagggcagggtgataataaggagaaggtcagcaacgaacatgtgaacaatagaatctatgtcataatgaagttcaagggaaggtactatgactggacgtgcacgtaagccagattgatgtttctctccacccaaacatctcagtgcagtaaagagtaacaaggcagcattgctgtaaacatgtctcacctcccaccatagggcggttttcccccatctcagaattgaacaaatgtacaatcgggttttataccgagacattctgttcccagggtcaggcaggagacagcggccttcctctccctcaactgcaagaggctttcctctttgactaatccacctcagcacagaccctttacgggtgtcgggctcgtggacggtcaggtctttctcatcccatgaggccacttttcagactatcacatggggagaaaccttggacaatacgccgctttcaagggcagggctacctgaggctttccacagtgtactgtgcccctggtttattgagactaaagaatggcaatgacttttactaagtatactgcttggaaacatcttgttaacaaggcacatcctgcacagccctagatcccttaaaccttgatttcatacaacacatgtttttgtgagcttcaggttgggtcaaagttgctggggcaaagctacacattaacaatatctcagcaaagcaattgttgaaagtacaggtctttctcaaaatggagtctcttatgtctttcctttctacatagacacagtaagagtctgatctctctttcttttgcctacactcactgaactgcccttcccctctgctgggccatgaccacggagaacaggtccactgtcctctctgcatggtgcacgacggatgctcagactccatcctcaaggctggcaagaagacagggtgagacatgagcctcctgatacaggtgatgggagtggagcccacaggactggaacctcacactgcagggctggaggcacagactgagtatttactgttctgtggcctggggggctcaaggcacagagctcctcattagccaaagtcgcccaagttccccaacctctaaggattcctcatcatcatgcaagaagaagaagagaaaatgattgtccatagaagctttggggctcttcctctaatcaggagaaagctggtgtgtattcttcgcttctttcttttctttttaaaaatccaactgctttaattttcatcttttattatgggaaaatataccacatataaatatgaaaaattataaatatatattagttcatatagaatggccagtataaacatttacagtttccacgctttttcagtttacagtttcatgacattaagtacgttcacattgtttagcaaccatcaccgccatcatctccggaacagttttatttttcaaaatggaaattgcaaccatttaccaagctctccactcctctctctcgcccagccctggggccacctttctagtttgcaactctaggagtctaactactctagacacttgatagataagtggaatcataccgtgtttaattttttttttagatacagagtctttctctgtcgcccaggctggagtgcagtggcatgatttcggctcactgcaacctccacatcgggggttcaggcaattcttatgtctcagtctcctgagtagctgggattacaggcgtgcgctatcacgcccagctaatttttgtatttttaatagagatgagctttcaccatattggccaggctggtctcgaactcctgagcttaagggatccgcctgcctcagcctccccaaatactggggttacaggtgcgagccactgagcctggacatgtttatccttttgggatttatttatttcactgacgataatgtcttcaaggttcatccatgttgcggcatgtgtcagaagtgcctgtttttttttttttttttttttttttttttttttttttgatttggttttattttgttttgttttgtgttttcatggagtctcactctgtcgcacaggctggagtgcagtggcacaatctgggctcactgcaacctccgcctcccgggttcgagtgattcttgcgcctaagcctccttagtagctgagattacaggtgcgtgccaccacaccagctaatttctgtatttttagtagagatggggtttgccatgttggccaagctggtcttgaactcctgagctcaggtgatccacccgcctcaacttcccaaagtgttaggattacagacgtgagccactgtgcccagcccaagggtgtggatattttctatagacttttgatgataatactttgacagcaaatatattgtgtctatctatatatacatttatatatatatatatatatatatatatatatatatatagagagagagagagagagagagagagagagagagagagagagagagagaacgtgtgagagagacagcgagaaagagagagtctccctttttcacccagactggagtgcagtggcacaatcatagcgtgctgcggccttgaatttctgggctcaaacaatcctgtcacctcagcctcctgagtagctgggactacaggcatatactaccatgcccggctaactttttattatatttttttgtagagatgaggtcttttttcccgggttggtcttaaactcctggctgaaagtgatcctcctgccttggcctccccaggtgctggggttacaggtgtgagccattgcatctggtgtgaagctgggattgcaggtgtgagacacggcatccggtgtgaatatctcctggtaaataccttgtactttcactttcattaagatgtctttcgtcctcatgaaattatctgaaaaacggatgaaacactgttctgctccatcttccccgcaggcacttgggccccatcctgctctcctgcccccctcttctagtgaatggccagataggaactattgcaggtttatgggccacgtggtctctgttgcaaatataacagctctgctgttgtagtgctaaagcaaccacagaccatatggaaaccatctttcctgcatggcctctgtaatcttttagaaatacccgttgggtcacaccactgcctgacttaaaacatatagatgacctcttccgtctcctaagctattaggttggtgcaaaagtaattgctgtttccattcaaagtaatggcagaaattggctgggcgtggtggctcacacctgtaattccagcagtttgggagaccgaggcacgtggatcacttgaggtcagcagtttgagatcagcctgggcaacatggtgaaaccccatctctagtaaaaatacaaaaattaaaattagctgggggtggtggcgtgtgcctgtagtcccagctacttgggaggatgaggcagaaaattggcttgaaactgggacttggaggttgcagtgatgcaagatcacaccactgcactccaacccgggtgaccgagacagactctgataaaaaaaaaaaaagtaatggcggaaatcacaattacttttgcaccaacctaataaaagtcaagtcctgaccacagcctaggaagccggctatgacgtggcccttgtcaccctctccaagttcaactcccgagactttccgtttcctctctgctccccgctccggcctcccattcctcactcgtgttgcatcagatgcctgcgcaccctggtgtttccgcatgtgctcttctgttagcctggaaagttctttactccctcttcatccagcactactagatacctccccctgccttagcctagccaggtcccctgtcatttagtctcagagtatcttgaatgtcttcttcacagcccaactgacaaccctcactcactcgctgagtgggtgccatcctttctctccacctagaatgcaagctccctgagggcaggggctggaaccgtcttgttctttgccaaatccccagtgccatctctggcacacagtgggcattatgaaaatatttgctgagtgcataaaaggagggaatcatgcatttgagccctcggcttggtgccctggggatgtggctccataaaatcagttcccattttttctctctcttctcctgggaggtgggtatctgggttctcctgccaggagagcttctctctcataagactccaggtgcctcttggcctaggcctgcctcctgctaagtgagactctttagggctagtctgcatcgactctgctgagatgcagccgccagagatgggtaacgtgggcaacccttggcaggtccctgggaacgaggcttccgagtcatctggatcaactagtttgaagttacaaactcaccagatgttggtcagctggcatcttagtgatgagctggtccaaccccccttgttgtagtcaagtcacttgtgcaaagccaccacttggctgggaccccaagctcaggcccgtgctctctccatggtcccaggctttacactaagggaatgtcaactgttctctagaatcacttggactactttatacttttgtgtctccttttcctattctgtattctggaaaaacaaagttttccttgtgattgaacagactcttcacactgtgttattgctggcattgttctaaatttagccttggttcatccccagctggagtgaatgactttaatttgatcagctgctgtctgtgcttgggagcctccgaaggggtcctatggcctttaaggctcctttccatacttagatcctgacctggggcaaacacacactccagctcgttcatgtccagataagacacctagaggccatggcgagggttccccctgtcggggcactattgctgttgagaggatcaaggcagcagtcagggcctgagtgttgtccagaagaaagcacaaagtgtaccgagcgctggtctgacagcacttaggggtgtgacagaaaccttctgtcatgaaaccagagattggagactgtgggaacacatccgaatccacatctccatgacaaggtggtgctgatttccagtggtcctccctggtgggggaatcacgtagctctgacggtggagcgtgttgttgtgtttctctttcagtatgagcttgtctgtggccctagggttcctcccttatgaaataatgatgcctcccaacacaggacatcccaggctgcaagcctgtcccttcagcccagcttccttacccctgtgccccaaaagcccacagcagggcctgccagaggctgatgacatatctgtcactgtcccaagggggcaggggcagcgacggaaatattaggccacaaaaggcatgcctgcaggcacatatgagggaaacacccaaagccagatgtcaatgaaacagtaattcggtggaataggagaggtcatattctcatgcaagactgtctaaatacataagtctccttgggcacaatctcccaggggacaatggttcatgccgagacagctattacactgtcttgctaagaacttccaacacacacttacacacacacatacacacgcacatatgcatgcacacacacgcatgcatacactcatgcacccacacacacacatgcaagcacacatacagatacacacacatgcacaaacacacatacagatacacatacatataggcacacacatgcacacacacagatacacacatgcacacaaacacacgaaggcacacacacatgcaacaaatgcacatgcatacagacacatgcacacacaggcaacacacatgcatacacatacatacacacaggcacacacagatgtacatatgcacacgaagacacacatgcatgcacacacatgcacacagacacacacatgcacacacagagatacacatgcatgcacatacaggcacacacatgcaaacacatgcacacgcagaaatgcatgtacacccctgtacacaccgtacacacacatgcacacaaaaacacgtgcacacacatgcacacacatacacacatacagatgcacacacagacacatgcacacagatacacacacatgcacacatccacatgcacacacgtgcacacacgtgcacacacatgcacatgcacacttgcacacacgcacacacacacacatgcacacatacacacaaaccactccttttccatttctctaatttccaattttttttctatgagcttcctcagactcatgatcttgattctagaatgaattcagggagtaagtgtgtattattgaaataacagtaaattcaaacatgcctaagaagctttttgaatgttggggaaaccatctcacagatcattcaaatgacccgaggagacacttcaccagggacccttggacatgtccctgtcccttctgccgacctctgtgctgtaatatcaggggacaaacctctcgattttggtttctcatctctttgtccccaggtacactggactgcactactgtgtcaaagctacttgtagcctgacctgggaaatgcacttttggattcactcgatttgccacctatttgggtggtttgggctggaaactgccctgctcacactcttggctcccagctgctcctgctttgggggcgcctagagaccccagctcatcccgtgggtcatatccccacagtggggccgggggtgcgactgagagttgtctgggcacctgtccccagcagcattgaggatggcgctcagcactgtgtgatgttggctggtggccactgcctgtttaggtcgaaatggcccagcctgatgtccacaagcacctctgcggcacactggcctgcagacccccgagcatgcgctgcatgcttctcacctctagagtggccacccagacagcgatacagacacaccaagaaaatccacaggcaagcccagaggagcccgttctactagggccttgtgagcctctgtgatttgagtcacgagcttcttgtggtgatttcatttggctaacatccaacacagtgcatttagagactctttctcttggacattatatggaggagtggccatggtttgctgagagaaatgtcccaaaacacccctcaataaaaccaaataacagctcatcaactccttacatttaaaaaaaaattgacatcttataaatagcaaatattggatgacaataaggcacaggaaaaagctcataagcccagatcagcagtcatccttcaattgttccttaactactgactgtgcacctgttctgtaccagcaccgcaacctagatgcagggacaccacacgaaataagatgacaaagcacctgcccctgtggagctgagccactagcaggagagacagtcactaaacgaatatctctatcctgtggtttctgggaatgacagtcacataaaagtatagaaagggatggaggaaagctaatttagccaactcaggatcagaatggggaggtggttgcatccctcaaaattcagagtagctggagtgcaagctttgtattagctgagcctgaatccgggccctgccattgtccatggtgtcctcaggcaaatggctgaactcctctggccaccggcttcaagtgcagaacaggggaccagagtcccatctctcagggttgttgctgtggactgaattgtgttccctccaattcactcattaggagctaattaacgttaaaggaggtcataagggtggaatcctaatctgataggattggtggatttataaaaagaagagatgtctctgtctctgtctctgtctctccccctctctgccatgtgaggacaagcaagaaggctgctgtctgccagccaggaagacagcccttaccagaaagggatggtggatactttgatcatgaacttctggcctccagaacagtgagaaaatcaatgtctgttatttaggccatccggtctcgggtactttgttatggcagctgggctggctgaggcagttgttgagaggaaccgacaaggtagttggggtaaagcacacagcacggccacagctcactgagcacaatgtcagtctcattccccttcaattgttattctctgtctggaggattttcatgatggcttttctccaagaagctccctggggtctttgtaaatatggggatatatctgacaagaaaaatccttacggttcttaacattgacaatgatcaggaacagcaagacatgaaaatgagaaggtggctagaaaagagaggacccacagaagaaaccaacaaccacataacacacacacacaggaggaatcctaatgcaggagaatagaacatcaggggaccctgagactgaactctgcatctcatgtattgagatcattccctgatatggtttggctgtgtccccacccaaatctcatcttgaattgtagctcccctaatctgcatgtgtcatgggagggacgtggtgggaggtaattgaatcattgggtgggtctttcccatgctgttctcatgatagtgaatacgtctcacgaaatctgatggttttataaaggggagttcccctgcacaagctctcttgcctgctaccaagtaagacgtgactttgctcctcattcaccttccaccgagattgtgaggcctccttaaccatgtggaactgtgagtccattcaacctcttgcctttataaattacccaacctcaggtatgtctttattagtagcatgagaacagacaaatacattccctaagcctctcttttcctctgagacaggcttaaactgaatagccccatctttgcaggccttgaatagtaatactgttatgtgttatattaacatgtactttactgaaagtctctggtttttgtctctctgaacataggcaggcattgctgaaacttgcagatgacactccaaaatgcattctatcttaagataagaagagagggtggtgaggaaaaattgtacataccttccccttgatgaagaggtccccgtggtgtggccggccttggtataagccttttggctctgttaattcatgagggctgagtctgattgatcctcatggggaagactaacaagggaatccttggcaaccattaggaataacactaatgacccagaaagtggttctgtcttcatggggcatcatctgtcttgtttactgagtgatcttctggctcatttttcttccaaccagggttggaattcaataattctagttccttcccaaattttagagctgggaaatgcattcctcaggtatctgcttttcaaaagtgaacaatatctgtggagctcaactcctaaatagtgtgactttgtctgtttatgtggttctcttgctgactgcctggttgcgactgtgcctgaactcaggcctctgtgtttctgaatcttagaagcggtggttggcatgtcaaacttgaagtcattgtcctttagttatctgagtgttataattgaacagcacatttattaacaagactttagtaaatccatcagcattctagggagctttgattcattgacctatctctaatgtacgcaaaggctgccatagagtcgctaacaagaattccatctttcctcagaaccttcgattcgctagggtcggagttcatacctgtttcatgaaaaatgcaaaaccatttaatcacagctgttcatagtatgcctattctaagagacctctgctgttcctaccccagggaccgccagaataattaaaagtcacagaaatcaaacaaatgggcctctggctaaattatagaagattaacccaggaagagcacttattaaatagtaagcagtccccgaaaatattaaagtacaaaaaggattagaaattgttttaagtgttgattccaacttcaggtgctgttcttccactccactgcggaagggaacaaatggattttcccgtcctaaagacagtaacattcatcacgccccttggaggcttaataacatctcgctttattttattttaattgtttatttatttatttatttttgagatggagtttcactcttgttgcccaggctggagtgcaacggcgcgatctcggctcacttcaacctctatctcctgggttcaagcgattctcctgcctcagcctcctgagtagctggaattacaggcacatgccaccatgaccagcaaatttttgtatttttattagagatagggcttccccacgttggccaggttggtctcgaactcctgacctcaggcgatctgcctgcctcggcctcccaaagtgctaggataacaggcgtgagccaccgcccccggccaataatatctcacgttaagcaaggagttgctgtctgctgtgtggccagagagaaaacaagccgccattacagagggaggtggtattgggctacttttttttggaaacaacagcaaaatgtgaggcaaatccgcttttagatcctggttacactgctggatggagcttagcaagcctgtgatagggtagcctggtggtggcttgggggactcctagccatgtcagacaggacagatgcctttgaggagagatggcatagcgttggctctcaggcccccattgcagggggaccaggctgtttatggatcaggtgggaaccctgttagaaaaataagaggaggctgggtgtggtggcctacacctgtaatcccagcacctttggaggatgaagtgggtggattgcttgagcctaggagtttgagaccagccagggcaacttggcaaagccctgtctttagaaaaataataatattagttaattaattagttgatttttttttttaaagaaagagaagtggagctaaggagcacagagcctgccagaaagccaaggtgaccagctagaaggacacagaagaacattaccatagttctctctgagcttttggactagggatgctttcatgtggttttcatatcaaacatactttaattttatacttagccgggaaagacctaatacatacaataaaggtaacacgagacaaaactctcacctaagcctaacatcttagatgctctactgggtctctgcaatttctattagggaccccatgggtttgaattgcattctagatttgttaagaagatccaaatgctcaaccccttcaaccaccccgcatccgtccaccccatttacaaaagccaagtgaaaactaaggagggaccgggtgcagtggttcacacctgttatcctagcactttgggaggctgaggcgaggggaacacctgagatcaggagttcgagaccagcctgactaacctggtaaaaccccgtctctactaaaaacacaaaaattagcaaggtgtggtggtggacacctataatcccagctacttgggaggctgaggcaggagaatcacttgaacccggaggcagaggttgcagtgagtggagattgcaccactgcactccagcctgggtgagaaaaagcgaaactccaaagaaaaagaagaaaggaaggaagaaagaaagaaagaaagagagaaagagagagagagagggagagagggagggagggagggaaagaaagaaagagaaaaagagagaaagaaagaaagaagaggaagaaggaaaagaaggaaggaaggaaagagagagagggagagagggagggagagagggagggaggaaggaagctaaggaggaaggtggcttgtacagaggtacagaggccctcaggtcctagccggcactggtgcctacgcaggttccaatgggctgagctttgcaaaaagctcattgtgtaacccaggaagcccaaatttatttctgagcagatgtcttttcaaagtgattttccttttaggaagtgagaggagaatgaaggggaggtttatctacttctgatgttaaaaaagtcaaaacaaaataaattggtgttcattgcaactattggccaaagcactataatcaccaggactggtacctcaaacacacctcctgacagccccttccattctaatcaagatgtgcccaacagtggtcacccaggggctgtttacctttacttaaagagaaccgctggtagtaagccataaaaattaccatattcaccatctttctgcttcaaagaaggttttagattagcaatggctggatcaatcactgtgagtatgttcttgggaactaaaagccaaaaagaaatattttaaatacgtggtatatttttaaaatgtggactcttaatatatttttaaatgcaatgtaggtaagattttaaaatcactttccaaatcggtgcaagagtcactccctctccctgttacatacacacacatacacacaacccaatggtatccacgtgatcatcaaatgctccagagaggtggttttaggcccattttgcaatatttaaaaaatggagactaaaaacaagatatgatatatccatccagaagaatacacctcagtaataaaaaggaatgaaaagctcggcatggtggcttacacctgtaatcccagcactttgggaggtcgaggtggacagattacttgaggtcaggagttcgagaccagcctggccaacatatttgaaaccccatctgtactaaaaatacaaagttagctgggcttggtggcacaaggctgtaatcccagctacttgggaggctgaggcagggagaattgcttgaacccgggaggcagaggttgcagtgagcaaagatcgcaccactgcatcccagcctgggtgacagcgtgagacttcaactccaaaaaaaaaagtgaagtactgatacgatacatgctacaacatggatgaacctctgaaacattacattcagttaaagacgtcagccgtgcacacacacacaaaaccatccattgcataattccatttgtatgaaatattcagaaaaagcaaatctagagagaaagtagatgcgtggtgacctgggaccggggggctgggaatgggacagtgacggcaaatgggcacaagggagcttcggggcattgtgaaaatgttttaaaactggagggtagtgatggttgcacaactctaaatttactacaaatcattgaattttattcacgtgtaatagaattttaagaaaaataaacaacacgtcaatagagtggttaactctgggccgggcacggtggctcatgcctgtaatcctagcactttgggaggctgaggcaggtggatcacttgagtcaggaattcaagaccagcctggccaacttggtgaaaccccgtctctactaaaaaatacaaaaattagccagacgtgctcacttgaacccaggaagtggaggttgcagtgagctgagagtgtgccactgcacttcagcctgggtgacagaggaagactctatctcaaaaaaaaaaaaaaaaaaaaaaaacatatatatatatatatatatatggtggttaactctgaagatgagcttccctggactcaataaagcaaaatgactgtgaccaactcaaaatccaccatcaaactctcccagcacctgctcttctgctttctaccccaagctctttgcctctgtgtttccatcgtaaatctggaaagaattcgaagactctgtgctaaagtgatttgctaaatattatcagaaaggactacagaaagatgcagagaggatggcagcgtgaccgacccctttgaaggtggttgaagactctgctgaactgaacctaagaataagccctgggatgtcagaatccccaggcaaagctgctggcagatgacagcacccgctgaaacagaggacagagcaagaattctgcaggccaagcacactgccgcaggctgggagaagggagtggaaaccgaatattcctcctgcataaaactgcttatttttatttgttcctcagcccagctgagatcttggagaagtagcaacaggaaatggaaagaaagcgaaaacaaactgcaaattcagttgcactgctttttaaaaaaagaacaagtgagacatcttcagcagcaagaaaaccttgtttcctttcttggagggcttaactaaattcttctggggatgtcccaggatcaacaaccacaggacattcctagattgtgagttttccatgtacaagaggccctggtaccttggtgcccctcagcagcaagggagacttcccagggaggcccggtgaagttgctggaggtggctgatgatttccagggcctcgagaaatgtcccttggctgtcctcagggcccaccactgatcctgggaccatggcagcttcggagagctgagcggagctgctgcaaaatgctttctgctttaattacctcgcattcatttctgggcccagagaaggatacagtggcctgggaagtgtcagctctccctgccaggggtaggacttctttctcatgtctgcctcttggcttgttctcaaactgtggcttcaggagggccttggctcttggcaaatgccagaggctttacagtttgagaaagaatcagaattttgaagaggagctcagagaggaaggtcattctaggatgcactttgcagaatcaccaggcagtgaaaaggtgaaattggctgtggatgacacaggccactgcagggaatgtgcccctctaccatgtgaaattggttctgaaatccagagaatctcttaggacctttaaaatcaccgttgtcaacacacttgtcagatttttgcatctccttgtttcaaactggttcagaatgaggtcggggacttgggtgtgattgatcaccgtcctgctccacttcagatatgttggtgaaaacactagggaccactcttcatggagctcctactgtgtgcaggaccctgttctcagcagtttaaaccagggccatcttcctcctcatcaacacctttcctctcccactcagcagcctcagcgtctcagcccctagtgtgcagctagtgcgcataccctagtgttcaccctacaggatggttctctttggaacacttaaaccaccacccccaagctaaattaggccccctccactgctatagtcttcttcccttttctaaaatagcatttgtcacaatagggcatgatgatgtgtctgtctatttggttaatgcttgcctttctccctcaactgttcaccccatgaaaacaggaccgtgtctggttttttttttttttttttttttttttttgagacagagtttcacccttctcacccaagctgagtgcagtggtgagatctcagctcactgccaactccacctaccaggttcaagtgattctccttgtcacagcctcccgagtagctgggattacaggcatgcgccaccatgcccagataattttgtatttttagtagagacggggtttcaccatgttagccaggatggtctcgatctcctgatctcgtgatccgcccacctcggcctcccatagtgctgggattacaggtatgagccaccacgccctgcattagtttagttttttagagacagggtttcactctgttacccaggctagagtgcagtggtccaatcatagctcactgcagccttgaactcttgggctcaaacctaggctcaagggatcctctcgcctcagcttctcaagtacctgggaatatatgaatgcacaccatgcccagcttacatttatttgtttaaaagacaagaaagaggccaggcacagtggctcacaagtgtaatcccagcattttgggagggaggctgaggtaggaggatcacttgagcccagaagttggagaccagcctgggaaacatagcaaggcctcatctctaagttaaaaaaaaaaaagcaataaagatgacatgataccaaatcaaatcatttcctttcctaggaaaagggcaaaaacaaggcacggtgtcagttaagaatccctctttagagaagcatgaaaagtctgccccaaatctggtaaaaccaggaacaactgacggtcaaactgatggtgcattctaggttaggatgatttggaccaggttgtactttgttcccaaagaattcaaggaaaagttagtttgtttaatccgcttatcatggtaaaatctttctttgcaatgtcatacaaagttggcattgtgtgtgcactgttgaagaaaacatagttaattgtttttttaaaagactgtattccaaaaccatttaattagtaaaaatgtttaataatgatttgtttttttttgtttttgttttttttttttgagacggagtctcactctgtcgcccaggctggagtgcagtggcgcgatctctgctcactgcaagctccgcctcccgggttcatgctattctcctgcctcagcctctggagtagctcggactacaggcgcccaccaccacacctggctaattttttgtatttttagtagagacagggtttcaccgtgttagccaggatggtctcaatctcctgaccttgtgatccacctgccttggcctcccaaagtgctgggattacagtcaggagccaccgtgcctggccctttgagtacattttctaagaacttggtcatgagttcagatgtctgcctcagagatacatgtggcttcctttaaagaacccaccttccctttctataggagtatttatgggagatatgagcctggaggttggaatctatcctggttgtactttgctatactgaagtaaggagtaaacctacaactaaattcatactgaagtatacaaagggggctctacaatagataggaattctgtttagttttgttgggtaacaatttctttgagaagcaaataatagctcacctacaaaactggtgatctgtataagttgggatttttcatggatcagttttgcttggaatgaactacctaatcacaaatatatttatacccagagagagagaaggagtgtctgttgaaaccgtatcatcttaacgtgtctataaaaggcaatacctggaaggtggtgggtgccacacaggttaagctgtcttccctctgggaggcaggcttctgggaactacacatttggtaatcttgcccataaaatgccgattggacacttatcgtagaatgccgagggcactgtagattgaaatagtccccatcacaggcatatgtggtgtggttttgcaggagtttggttaggtaacctggtaaatattcagtcgggttacaagagttccagaaacccaccactcctccttgggtttggggacaggaggacgttggttcccctggggaagggctgttgagttaacaacatgtggggtggggcctccctagcagctctggtgcagaggtcaccaaaccaggcccagaggtggggcacaggagccaatgtcagctttcatgttgatatggaaggggggcaggggagtgctgggtagagaagggtggggtcactgtcgagggctctgccctcgggcttgtgcccttggaccttagtgagaacaggcactcctgttttcttgtccaaatgttgcattttccaagactactctggcctgctatgacccccatcctgtgcccataaaaaacccaagatcctagtgggcacagacacaagtggctggacatcgagaggagcagagaagcaggagagcacactgaaagacatcagcagatgctggcaggcttttgacagtggggagatgtggaattcagtagggggtggtcggaggagagtgtggctactaggcagcccgactctagcagaagatcaccttcccactccatcccccttctggctccccatccatctgagagccacctcctccactcaataaaatcttgcattcattctccaagtccacgggcaatctgatttttcaagtacactagggcaagaacccgggatacagaaagccctctgtctttgtgataaggcagagggcctaactgagctgattaacacaagccacctgcagatggcaaaactgaaggagaccactgtaacacatgcccactggggcttcgggagctgtaaacacccaattccacacgcttctgtggggccagatcccagaaatgctccccacgacatgcccctctacacgctccctctaggggtttgagcagcagggtactgagaagcgagccatgcccctgtagcatgccctgcaagggggataagggtactcctcctgtttcaatgtctgggtcagaaaccttggtctaggcccactgaatggtttggagggctctttccccttcaggaagcactaaggtattggccaggagccaagaagtcctgaagcacctctgtaaaccaggaaaaaacaattgggatgagtatcccctggacgtgtggatgcccatcctgagggaggctttcattttctcatctcccactagtgaggccatgccttattgggatgagaggatgcagtttcatttcaagaaatcactcttggctctgtcttggtgctggagaggaaagacaggcagggtgccctgtgcagagaagcgatggtggggctctgctgtgggttgaatggtgtcctctcaaattcacgttcatcaatgtggggaaaagaaagagagatcagattgttactgtgtctgtgtagaaagtagaaatacgagactccattttgttctgtactaagaaaaattcttctgccttgagatgctgttaatctgtaaccctacccccaaccctgtgctccctgagacatgtgctgtgtcaactcagggttaaatggattaagggctccgcagggtgtgctttgttaaacaaatgcttgaaggcagcatgctcgttaagagtcatcaccactccctaatctcaagtacccagagacacaaaacactgctgaagcccacagggacctctgcctgggaaagccaggtattgtccaaggtttctccccatgtgatagcctgagatatggcctcctgggaagggaaagacctgaccacccccccagcccaacacctgtaaagcgtctgtgctgaggaggattagtgaaagaggaaggcctctttgcaggtgagctaagaggaagtcatctgtctcctgcttgtccctgggcaatggaacgtcttggtgtcaagcccgattgtatattcctactactgagataagggaaaaccaccttagggctggaggtgggacatgctggcagcaatactgctctttaatggattaagatgtttatgtgtatgcacatcaaaagcacagcacttaattctttatctggtttaagatgtagagagctttgttcacgtgttttcctactgaccttctctccgctcttaccctattgtcctgccaaatccccctctctggaaacgcctgaaaattatcaataaatactaagggaactcagaggctgctgccggcatgggtcctccgtattctgaacgcccgtcccctgggcactattttctttctctatactttgtctctgtgtctctttcttttccaggtctctcattccacctaatgagaaacgcccacaggtgtggaggggcaacccaccccttcaatcaggaacctcagaatgtgacatttggaaattgggtggttgcaggtgtaacgaattaacctggtgacatactggagtaaggtgggcccttcacaccatgtgactggtatccttaaaagaagaagagactcagagggaagacagccatgtgcagctggaatgatgcatctgaagccaaggaatgccacgcattgccagccaccacccaaaactggaaaaagtcaggaaggattcttccctagaaccttcaaaggcagcacagccctgccaacatctgcattcagactctggcctccagaactgtgagaggatgaatttgttgttttcagccacccaagcttaggaaatgggttgcagcagactgggaataagacaggcagccagtcagactccgtggaattcccaggcagcttgcagaagccacagtgggccctgggctctgagaagtctgaggcctagcaggcacgtggcctaaactatttctcggcaaggaggaaggaaggctcatccagaacgtagatccccttcctccttctcacacctcacgaggtcacagcgaggtggctgggaggagagccaggggcttttcactgaggtgtgtgggagacagcttggccgcccttggcctctgaagggaggaggtggtgtgaaggagggcagcttcagaacttcccagttcctgcttgaccacctgtgtgtaaagtattcctgtttaggtttcaaaatcctctcagaaacataattctcagaaaatccaggcacccaatccagctccctggccttccctgaaatctgaagtcaaaggggctgagccagcctgccctgggtgtcaggcctctgagcccaagctaagccatcatagcccctgtgacctgcatgtacacatccagatggccggttcctgccttaactgatgacattccaccacaaaagaagtgaaaatggcctgttcctgccttaactgatgacgttgtcttatgaaattccttctcctggctcatcctggctcaaaacctcccccactgagtaccttgtgacaccgactctgcctgccagagaacaacctccctttgactgtaattttcctttgcctacccaaatcctataaaacggccccacccctatctccctttgctgactctctttcagactcagcccacctgcacccaggtgaaataaacagccatgttgctcacacaaagcctctttggtggtctcttcacatggacgcacatgaaatttggtgccgtgactcagatcgggggacctgccttgggagatcaatcccatgtcctcctgttctttgctccatgaaaaagatccacatacaacctcaggtcctcagacccaccagcccaaggaacatctcaccaattttaaatcgagtaagcggcctcttcttactctcttctccaacctctctctgtccatcaaccactttctcctttccagtcttcaatctctcccttctcttaatttcaattcctttcattttctagtagagaaaaaggagacacgttttatccatggacccaaaactctggcaccggtcatggactgagaaggcacatttcccttggtgtttaatcattgcagggatgcctgattattcaaccacgtttcaaaggtgtcagaccacccagggacgcctgccttggtccttcacccttagcggcaagtcccgcttttctgggggaggcacaagtaccccaaccccttctctccgtgtctctaccccttctctgcttttctgggggaggggcaagtaccgctcaaccccttctccttcacccttagtggcaagtcccacttttctgggggaggtacaagtaccccaacctcgtacctctgcaccccaatcccttatttccgcaccccgaccccttttctctgtgccccaatcccttatttccacaccctgacctcttatatctctgcaccccaatcccttatttccatgcctggacctcatatctctgcgcccccacccctttcccacttttctggagagtaagaacccccgaaccccttccctccgtgtctctactctctcttttctctgggcttgcttccttcactatgggcaactttccaccctccattcctccttcttctcccttagcctgtatttttaagaacttaaaacctcttcaactctcacctgacctaaaatctaagcatcttatttcttctgcaatgctgcttgaccccaatacaaactcaacagtagttccaaatagccagaaaacggcactttcaatttttccatcctgtaacatctaaataattcttgccgtaaaataggcaaacggtctgaggtgcctgacttccaggcattctttcacacatcagtcccttcctagtctgtgcccaaagcaactcatcccaaatcttcctcctttccctcccacctgtcccctccgtcccaaacccaagcattgctgagtctttctaatcttccttttctacagacccatctgacctctcccctcctccccaggctgctcctcgccaggatgagctaggtcccaattcttcctcagcctctactcctccaccctataatccttttatcacctcccctcctcacaccgggtcccgcttacagtttcattccatgactagccctccccaacctgcccagcaatttactcttaaacaggtgcctggagttaaagacatagtcaaggttaatgctcctttttctttatcccaaatcagatagcatttagcctctttttcatcaaatataaaaatccagcccagttcccggcttgttcggcagcaaccctgagacgctttgcggccctagaccctaaaaagtcaaaaggccgtctaattctcaatatacattttatttcccaatctgcccccgacattaaataaaactccaaaaattaaattctggccctcaaaccccacagcaggatttaattaacctcaccttcaaggtgtacaataatagaaaaaagttgtaattccttacctccactgtgagacaaatcccagccacatctccagcacacaagaacttccaaatgcctgaaccgcagtggccaggcgttcctccgcaacatcctcccccaagagcttgctacaagtgtcagaaatctggccaccaggacaaggaatgcccgcagcccgggattcctcctaagccacgtcccatctgtgcgggaccccactggaaatcggactgttcaactcactggcagctgctcccagagcccttggaactctggcccaagcttctctgactgaccccttctcagcttagcggctgaagactgacgctgcctgagtgcctcggaagccccgtagaccatcatggatgccgagctttaggtaactctcacagtggaggataagtccgtccccttcttaatcaatacggaggctacccactccacactaccttcttttcaagggcctgtttcccttgcctccataactgttgtgggtattgacagccaggcttctaaacctcttaaaactccccaactctggtgccaacttagacaacactcttttaagcactcctttttagttatccccacctgcccagttcccttatttggccgagacactttaactaaattatctgcttccctgactattcctgggtacagccacacctcattgccacattttaccccagttcaaagcctccttcacatcctcctcttgtattaccccatcttaacccacaagtatatgatacctccactccctccttggtgaccaatcatgcacctcttaccatctcgttaaaacctaatcacccttaccccactcaacgccaatatcccatcccgcagcatgctttaaaacatttaaagcctgttatcactctcctgctacagcatggccttttaaagcctataaactctccttacaattcccccattttacctgtcctaaaaccagacaagccttacaagttagttcaggatctgcgccttatcaaccaaattgttttccctatccaccctgtggtgccaaacccatatactctcctatcctcaatacctccctccacaacccattattctgttctgggtctcaaacatgctttctttactattcctttgcacccgtcatcccagcctctctttgctttcacttggactgaccctgacacccatcaggctcagcaaattacctgggctgtactgccacaaggcttcacaaacagaccccattacttcagtcaagcccaaatttcatcctcatctgttacctatcctagcataattctcataaaaacacacgtgttctccctgctgattgtgtctgattaatctccctaacctcaatcccttacaaaacaacaactcctttccttcctaggcatggttagtgcagtcagaattcttacacaagagccaggaccgcaccctgtagcctttctgtccaaacaacttgaccttactgttttaggctggccatcatgtctctgtgcagtggctgctgccgccctaatacttttagaggccctaaaaatcacaaactgtgctcaactcactctctacagttctcataacttccaaaatctattttcttcctcatacctgatgcatatactttctggcgccccggctccttcagctgtactcactctttgttaagtcccacaattaccattgttcctggcccggacttcagtccagcctcccacattattcctgataccatacatgacccccatgactgcatctctctgatccacctgatgttcaccccatttccccacatttccttctttcctgttcctcatcctgatcatgcttgatttattgatggcagttccaccaggcctaatcaccacacaccagcaaatgcaggctatgttaaacacacctcaccaagctcagccgacttaaaaaggactggacaatacttttaccactttcccttctcagaagtcagacctgtcctcagaatgctacaaaatacagcccatttgagctcctgtacagacgctcctttttattaggcctcagtctcattccagacaccagaccaagttagactatgccccaaaaaaacttgtcatccctactgtcttctgtctagtcatactcctattcaccattctcaactactcatacatgccctgctcttgtttacactgccggtttacactgtttctccaagccatcacagctgatatctcctggtgctatccccaagcctccactcttaactcttgaggtaaataaataatctttgctgacaaggctatgctgaacctccttaggcactctctaattagatgtcctaggtcctcccaattcttagacctttaatacctgtttttctccttctcttattccatttagtttttcagttcacacagaactgtatccaggccatcaacaataattctacacgacaaatgtttcttctaacaaccccacgatatcaccccttaccacaaaatcttccttcagcttaatctctcccactctaggttcccacgctgcccctaatcccgctcaaagcagccctgagaaacattgtccattatctctccataccgtcccccaaaattttcgctgtcccaacactttaccactatttcattttatttttctcagtaatataagaagacaggaacgtcaggcctctgagcccaagctaagccatcatagcccctgtgacctgcatgtacacatccagatggccggttcctgccttaactgatgacattccaccacaaaagaagtggaaatggcctgttcctgccttaactgatgacattatcttgtgaaattccttctcctggctcatcctggctcaaaacctcccccactgagtaccttgtggcccccactctgcccgccagagaacaacccccctttgactgtaattttcctttacctacccaaatcctataaaatggccccaccccatctcccttcaatgactctcttttcagactcagcccgcctgcacccaggtgaaataaacagccatgttgctcacacaaaacctgtttggtggtctcttcacatggatgcgcatgaaactggggtcctcacgcccaccagcccagagtactctctagaggaaggctacagatacttcctggctcgctcatccaaacgttagctgtcttgctgaaactccttttgtcacccttgaaaaccactggaagaatggccaagaacccagctatcctgagtaagttcacttaaagaagcaaaatctgacatgagtggcaaaacggacattggcaccaagagtgtgggtcagagtcctgccccttggaactacatcatcgcttgtacagtgtaccccccaggcaccaagagaccaggcggagacccttcagtggccctgggcctctggtcactgtcttcctgcctggcacagaggcaggccctcataaatcaatgagtactgaaagttccagccttcttggtgggttctctgcaccccgtcgtgagccacaccctgccccagggaaatcagggtcaacttgatgctacccctaggccagtgccccttctgcagtgccccaggctggcaccccatacttagatctcttcagcctcttcatgaaaaccttcttgtccatcaccccagcattccccagactgtgctaaatgagcagctgaccacacgtcaaatcaattttcagagtttgcctttggtttaatattcatggcttatccaaaagatcttgtcaccatagctagatgaaaaaaatgacaaggctctggagaagcagagccacaagatggaagatacctgggtcctaggttcatgaggagaggagcttcttgctccacagactgtcacatgagtgggaatgaaacttttgctgcgtttagacgattacctttcttcactctgtcacatagtctatccccgctaaacagaacttgacctccaccagaccgtttacatcaagacctatatgtgtagtgcagcggcctgagcctccaatccatgccccacctatccaaccagccttgccatattctaactctgagagtggtattctgggggcagacgctcagagcatagaattgactaatgccagatacttcaggcgctttgcactttgaagtctctctgtcctagcacattccaagtacaaagaagacacttcagcagtacaacctggcctacactcagttcaattacttcttcaaaaacctaggcccggccaggtgtggtgacttacatctgtcatcccaacactttgggaggcggaggtgggtggatcacctgaggtcaggagttcgataccagcctggccaacatggtgaaattccatctctactaaaaatgcaaaaaattagctgggtgtggtggcaaccccctgtaatcccagctacgctggaggctgaggtggggaaattgcttgaaccctggaggcggaggctgcagtgagccgagactgtgccactgcactccagccggggaaacagagcaaaaccccatctcaaaaaaacccaaaaaaacaaaaacaaataaaaacaagcctaggcccacatccagacaatggaatgttatttagcactacaatgaaatgagctatcaaaccacaaaaagccatggagaaaccttaaatgcatattcctaagtgaacgaagcccatccgaaaaggctgcacactgtatgattccaacgatatgacattctggataaagcaaaactatggagacagcgaaaatatccatggtttccagaggtcaggagaaaggaggaatgaattgatgaaacacagaggatttttaaggcagtgaaactactctgtgtgatactacaatggtggatccacgtcattgtccatatgtccaaacccatgcaatgtacaacaccaagagtgagccctcatgttaactatggactctgggtgatagtgcccacctcggcctctcaaagtgctgggattacaggtgtgagccacagcgcctggcctctgcttcatttctctaacacattaagtctatttaaaaggaaaaaaaaattccctatccccaggatagcattacctttgggaggagaggagctagcgttagggaggggagaatgaggtgctcaggcaagctggccatgcccagttccttgatctgcatgacgtgcatgtgctttactgtgtgaaagctcacccggttatccacttgggatatgtaaacaaaaatgtttaaggaaacttcgaggatgggctgctgggtgacagcaggacaggctcatgaggaccagccatcacccaaatgctctggtcctccaggctgcctgcccatgcctcaagctgtttggtctacagtgccaaaaggtcaggaagaaggacagttaggacaacctcatagtttcagcaacatggaggccatcaagaaccattttgaaaccatatggaatggggggtggggacagaagcttgtttggaaaaggtagaaaagtgagtggaggggccaggtgcggtggctcatgcttgtaatcccagcactttgagaggctgaggcaggtggatcacctgagattgagagttcaagaccagcctgactaacatggaaaaaccccatctctgctaaaaatacaaaattagccatgtgtggtggcaggtgcttgtaatcccagttacttgggaggctgaggcaggtgaatcacttgaatctgggagacagaggttgcagtgagttgagattgcaccattacacgccagcctgggcagcaagagcaaaactccatctcaaaaaaaccaaaaaaaaagaaaagtgagtggaggttcagaaagtcaaagatggtccatgtggtaggcagaataatggcccacaaagatgtccacaggccttaatccccaggaccagtgattatgttaccagacattgatggaaaaagggacttggcagatgtgattaagttcaggattttgagtgggggagattatcctggattatctggaaggggtttatataatcacaagagtccttaaaatgaggaaggtggctgagtgcagtggctcacacctgtaatcccagcactttgggagaccgaggtgggtgtatcacctgagatcaggagtttaaggccagcctggccaacatggtgaaactctgtctctactaaaaatacaaaaaattagccgggcatggtggctgatgcctgtaatcccagctactcaggaagctgaggcaggagaatagcttgaacctgtgagacggaggttgcagtgagccaagattgcaccattgcactccagcctgggcaacaagagcaagactctatctcagaaaaagaaagaaagaaagaaagagagaaagaaagaaagaaagaaagaaagaaagaaaggaaggaaggaaggaaaagaaaataagacagaaatggtttatactggatcaatctacctgggaggagatattcccaagcaagcagcgtcttttctcctatgactgactctggaacagtgaggagctgctggattctatcaacagttcgagagtgccctatataaccagctctcatctcactcacccccagctgtttggtctatggatgacaatttcgaggtgaacaaacaacatcctgtttggagggctgctactctggctaaagacggtaaaaatcagtcagctcagtgagctgaattgcatgctgttttcctagccactgatttatactagaatgatgccagtaactgattttcaaagaatcatggtatgtgtcccaaagtgttccacaggagtgtgatattgtgaaatatatatttgatcagttgaacagtggtagaagtcccctgtttgggtttttactgactcctgggcagtgaccagtgtcttggctgtacactcaggcaagagggcaatcgccacctggcttattaacggatgtccatatggggcacagccctgtggagaggtgaaagatgccttgaagtagaacaggttcacgtccatcagaaaaactcccttccaggctcaggaggtggctggagtcaccaagtggattttttttgtgtgctcctgtgaggtggtcacctgggcccatgaaatgagtgagcaaggccgttctgcagcagtacagagatgggctgaatctagccatgccccttgggctcaaaatgccaataagaactgttctgtcgctgggtgcggtggctcaagcttgtagttccagcactttgggaggccgaggcgggtggatcccctgaggttgggagtttgagaccagcctgaccaacatggagaaaccccatctctactaaaaatacaaaattaccggggcgtggtggtgcttgcctttaatcccagctgaagcagaagacttgcttgtacccaggaggcggatgttgcggtgagccgagatgatgccattggactccggcctgggcaacaagagtggaacaacgtctcaaaaaaaaaaaaaaaaagaactgttctgtctgccagcaagagaaacagagactgcccacaactgccaggcacattccctagtgagaaagctcttaacgtcactggcaagtgagatggatgctggcagccctgggggagctgcatctaggtctttacaggaatagacgctgtctctggactgggctttgtttgtgtggtagaagatgcaaactctcggagtgccattaaaaacaagaaaaaaggccagacacggtggctcatgcctgtaatcccagcactttgggaggctgaggtgggcggatcacctgaggtcaggagttcaagaccagcctggcaaacatggtgacaccccgtcactacaaaaatataaaaaaaattaagcaatcccagctactcgggaggctgaggtggaagaatcacctgaacccaggtggcgtaggttgcagtgagctgagatcgtgccattgcactccagcctgggagacagagggagactctgtctcaaaaaaaaaaaaaaaaagaaaaagaaaaaagagaagaaaagaaaagaaaaaaacagaaaaggagatactgcatgaatcttgatagccaacgtcattgcttcagaaaaaggagcactctgtacagcccataatgtccaacaataggcagagaggcatcctcttcagagtcataatgtggcacagaaatggaacaggcaaatcaaacgctggttgtctaaaacgggggaggtgaaagcagaagggctggtgatagagtgtggatctgtatctccaccaaattgtgtgttgaattgtaatccccagtgttggagctggggcctggtgggaggcaactggatcatgggggcaggtttcccatggatggtttagcactattctctttggtattgtactcacgatagtgagtgagtcctcgtgagatctggtcatttaaaagtgtgtggggccgggcatggtggctcacccctgtaatcccagcattttgaaaggctgaggtggatggatcacctgaggtcaggagttcaagaccagcctggccaacatggcaaaaccccgtctctagtaaaaatacaaaaagtagccagcgtggttgtgggcgcctgtaatcccagctacttgggaggctgaggctggagaatcacttgagctcaggaggcagaggttgcagtgagccaaggtcacaccatggcactccagcttggatgacagagcaagactctaaaaaaaaaaacaaaaaaagtgcgcggcacctcccccagtcattctctctggctcctgctcctgccatgtaagagaactgctcctccttcatcttctgccatgattggaagcttcctgaggcctcaccagaagcagaagctgctatgcttcctgtatagtcttcagaacagtgagccaattcaaccactttccttgtaaattacccaatcccattgcttctcagccttttggctaagatcaagtataaattacccagtctcaggtatttctttatagcaatgcaagaatgaactaatatagctggcttgcacgctttgtgagtgtgcactcatacttagcatgagtggtctaaaggagtggccttccagatttttctccatttttttggttgatctggggaagggggggtggggaggatgctgacatgaccatgcaattttttttttctttctgagacagagtcttgctctgtcacccaggctggagtgcagtggtgcaatcttggctcactgcaaactctgcctcccaggttcaagcaattctcctgtctcagcctcccgagtagctggaattacaggcgcatgccaccaggcccagctaatttttgtatttttagtagagatggggtttcaccatgttggccaggttggtctcaaactcctgacctcatgatctacccgcctcagcctcccgaagtgctgggattacaggtgtgaaccaccgcacccagcccaatgaacagttcttgaatgaatgagacagtgaagaagactaccagaagaatagcagatcaaaggtgaataagtgagtagtagcttctgattaatccctcatcagcaaccaacgtaacccagggcttatagatttctctgtgtaacatgttacacacatgtctacggaaagagagagagagagaagcacatcagtcaagcatttttcaaaagttaccctaaatgtgctgtgttggtcttgtattacaatctttagattacactactgttttatttcaaacaggactggtagaaacttcttcatgccttttcaaccaaaggccttcagtcctataaaaatgatcaccttgttctttgaccaagtaccaaccttagaaagttaagcagcgaactccatctgacttagattagttgaaaagtaactggatcaatccccctttaccccaaacatctaaatggaacaattttcttttcttcgggatgcagcataatcctcaaactacagagccacttggcgatgaagccagaattgcagtgcatttgataacttcatgcaactttttactagcatttaaaactcagatatgaaatctgtacttgatcttttctgcttggaattggccagattagtggttctgcccccacatacaacaaaaggctctcagaaacactcagggttgctaaccagtcagaaggaccaacagagctcgacaaacagacaagagggagaagggcaccaccttccaacctacccgcttagacagcctttcaactctgcccactttgaggatgtgtaggatgatccaggtaatcatgatacctaccttaacttcaaggtagaaattaaggcttgagggcacttatttggtgccttattcagtgaattggaagactatatggtaatttcactgctcataataattaaaccttttttttaactttagggatgataatgacatttggagagtagcactataaacctcagacatctattttgaagatgactggatttaggagcaagacaggtttgctgtacacttgactgaacatgctttgttccccaaagcagcaaaaaagccagagcctggaagtttctaaaacttgaagcagatgtaagtggcaaatccaaaaagccatgcctagagaacaggtcgggtgaccggctgtgtctattccagcctccctgttggctcggtggaggacttcggacaggtctgtcagtatccccttctttggtttcaccttagaatgaggggaagtcacagcatttcttcgtttgtatttcacagaaacacagtcagcaaatgtaaagaagtacgggcgcctaaatggtggttatgctgccctggtctcaagcttcatattcatccttaattgattcccaggcacactcactagtgacctggctctgcttcactgaatgaccccaagggcccacactttcttaattctcctgtggaccctttattcactccccctcatccttcctttgctgacggtgtttgcttctgattgtcccaatcttttttttctttttctttttcttttttttttctttttgagatgtagtcttgctctgttgcccaggctggagtgctgtgtcgagatctcagctcactgcaacctccgcctccccagttcaagtgattctcctgccttggcctcccaagtagctgggattacaggcgtgcgccaccacacccggctaactttttttgtatttttactacagatggagtttcaccatgttggccaggctgctctctaactcccaacctcaaatgatccatctgccttggcctcccaaagtgctgggattataggcatgagctactgagcctggcctcaatcttatgcttacaattcttaatctgttgcctcattttatagccacagctcaggtgacagctgagggattaccttcgtctgtctctgagcctctaagatttctattttcttcaccaccttccaggaatccttttttctagctcttggttgctggccatgtcctggacagttcagtttaaaatctgacctccagttcatcggtgcatctaccatcaatcctcattacctgcagattctgcagctgtaaattcacgtacttgataatgtttatttatagcccctaaatcaatcccagcagggctttcctggatgtgcgccaagtgctgaagaggttgaatggctgatatgcacggtcccagcagagctccatcgaggagctccttttggtttccgctcttataccataaatgaatgcccttttcttggttgctttggggtttttttttgagacagagtctcactctgccacccaagctggagtgcagtggtgtgattgcaacctctgcctcttaggttcaagcgattctcctgcctcagcatcccgagtagctgggactacaggcatgtgccaccacacccagccaatttttgttttttagtagagacggggttttgccatattggccaggttggtctcaaactcctgacctcagatgatccacctaccttggcctcccaaagtgttgggattgcaggtgtgagccaccatgcccagccagggttctcttaaatgtaatggaaagaggagaattggaaaggcagagagagagaactaggatcctgcatgaatgaatcaagttgagttggagagaaactgtatttataggaaagttaaggctctgagtttggaggccaagcagggtggggatgagcaaagccatgagaaggaaagaagggcttcaaaaaacagctgctccttcttgatagatgcagagaggaatcaggaaagaccgggggccatgcagtgttatttgtagcacttgaatagcttggctcttagagttccaagacctccagctagtgatccagagatgccattagagggcaaaagcgctcgctgctccctcatttgtcaccaggaagacatggtatggccctggtcttaaggacaaattagtcaattgcttattgtatatcacgagatgaacgctgggagagaggaaacgcagggtgtgtaggaagagggcaaaaccggctacatctgacccaccccagagatgaggaaggcttccaggtgggaggtgacgccaggaggtaaccaggtggaaatcaccgtcaagtagcagggacaggagtgcaaaggctcagagggaacttctccaggatcagcagagctcaattgtagggtgtgaggctgtcacagaggctggagaaataagcagtgccttgctaagaagtctgaattttaacctgaagggacatgagagctactgcaggctggtaagcaggggggtgatgctggttggattgcaatgcagagaaaccctgggttggcctgcgtctgatggactggagacacccttgaagaaatcagggtacaggcagtcctccggagtagaaatgaggaaggtgccagctgagaccacagcagtggggaagagtgtgagagggatggaaattgagatgaattcatgggtgtttggcctgtgcagtcacacagtgccccatgctgagagggaccccgagcgtggcttaatgctctgctcttactgtcttaaaattcctcctcattttatgtttgaatctatgttttgttttgttttgagaaagagtctcgctctgacatccaggctggagtgcactggcgccatctcagctcactgcaacctccacctcccaggctcaattgattctcctgcctcagcctcccaagtagctgggactacagccacctgccaccacacctggctaatttttgtatttttagtagagagtgggtttcaccatattggccaggctggtcttgaactcctgacctcaagtgatccgcccacctcagcctcccaaagtgctgggattacaggcatgagccaccgtgtctggccttttttcttgtttttaatggcactccgagagtttgcatcttctaccacacaaacaaagcccagtccagagacagcgtctattcctgtaaagacctagatgcagctcccccagggctgccagcatccatctcacttgccagtgacgttaagagctttcccaccagggaatgtgcctggcagttgtgggcagtctctgtttctcttgctggcagacagaacagttcttctttttttgagacattgttccactcttgttgcccaggccggagtccaatggcatcatctcggctcaccgcaacatccgcctcctgggtacaagcaagtcttctgcttcagctgggattataggcaagcaccaccacgccccggtaattttgtatttttagtagagatggggtttctccatgttggtcaggctggtctcaaactcccaacctcaggtgatccacccacctctgccacttagaaaacaataaacaaatggggtaaaatggtagcactggggaatgtcagcgaagggtataaaggatgtctttgtactattcttgcagcgcttctgtgtctggaaaaataataataaatattacatatttaataactaaatgaatgaaaaagtgtgcaatgtttttgcagatgtcaaccttggcaatgcaataggatcatctcagaagctctgcatgaatatcagtgcccaggctccaacccagagattcatagtcagttagctgggggtgaaactccagacatcggcatgtgtgaaacacaccccaaggtcattctagtgtgaatccagaataataagcagccagcttagcctttagtgtcattgggtgacaggaaagttctaggctggggactttctgagccccccatgtctgcttgttttgagatctgatcttgggggcagcatggtgactcaaaacaggagcacagttgtgggtccagtcttggtccttccactaataagatgggagacgttgggtcagatcccttgcctgtgccaagcctgggttttctcagctgtagaatgaggttaaccaggaagtgcctcagaggccaatgtgcattcaaggaagaagatgcccagctcagtaactgatatggtgtggctgtgtccccacccaaatctctaattatagttcccataatcaccacatgttgtgcgagggacctagtgggaggtaactaaatcatggtgtgggtctttcccctgctgttctcatgacattgaataagtctcacaagatctaattctttttttctttttttgagaccgagtctcactctgttgcccaggctggagtgcagtggcgtcatctcagctcactgcaacctccgcctcctggatttaagcaattttcttgcctcagcctcccgagaatctgggacaacaggcatgagccatcactcctggctaatttttgtatttttatgagagatggggtttcatcatgttggccaggctggtctcaaactcctgatctcgggtgatccacccaccttggcttcccaaagtgctgtgattagagatttgagtcactgtgccctgcctgatctaatggttttataaaggggagctcgcctgcacaactctcttgcctgctgccatgtaagatgtgactttgctcctcctccaccttctgccataatcatgaggcctccccagtcatgtggatctgagtccattaaacctctttttctttataaattacccagtctcaggtatgtctttattagcagagtgagaatggactaatacagtaatccttacacccccggaccccaaaatggagttgccacaagatggcagtctgaaatccttgtgatgtccagctggcagaaaggaatttggatgagtagggctggccaacttctggtattgctggtgggtcctgtcattgtgtgggtgactccttgcacccctggcccttcataggactgaaatctgggagggttcttgggaaaggggctagagaaagcaagaggacaccaattttcttccaggcagtaggaaggcaagctggagaggccaagctcccaagtaaactgaggcacctccactggcccctttgtgaggcacgcttgacctgggttttatggaaagaaagtgccctcaccaaagggtgctaaacaaggccccaggctccacacttgatcccatgtgcccccctctgccctgccctagactcacctaaagctgtactgcccagagtcatggcctcaggccacacgtggctactgggcacttgagatgtggccatctcaattgagatatgctgttagtgtaaaatatacactagatttccaagccgtcatgagcaaaaaaaaaaaaaaagaacataaaatatctcattaagaatttttaagtattcattaatgttgaaataaaaacattttgaatatattggttaaataaagtttactaggagaattcatttcaccccttttactttttctaatgtggtgactaaattatttaatattacacatgtggattacattatatttctattggacagctctgttctaaagtctgcacgttgtccttttgtggcttatttccttgataattttattaaaattaaattgacgggcaaggtgcagtgactcacacctgtaatctcagcattttgggaggccaaggcaggtggatcacctgaggtcaggagttcgagaccagcctggccaacatggtgaaatcctgtctctacttaaaaatacaaaaattagtggggcgtaggggggcatgactataatcccagctacgcggaggctgaggtaggagaatcgcctgaatcctggaggcagaagtagcagtaagccgagatcacgccactgcactccagcctgggggacaagagcgaaaatccatctctaaataaataaataaataaatagaaaaacaaaattgagggccaggcacggtggctcatgcctgtaatcccagcactttgggaagccaaggcaggagggtgacttgaggtcagaagttcgagaccagcctggccaacgtggtgaaatcccatctctactaaaaatacaaaaattagctgggctttgtggtgggtgcctgaaattccagctattccggaggctgaggcaggagaatcacttgaacccaggaggcgaggttgcagtgagctgagattgcacaaaggcgctccagcctgggcgacagagtgagaccctgtctcaaaaaataaagaaagaaataaaaataaattgaggaaggattgagcatgcaaaatagaatcagcctttgaccctgaataccctgcagtgagaattcccctgtggttctcaggcttctgtcattccagcaaatacactcttccctcagcttcactaaaatgcagatattgtgagataatgctcatttctcacagcttgcttgaataataacaatgatcattatagtaatttataacttaatagtcaacattgcctttttaacccagtctgtgagactgaatcgtaaacgtgacattctttaaagctgtcaattaatataccagactgcataaactctaataacttacctttccatggaaagagaatatgtgggtattctctttgaagacaaatggtggagagtagactctcatccaagaccctctggcagtaatgagttgcattccagaaggttccagaaggttctgtggaaggctgcagtttgggattggttctcaggtgtctgtctaactgctttctaaggatgaagacggccgggcacggtggctcacgcctataatcccagcactttgggaggccaagacgggcggatcacgaggtcaggagatcgagaccatccttgttaacactgtgaaacctcgtctctactaaaaatacaaaaaattagccggcgtggtggtgagcacctgtagtcccagctactccagaggctgaggaaggagaatggcatgaacccgggaggcggggcttgcagtgagccgagatcgcgccactgcactccagcctgggtgacagagcgagactccgtctcaaaagaaaaaaaaaaaaggatgaaaactcctggttcgtgctttagcaacatccacaggagcaacagactaagacattcctccacacactaacagaccccggcagtgcagagccacgtgggtcttatctgtcctgttgtccacagtctggttttatcttagacctggcctggtgcaatccatgctgcgtataggcacgccacttaagtttcctgtttgtaaaaagcccctttcattcagtgattcctcagggctttaggggaactttctggaaaccaggaagaaggaaataaaggttgttttactgaggatgggtgacattgggtgcgggacccaaatgagtggtttgagcagaaagtagcctccacgctggactaatgcttggcaacattatgggaaaatttgaggaagccgggagaggagggggcagagtttctttcccagccagccacgggggccaggcagttttggtcctaggatgtctctatgcattcccaagtgattgcaaggcttcttcttgtcatcgtctgagacttggattccccaagcgtccttcttttcctggagtctctgagtcctctattcctgaggcctttcttcagccctcccaatagccctgccatgatttcattgcagggctgtgaccgtctatgacaagccggcatctttctttaaagggacacctctggacctgcagcacaggctcttcatgaagctgggcggcatgcactctccgttcagggcccggtaggcctcccatcctcagctgctttctctcctgctcaccactgccctggcctctccccttctcactgcagacctgggaacacactcatccaggggttggcatactaaggcaaccggccagtctcctgctttggtaagtcaagtttcattgggacacaacacactcattgccttctgagttgtctacagccgcctttgagctacaatagcagaatcgtgttttgcaacagagaacccgtggcctgcaaagcctgaagtatttactctctggccctttaagaaacgtttgtggacccctgtgctgtcttactctcctgccagtgggttcccaggcctgtggcaggatctgtggacctgtgggtcccctggggtgtctcacggggctaaggagggacctttgtgcagatccacacaccctaaggtgtgcccctgggtaagctgcggtggtgtgggagggcgtccctgcaccctcatattgagtccaggggatgataagacagtaagtcccacggagaaaaggaatgagtcagtcttgtttgctgttgtaaccttagcacccagcaacaatattagagaaaggaagcccaggcctcgatggcaggggtggcctggtgctgctgatgtggccgggcaccccaacctttgggagcctgcaggccttgccatggcaggagaagcctgtcctgggtcctgggcctgctctgtggcctctcacaggcttttttcctgctctttcagtttagaacctgaggaaccagccacggagccgtcggccttcatggagcgggatgctgggagcgggctggtgatgtgtctctgcgagtggccagccctgctggtcagcagcacaggctggacaggtctgcacgacccctggaacacttgggcttggtgtgacgggcacctggccaatctgtattctcctcacccctgccagtcctgcatgcccccaccctgccacagtctcaatgagaaggggagggcgtgtgagctggaagaggggtgtctagaaacaggcccctgacattcaattctcttctcatagaggacgaagacttctccatcctgctggcagctttagaaagtaggggtgtagctgtggtgaggagctctgggcttgtcgggggccactgagctgtgagctgcttgcctggcctgcagcatgttcctgtcccgggccactgggtggggcagcctggggacagcggaggtggtggaggtgggctgccctgaatccccagttgggtcattgagtgaccaggccctcaggctgaaatgcctcctccaggagagtatctcacagaggctggtggcctccccacaagagcagtgctctttctccaactgaccaggtgactctggctattgtttatttaaaactttttttctgaatgggcatggtggctcacacctgtaatcctagaactctgggaggctgaggcaggcagatcacctgagttcaggagtttgaggccaacatggcaaaacctgtctctactaaaaatacaaaaattagctgggtatggtggtgggcgcctgtaatcccagctacttgggaggctgatgcatgagaattacttgaacccaggaggcagaggttgcagtgagctgagatcatgccactgcattccagcctgggtgacagagcaagagtctgtcagaaaaacaaacaaaaaaagaaattctatcagaaattccatgtagaattgtttctttttttaaacacagagtttgagcaactgactcttgatggacacaaccttccttctctcgtctgtataacaggtaccgcctgggaccctgggtgtctgtttgattgggggatggtggagggggaggggcacgcagcctttaccctgtgcttcccacgatcttgtctccttaatcttcactgcagctctctgcatagggtcttatactgcttgacgtgggggaaactgtggctcagaggatttcacagcagggcagggagcccagattagaatctgtagataccaagctttctactttttcagtagtttccaagcatctttttgttgttgttgttacatcattagtgtctttttttctttttttttttttttttgagacagagtctctgtcgcccaggctggggtgcagtggtgtgatcttggctcactgcaacctccgcctctcacattcaagcaattctcatgccttagcctcccgagtagctgggactacaggggcccaccacacccagctaacttttgtatttttagtagaaacaggtttcaccatgttggccaggctggtcttgaactcctgacctcaggtgatccacccaccttggcctcccaatatgctcgaattataggcacgaaccactgtgcctggccatgtcattggtgccttaaccaagcctcttttaatttttcaaacggaagagcccctgtgccacagttactgctgctgagccctttcaaggtgactcagtgaggagggagaaaagcggaagtggtgtgggaagaggcggggtctgggccagctgctggtcctgctctcctccctcctctggcctctaggctcccaggagtggtttggagcccgcgccatgtgctctggaggctgtggcagggcagggggagtcctcgtgtcccctgtgcacaacacagacaaaaggctgggtccacccagtggggggtcgggtgccaggccggtgcttaccccgccatgtttgcagcccgaggccagctggctgcaagtgcagggctgtgcgtcaggggtcagggtgcacacacccctgcgggtctcggggctcctgggatgcttcccgaagggcccggatggggcctgactggagctgccgaggggtggagcttctgggaaagggatccctcctagcggggagtgtcttgggcctggggccacttggtagggtcagagacgggtccatagcagtatctgctcttctctgtgaaggcaaagggcctctgacggagtattacagctgcctcatccaccagaagcatttccagcacatccaggtcagcaccccttggctggaggccgaggactagcccctgcttctaggtgagaggccagcaggaggctcagggaggaggcggggccttaagcagcgggaacagaggtgggcgggatgtactttttctgaaaaggtggctctggaggccacttggggacaggacctgggctctggctgaactcccgggaggaggctacttcctggtgtgccagcccctccctgccaggtggccccagaggccctttaccaaggggtttgaggaggccatgtcctttcagcctgccacgccctccattcagtcctcttccttcctgcaggagggctgggcctggggttggggcactgttgcccaggtgtgggagggcagtggctttgggaggtacagggacgatgtgtcaaacagcgtcgcttctcccagtgagatggttctcctttgcctccgtctctttccccgattgatttttccaaatggggagtcgtggcttggtcctgatgcgtctctagagctgcatcttccagcttcaagtgagcagagcagttggaggctgagggccttttcctggcaggactctccagctagtctttgttttagacagtctcgctccgttgcctaggctggagtgcacgatctcagttcatgcaacctctgcatcctgggttcaagcgattctcccacctcagcctcctgagtagattacgggattacaggagcccgccacaacacctggcttatttttgtatttttagtagaaacagggtttcaccatgttggccaggctggtcttgaactcctgacctcaagtgatcctcccgccttggcccccctaaatgctgggattccaggcgtgacccatcacgcctggccccagctagtcttcagaaatattaagctgtttcgctttgttttcacactgacagctggtttgtggtgggtgtgctgtggtttattattattactgttattattattattattattttgagacagagtttcgctcttgtagcccaggctggagtgcaatggcacgatcttggctcactgcaacctctgccttccagggttcaagcgattatcctgcctcagcctcctgagtagctgggattacagacagctgccacgatgcttcgctaattttgtattttttttagtagagatggggtttcaccatgttggccagcctggtcttgaactcctgacctcaggtgatctgcccgccttgggctcccaaaatgctgggattacatgcgggaggtgaacctgggaggtggaggttgcagtgagctgagattgtgccactgcactccagcctgggtgacagagtgagactgtctcaaaacaaaacaaaacaaaatgacaacaaaaaaaaaacaaattgtggttaagtagaaaaagtgtcaacttacattttcagatgtcccagccaggccgtgtggctgcttggccggcttaagccacttgtgcttggtgctgtcgggtgccttatccgattttcactcccctcaggggatgttgcctcactgtgctgggaggatttgtgttcccagggcagagaccagtgctctgaccgcacccctcttgcctagcagggtcggtggacctgggtgtctgtctgcacacgttctccagtggcctggacctgcccatgaaggtggtggacatgttcgggtgctatttgcctgcgtgtgccgtgaacttcaagtggtaggagcagaacccgaatctttctagggatagcttcacagatccaccgctgagggggaagcagtgcagagggagctgcccacagtgaggccctgcccctcggtcagtccagcacacactggaggccacgaggaggagccctgcggttactgtggctgggctgagcctcactgaagtagttgcttccatttagagctcatgttatatttaggctggtacaaaagtaatcacggtttttgccattaaagatggcaattacttttgcaccaacctaatatgaaaaaaaagcatcttaaatactagaactccactcggggcttttgctcctggagtagaattggcgggaattgcctgcaggcttacatggtcttctttgtttctttctctcccaccatgtcccttttggccaagctcacgtggtgggtttgaatcagttgaatgagtgtcatgctgtggcctcactccacccagcatagacgggtgtttggaagggcactgttagaggagattctagaagcagtagccccagcacaagctgagcccttggcccctgctcaggagccggctcatggatgggattcagcgatgtgagcccctcctgtgagctgagctcagggaatgtcgggatcaaatctggtgccctagaaaagtcatcttttatgtgctgagccagtccccagggtgttccctttacttgttccatggccatggaattaagaaaaacatgcaaaaataattcttcagtccttgaagagcatccagcacagaaggtacaaaccccccttaaggctccctcctcaaatcggtttggccacttagatgtgcacccccccaggcctttatacccttcagatgccaaatctaagaacgagctcccggaaaccacaccccctgttccaacccccagcctggcttgagcatggggttgggggggtggagcccaggtgggcaccccaggggtctggtgtcttctccaggcagctctcaggctcccttggttctctctgcagtttaaatgagctggtgaaacatgaagaaaatggcctggtctttgaggactcagaggaactggcagctcagctgcaggtagccacatctgccaccacgccagggtggggagggttctggagactggctccgagccacgctccctgatcccttcttcccacagccagggtgggaccatgtagggtctggcggaaaagctagggagagagcagaggtcacaggccggcccactctgctgtcccgttttggtacagtaggctcaggaaagttaggacacacccccacctgccctctggatttatggagctgacactccacaaatgatgctggagccgggtgggccaggctgcagtttaggaagtgatcaggatcacgtaggtgggcgggcaaagggagcttctgggaccagccttgaaagatgggtggaattctgcaaaggttacttgtttcttattgctaaaagtaatacaccattcttgccaacagaatgattggcaggattttcagtaaaggtccaggtcggaagtcatttagactgggtcccccagtctctgtcagaaccatggtactgacatgtggtgtgaaagtagccacagatcatctgtcgattaaggggtgtggctctgttcaaataaaactttatttacaaacacaggctgtgggctggatttggcctgcaggctgtagtttgtgatccttgattcagacagtttagcaaggctgcaaagaacacagacacccccttgttacccacagatgggtgggacatggccagaggccaaaaggagggtgcttgcaggggaacatacagcatgtagaggccgggaggtactccagggcaccaagtgtgggaaagtgggacacacggggaagtttccagaaagcgtgatgtcaagttggaggcagagcgctgctggggtgtgaagagtctcgagtccaagtgagggagttaagaacttgggaggggttgttgttgggttggggacatggggtcagccaggtggtgacctgggatggggtggggacaggaaatgagttaagctctgctctttatttttttgcagatgcttttctcaaactttcctgatcctgcaggcaagctaaaccagttccggaagaacctgcggtaatcgcagcagctcggatgggatgagagctgggtgcagactgtgctccctttggttatggacacataactcctgggccagaggctaaaaccccgggacccctgctgtccttcccgcagcttcttctcggagtctcagggcaaaccctttcgagcagcgcctcccagtggccagaaggtgaaatgacggcagtggtgccgcctggtgaatgaattggttctgtgacccgggaagctgtgcttggttctgatttcttttctggaggctcagaaacacttcctctcttcttctgttcttcatgccccatgcccctgctagcgtattactgttctgtgacttctgcagtactccttatcctgcgtttggtctccaggtgtcatctttctgccgtgttcctaacattttgattcctgtcttgaaaaaagcacctgctgcaccgtaagcccagggatgtggcagctgcagcgggcttggctttgtgaagaaccgagtgtgtccacggatgtggcagctgcagcgggcttggctttgtgaggaaccgagtgtgttcagggatgtggcagctgcagcgggcttggctttgtggggaacagagtgtgtccacgttgggggaacatcatacttgatacacactttttatttgcacaaagaaaatgctgtttttggagccagagttttcatgtctgattgatggcgattttcttcagaaccagaactgctggcagaaagggagcacccacacgcttagatagctgatgtcttattagagggcagtttgtggttcctgatttggaaattaacattctccaaacattccagtccaatgaaagttttatctgctttcccatataaaaactcttcccacaagagtgacttgattctcacaatcccgttggagtcgtgtgtgaatcctacagtgtgaggttcagcattgccatctccaagtgctcttcgtagggaaatagtttctggtcatgacgagggttccacttcccatctgatcctggcctgcctggaaacagaggacatgtgtttcaggatggcagagtttggggacaggacatgagcgtattgtgtggggctgctaggacaggcctggcggggtcggggggtgtccaagtcagtttacttggttcacaggttcccaggcccacccaggtgcctagaattggcctccaggatgggaccagaaatctggttttgcatagaaatggctagcagcaggcaccgtgccgctgtccagtctctgcccgcgtctgccccagcacttggcacagcgggacagacgcagagatctgaacccacatctacctggctgctcagtcaacccactctccacaaagcttagaaagcagccaggcacagtggctcacgcctgtaatcccaacactttgggaggccaaggcgggtggatcacttgagatcaggagttcgagaccagcctggccaacatggtgaaaccccatctatacaaaaatacaaaaattaggcaggcacgatggcaggtgcctgtaatcccagctacttgggaggctgaggcaggagaattgcttgaacccaggaggcggagtttgcagtgagccgagattgtgccactgcactcgagcctgagtgacagagtgagactccatctcaaaaaaaaaaaaaaaaaatcacacacacacacacacacacacacacacacacacacacacacacacagcttagaaggggctggtgttctcataagcacagatatctgaagagccgttagccagaatgattcttttttttttttttttttttgagatacgatcttgttctgtcacccaggctggagtgcagtggcacagtcattgctcactacagcctcgactcctgggctctagcaatcctcccacttcctgagtagctgggatgacaggtgcgtgccaccatgctagtaatttttttattttgtagagatggggtccggaatgcatggcctcaagtgatgctcctgcctcagcctcttttattattattttttagacagagttttactctgttcccaaggctggagtgcagtggtgcaatctcagctcactgcaatgcatcccaggttcaagtgattctcctgcctcagtctcccgagtagctgggattataggcgtgcaccgccaagcctggctaatttttgtgtttttagtagagatggggtttcaccgtgttggccaggctggtcttgaactcttgacctcaagtgatccgctcacctcagcctcccaaagcctcagcctctaacagtgttgggattacaggcgtgagacactgtgtcctgggatgattttcaatcacagttttttgttacgagtggaaaatgcatatttataaaaatgaagtagtacagacatgaacgtgtagaagtctctataatcctgccatccaaggatggcacctgttaacgtgtatatcaggtatgtccaatcttttggtctccctgcaccacattggaagaagaagaatcgccttgggccacacataaaatacactaatgctagcaatagctgatgagctaaaagaaaaaaaaatcacaaaaaaacctcgtactgttttaagaaagtttacagatttgtgttgggccgcaggttggacgagcctgctatatatatattctaggttttcccctataggtatacttatgtgaaaatgattattgtgataattttattttgagatgaagtcttgctatgttgctcaagggggccacaaactcctgggcttaagccatcctcccgcctcagcctcctgagtagttgggaatataggtactcataactatgtgtgggtgattattattatttttaaaacaaaaatggggctgggtgcagtagctcatgcctgtaatcctaacactttgggaggctgaggcagcagatcgcttgaggtcaggagttcaagaccagcctggccaacatggcgaaacctcgactctacaaaaaatacaaaaatcagccaggcgtggtagcacgcacctgtagtcccagctgctcaggaggctgagatgggaggatagcttgaacctgggaggtgggaggttgcagtgggccgagatggcaccactgcactccagcctgggcaatacaaagccagactctgtctcaaaaaaaaaaaaaaaaaaaaaaggtggattggggcttatactatgtgtgctgcttggcactctttttttcacttcaaagatattgcaggtattttttcacataagtatctgaagaaagacttccttttttttttttttttttttttttttgcatttttgagacagggtcttgctctgttgcccagcctagagtgcagtcgtgagatcagggctcactgcagcctccacctcctgggctcaagccatcctcccacctcagcctcccaagtagttgcgcaaccatgcccgactagtttctgtacgttttgtggagatggggtcccactatgttttccaggtaggtcttgaactcctggtgtcaagaagtccccctgccttagcctcctaaagtgctgggatgacaggcccgagcctcgcacccggccagcctcctgtgcgaggttgtgcgggactctgtcgtggaacccagtgtgtcttcgtgtgctggcttgtttgttggctctgtagttaacgggctgccccacgtggacaggcattggacccgtgtctctctgtgcaggcagaggctgctgcacgtgcatctgtgaacatggctgccaagaggggctgtgctcagggggagctggggcagaggctggtggcaatggggggcttgggtgtagtgtggaggcacgagagccaggtggccgggctacagtctgtgggagcttgggggttgcttgtcctctgtgtgtcccagtgtctttgtcggtgagatgggacaatgatagcacactctcacaggtgctgggggctgacaaatgtcaggtctgaggacagtggctggcccactacggggccagttcccctactctatagtcaccctgctcgtcttccatcaactgggtgctcaggacagtggcatggtggatccgcctgtacagcctgtgctccagcgtcctgcaggccacagcggtgtccagccctgaccatgactgcccctcccgccacctccattttatagatgaggaaaccgaggcccaagggcttagggaatcttgctctgaagcacacagtagggctgctgggctcagatcctccctccctgtgctgagctgccctcctcctgccgcaagtcccccacgccatgagcccaccctgctcaccggcctctgccctagttccccgcatggtgtgggagtgtggggcttcctagcttttaccctgccctcagttctttcacttccactggagtcccgcagggacagctccgggaccatgcaggcccgggtgggcgtgggggctcagctagctcggtggtgaacagctggcacgtctcttggttgcggacggtaagggccacatagacttgaggagcccgttggtgttcccggtaggcagccagcctccgcaggaccccgaccagcgacacaatggcttctgggcaatacggcacgtctacggtgaaagcttcagattactgaaggggaccagcggacagttccaggtcatgctgacctcagcagaagggcgaggccagagaggcagcggtcatatgagactagtagatgccatttgaccatttgggccattagatggaaaggcaattacttgggtgaaaaaggagaacccttagtagagaaagctgcaaaagaccgaagcaaaagaaaaaatctccagactcactggtgttccttaaaaaacgagctctggttctcggcctatctagagggctgtgaatgacacaaagcctgaccctgccatgaacttcgtgtttcaggcgtctgccgatttgtctgctggcttgcaggggtgggcctgtgtccctggccactgctggacctgtggttttcagggctgggacccaggaccacaggcagagctctgttcgacccgagaggagactgagtgtgctggcaggggcgaggggttttcggtggcccagccaaacaccaccttctctcaagggccctgtcctcatcccagaagtggttgttttcctcctgtggtctctgaaagacacaggcatggctctgggacagagccatgtggtgatgactgtaatgggagtatgcctgtctccaaaaagagggctgtggctgtaaggtcaccttaagaggcacccctgtcctttgatgtcaccctggaggcccagagtaactcttctggaagccccatcatgtccatgcccaacagcgtccatcgttcccttttcccagagcccagagctgggtagagctgcaaggacaccgcctgcacagggtgcccggggctgggcattacctgctgcagtgacaacatctggctggatggcagagagctgacggactgtcgcgacatcccagtccagctgggccactgtcaccctggggttgtctaagttggcagagatgtctgcctctaatgagaggccattgagaaggatattccctcggagcttcttgaggacccggctgtgacagtcgctgaagatatatgcccgggggaggcacatcttgcagatggccaggcctgtgaggccggcgccactgccaagctctaggacagtcctggcgggaggaaaggggaccatgtctgcgactgcaccagggtaagcctgcctcggtgccctgccatgcaccccgaggtcacctatgagagaaggctgccgggttctcaatggcccattctgcaaggtagagggcagcatctcatgtgaccaggcctgtgatgccgtgggagatgatggctgtgctctcagagagtgtgactgagcctcccgagggctgcaccaagagagggcgagagagtcagtccagcgatcagaaggcaagtggcttagaagacaagtagccatccaccacatggctgaataaaccatgacaggaccaatcgccactcagcaatgagaagcaactaactgttgacatgccaacagcttgcacgggcctcaagggtgtcatgtggcatgaaagacactcatctcaggccacacaggattccattcattgaacattcctgagacaacggaattctggtgatagagcacaggtcagtggtggccaggggccgggtgtggctatgaaggggtggctgccttgtgatgattcaatatgctatgtttttcctttgtggttttctgtatctatgttttatcttattttttttgagctctgttccccaggctggagtcagtggcacaatcttggctcactgcaacctctgcctcctgggttcaagcaattctcctgcctcagccgcccaagtaggtgcaactacaggcatgtgccaccatgtctggctcatttttctacttttttttgagacagagtttcactctcgttgcccaggcaggagtgcaatggcgtgatcttggctcactacaacctcctcctcctgggttcaagagattctcctgcctcagcctcccgaatagctgggattagaggcacccactaccacacccgctaatttttgtatttttagtaaagagagtttcaccatgttggccaggctggtctcaaactcctgacctcaggtgatccacctgcctcagcctcccaaagtgctgggattacaggcatgagccaccacgcccggcctaatttttgtatttttagtagagacagggtttcaccatattggccaggctggtcttgaactcctgacctcggatccacccgcctcagcctcccaaagtgctgggattacaggtgtgagccaccacacccggacctgtcaagtattctttgaggaatggacaccaggtccttgtgaaggaggtagagtgtgtcacctattggacaaatgcccaacaaccccatgagacatgctgttgttgttgaagtgcttgatttacagacagggaaactgaggctaaagaaggttgacggacctcatgtctaagactgcagaatgggtgagtcaggatttgaacccacacccacgttttcactttgtctgtgcaggaagggtatctgggctgtgagggggaggagggtgcccttcttataccagcaaatagctccggtggccctgggtggactccttggccatcagggtctccgccagcgcctcgtacagctcgtccaaaggctccgtgtggacagcctcctgctgggggcaggcagagtgagagcttgtttgctttcgttctaatctgtaaaaatggtcagatgatttcaccaagtttggaggggagatttgggatggaatggtgtaatactggccagctggcatataaaatattcacttcattgggcttggtggtgtgtgccgaatagtcccagctactctagaggctgacatgggaggactgcttgagcccaggagttcgaggacagcctgggcaagagaccttgtctctaaaaaaaaaattcacttggtagggaaacctggatgggagggccttcaacgagaggtgttgagagggtagtgttaggtgtagtctagggcaggagacaaggatccgtgagagctgccacatgaccatgacagagaggaggaaaacaaaaggtgcttttaagtgagcccaggcagaactgtgagggcggcccatgctgtaggctgtggctgtcagcaggctgcttctccacggctggccccatcctaagattcacagggcagcagcaagatacactgggtgactgctgccctctcctggtggcacagggcagacctgctggtgactacagatgcacccttttggggaggattagggagaaagcaggtattggagaagcaggggattgtttacttgctaaaagtgtggccctttcactcagcaggtctgctactgcctactgaggaatggcctctcgacatccttatgtcaaacgctgcatgttcgggcccatctttaaaatccatcctaggccaggtgcggtggctcatgcctgtaatcccagcacattgggaggccgaggcaggtggatcacctgaggtcaggagttcgagaccagcctggccaacatggtgaaactctgtctctactaaaaatacaaaaattatccaggcatggtggcatgtgcctgtagtcccagcttcttaggaggctaggtacgagagttgcttgaacccaggaggcagaggtttcagggagccgagactgtgccacagtaatccagcctgggcaacacagtgagactctgtctcaaaaaaataaataagtaaaaaataaaatccatcctgtatcagtcaggaaagagcacattccagcaggatcaatgcggagaattcaccagaggaactagttccaaagttatggcaagagctaaaccttccaacaggggcccgtggggcaacccagagacagacaagagtaggaaactccaaacccttcggcgggtaggacagagggtgtgggtgagggttccagtgctgtgggctgggccagcctggtaggaatgagaatccatatgctaggagctggggccccagagcagcagctgcggcagaaaccccaggaggcagagtgagggagagacgctggcctccccttcttcccatcctgcattgtctcccatgggtcacacgcggctgcagccagttgcctggttaggcccctgccacgctggggtttgcaaagcaggcccagggcctgggaaggacgggggctccagcacgcaggtggctatgctgtctggctactgggcggacactccccataactgacctttttgatgagttctgagagaaagcaccgggcatacttgactgacggccggtgcttcacacacacaggatgcttcacagtctaccgcaaaggacagaacgttggttgctcgagagcccgtcttaagcctcctatgagcttcaagccaacacagcagagggcaaactccaggctacccgatcccccagcaaagatgtagatggacacagcgttctggccccatgcatctgaagtttgtcttatgatataagccgtttcctaaaaatgcttccactgcagtggcacaggctatggcagcatttctaacgcccattctgagcaagaacgcagggcacgtgggcccaaaccacctccctcccaggggagccagtgtgaaccagggtttacagtgaggacagtcgccaactgtctggctctatggaagaggcgggaaggcccactcggcaactgctctcttggagcgtgtgtccctggggacaggatggaggggaggggacgctcagggtgacaccccagctaaagccgagagaagccgagtgcaggacgagcaagttccaggcagtggcaacagctggtgcaagctctgaggtggccgcggcctggcacttggaacggagggcagagggactgctgcagcaggagcggggacagcgggaaaacaggagcctggagggagagggaggagacggtccgcagcgcctgctggctgggagggatgcagattctgcccaagggcagcaaagtaccccacgcaatacacaggctcttcaggctgctgctggtttttcattttttctgacacagtctcgctctgttgcccagggtggatggcagtggcccgatcttggctcactgcagcctccgcctcctgggttcaagcgattctcctgcctcagcctcccgagtagctgggactataggcgtgcaccaccacgcacagctaatttttgtatttttagtagagatgggtttttgccatgttggctaggccggtcttgaactcctgaccttaggtgatctgtccacctcggcttcccaaagttctggaattacaggtgtgagccagtgcgcccagccttgtgctgggttttaaagcagctatccctgcatttcatgcttcaccacctacgagagtgaggctcagggtgaaactcagagcagggtgcaagataactgcaggtatctccatgttcgaagccctgacctactgcattgacctgaaagttgcttgagcccaggagttggaggctgtagtgagctatgattgtgccactgcactccagcctgggtaagagagtgaggctctgtctcaaaaaccgaagaaaacaaaaaacaaaaaacagatgctatgtcccattccagaggttgaggtttaattattctggggtggggtgtgacctgggttttggaacactgaaaaaatcccaggtgatcctaaagtgtagatgagtctggaaaccacacacctaaggcacacttgaatgggggagcagtgaggtggtgtgggctagccggccagaacccaggggtgggaaccaacattgcagatgccataaaggctgggaagcatagtgtctggggcccataacaatgcttggacatgaatgctttagacctaagacaattggctcctaaatgtgaaaactgcaaggctgaaatgaatgcatgtttaatgctttgcaacattgtcaagtggtcagctgcaactccgttctgagggcgtgatgcctgagatacgcctgtcatggcggttgattttaatgaatttaatatggtgtggagtggggccttcaaaagtaaaaacgtcagttctaagttggttgcgggggtctgggcaaaggtcttcaaaccccgtggtaaacaccccgattttaaaacagggccttttttccaagagactttttgaaaatagctcctattttgaggggaggaaccctggcgggagagagccagagttaagcccagctgagagggggttggcaggcacgggcctgcctggtcctcactgaaacttgctactcagggtgagcttcctaaaccaatgcagacttgctggcccactgagcctcccagctgagaacctgcatttcgacaaggtcctcagtgcagcaaagtttgagatatactgggctagagcacccaggggacctaaaggttctttgaatactaaggaaaataggcagggtgtggtggctcatgcctgtaatccttgtattttgggaggccaaggtgggtggatcacttgaggtcaggagttcgagaccagcctggaccaatatggtgaaacaccgtctctacaaaagatacaaaaattagccaggtgcagtggcaggtacctgtagtcccagctacatggggagctgagacaggagaatcgattgaacctgggaggcggaagttgcagtggcccgagatcgcaccactgcactccagtctggtgacagagtgagactccatctaaaaaaataaaaaataaataaaataaatataaatactggactagaagacccaggagacccgaagattctctcaaaactaaggaaaataatctaggtcacaaatatattctctttctccttctccccattgcccccccctgccagtaatctttatagactcaaatagagttgatgttctataatcaattctagtcacttttatttatatttatttattttagagatgggggtctcactatgttgatcaggctggtcccaaattcctgggctcgagtgatccatccacctcagtctcccaaagttctgggattacaggcatcagccactgcacttggccatcacttttatttttgatgttcaaattataagctaatatctgtgagaccatagattctttttatgcactcaatacatttttgtgtttaccttacatttttattatggaaaagattctgttttttcgacttgtttctatttgataatgaagccctctgtgcctatcaccagcctcagccgccatcatctcattaccaagctgggttatttggaagcaaatatcttcaatatttagccagtgttcaaatttccccaaccatcctaaatgagtgtttagaatagttgtttcattggaaacaaggtcaaaacaagtacattttacatttttaggccagtcttgaaagtaagtgtaaaaccatgtgtggggtaggaggtgggactagcctctcaaggtggggcctgcataccagacccaattgaggactagctaagacagattccacaatgaataacaccaggaggtgggaatattaaggtccattgcaaaggttggctaccacaattatttgatcaactagttatcaaccctgactgcagctgagagagatttctttttgcttttttttttttttttcagagacagggtcttgctatgttgcccaggctggactcaaactcctgggctcaagtgattcttctgcctcagtctcccgagtagctgagactacaggtgtgtgccactgtgcccagcaagatattaaaatatacgtatgcacggacaccactctaaaccaactaaatcagaatcagatactgtgaagtcattaatcattttgctcctgggtctttttgacagttttgctcctgggaaactcctggcaatgtgttagagagaaagagatgggaaaataagattttaagaagtgttgctatgcattttgaaaataatttttctttggtgttggtcttgagggacggcggtaaacatttcaattgcctttaagtatgcttgcatgctggaatgatggttctctgaatgcagcaacgaactggcattgggccacatggcagccagtgtgagcctttatgccacatttataaaacatgaatgtcatgagcccactctcagggaccttacaatttggagggttaggtcagatccacaaatctcctctatctcatggtaaaggaaacctggcgtgtagcaggagatggtgtgataacaatgtcatattgcatgatcaatatttgtattcttcttggcaatattaaactttcggaccccctccattgtgtcatcaatttgcttaatacagtttctgcttcagcgtcggtttttaggcctggcataagctgtttgaaacccaagcacgtaccccgcccatcatctttggcctagttaacacctcccctccctgtgtggtggtttggagaacctgcttgttcctcatcccactgatcccaaacccaggacaccccacagctgctgaccaggattaaacctaacagagatttaatgcctttcttctgattctcagggactgacattcattcacttaaatacttgcagagtcagccaggcgtggtggctcacacctgtaatcccagcactttgggaggccgatgtgggtggatcacgaggtcaagagttcgagaccagcctggccaacatggtgaaaccccatctctactaaaaatacaaaaattaactggtgtagcagtgcgtgcctgtaatcccagctactcaggaggctgaggcaggggatttgcttgaacctgggaggtggaggttgcagtgagccaagattatgccattgcactccagcctgggcagcagagcgagactctgtctcaaaaaacaaaaaacccaaaaacttgcagagtgaatttaggaaaccatgaagtccagagtttgatccaatcccttcctttttctctttctcaaatattttgagccaggtactattctagattgtcttgtgatatttacaatctaggagaaggcaggagagagaactaagaacagagagcatgttctgagatgtctgctgtgcttgcaggtaccttccctcaatttccctgctcattggccatgctagaaagcaggtcttggcgccatatttgtaccatggtacttcccctccctatactcaattggttggccagaagcccaattgtcgttctctctctctctctctctctctctctctctctctctctctctctctctctccctctccctctctcctccctccctccctcccactccaagatatccagtaactgactgatcagctggtggtgggctctgctggctgccatgatgggccaccagcaagaagggaaaattggttgtgagtgagagaagcagagataaggaagtccacagggctgataggaaagaccatgggctgccgggcacggtggctcacgcctataatcccagcactttgggaggccaagacgggcggatcacgaggtcaggagatcgagaccatcctggctcgcatggtgaaaccccgtctctactaaaaatataaaaaattagccaggtgtggtggcgagtgcctgtagtcccagctaattgggaggctgaggtgggagaatggcatgaaccccgggaggtggagcttgcagtgagctgagatcgcacgactgcactccagcctgggcgacagagcaagactgtgtctcaaaaaaaatgggcttctgagagccagaaagaggcattttggtttctgtaactgcagtttccattctctcatggcctctcatttatttctcgtgcccatgagtttgcctattagagataaggtgtgctcctttccctccagctcatgcaaatggatttctgtttcttacaatcattgttcccagatatggatggtgactgatgctctactaaatgctgaaaaaaagcagagtggaagcacagaaaagagggcttctctgaggaggtgacgttagagcccagttggaaggcaggagtaaatgtgcaccatgattttttaggattaaaaccaagtatctcactgcttgggcacatgtagatagaggtgatttaagagtaaactgtcccagtggtacccattgtcagttacctcaccacagggattatgtagccctgagtttgcttagtgcttatttattttaggttgttgtttatccaaacctcttaaatggtaagcgtttcaaacaagtgacagcatcgttcattgatgttgtggacaaaccactattttattactcaagactgggtaatttataaagaaaaagaggtttaatgggctcacagttccatgtggctgaagaagcctcaaaatcatggtggaaggcaaaaggcacatcttacatggtggcagacaacagtgatgagagctattttagtcattgttcactggccatagaatttacttctatattttgaactaagacaagagccaggcacacaagaccgttacaggtctgtcttttgtttttgatgatgatgatgatgatgatgatgaaatggctgacatggttcatgacttgctttttctcatcatctcagacctagatttttggctggactattgtcttgagatagatgaaaatcattccttgtatcccctgatcttaaagtcaagactgaaccagcctccagacgcaagccttcatggggcttcagataccatgaggaatgggcgtccctgcaatattgtcatggctgtcaaaagtgttattggagctgggcaagtgggcgctctcctgccactgcatcctgcttagattttccattcaacatcaatcttatttcctttttttttttttttttgacagtctcactctgtctcctaggctggagtgcagtggtgggatctcggctcactacagtctccacctcccaggtttaagtgattcttgtgcctcagcctcccaagtagctgagattgtgggtgcacaccatcaagcgtggctcgtttttttttttgtatttttagtagagacagggtttcgccatgttggccaggctggtcttgaactcctgacctcaagcgatccacctaccttggcctctcaaagtgctgggattacaggtgtgagtcaccgtacctggccccatttcctcttataccataagtcattgcccgcagatgtgttttctccattagtttgcaaaagcttccggagagtaggtctgtgcctcatttattctggaatcttcctggcacaaagcacagggctttatcctcagtaggcatccaacaaatgtttaatttcattcaacagctcctcttaccactgcccccaccttatttgcaggtggctaagtacaatcagaacaagtaggtatcataagatttagtccagagtcaatccgggaagaaattaccttagtgatgtgaaaagaaaccaagctctttagtcagaatgtttctgagagtatcccctgtccaagcatttgcggaatttcgatctactaattttcaggtggaacagtatggttgcagagtccatttggacatagatacactttcatgcattcatgtctttaacaataatttgtggccctactgtgtttgttcactaactcctttgaacctaccatataagctatatatttcccttgtaatttgggaggtccaatgcttcattaagctcacatgcctgaaactaatgaagaaaatagctcgttaaccagctagtataaaaatagccaccaaaacaagtcaatcacccgccttaaatcagctcattactcccatcttgagtggagaagccctttctgaatcacattcaagacactgatggaagaacagctctgtctgggtatcaaaaccacgctcaccccacatcctcttccccagagttctactcatttctcacccactgaacccagaacaaaccagaagtgcttgaaatgaggacgggtagctccgtgtaccaattggaatttaaaactatatcaattcctgctatagaaatgaggcttctccccaggaccagcattccatgaaggcagcccttctctagatggagaaatagaacctgaaggcacccgtttccctaaactgctcttgctcatgtgtaagtacaaatgaaaaatgctgaggctgcttctgttggcattgctttataattacggccatcaataaatcattttatccttgaacaagacttgagaatggcccgaaggcagaggcatgattccttaggaattaggccaacagagaatgggctatctctcttcccacctcttctcttactctgctgtcagaaacagaaaagttctctgtgagtagctgggagcagacggcggcactcgagttccatctgggggttctgttgacacagttttaccccagcctgccttgatggccactgccacacaagctgcatctgttctttcttctgcgccttttgttacttcgttatttttcctctttctagtgtagtgagctgaatggtggatttgcacaagatatatccagatccttgtgcctagaatctgttgaggtggcattatttggaaaaagggtctttgcagatgtaattaagttaaggatcttgagatgagattctcctggggtattttaggtaggctgtacatctaaagacaagtgtccttataagaggacactactgtccgggcgcagtggctcacacctgtaatcccagcactttgggaggccgaggcgggtggatcacctcaggccaggagtttgagaccagcctgaccaacatggagaaaccccatctctactaaaaatacaaaattagccgggcatggtggcgcatgcctgcaatcccagctactggggaggctgaggcaagagagttgcttgaatccaggaggaggaggtggcagtgagctgaggtcatgccattgcactccagcctgggcaacaagagtgaaactccttctcaaaaaaaaaaaaaaaaaaaaaaataggacactctttttcatgcacgtccgtgtgaagagaccacaaaacaggctttttgtgagcaataaagctgtttatttcacctgggtgcatgtgggctgagtccaaaaagagagtcagcgaagggagataggggtggggccattttataggatttgggtaggtaaaggaaaaaggggtgctctctggcaggcaggagtgggggtcacaaggtgctcagtaggggagcttttgagccaggatgagcaaggagaaggaatttcacaagataatgtcatcagttaaggcaggaacaggccattttcatttattttatagtggaatgtcatcagttaaggcaggaaccggccatctggatgtgtacatgcaggtcacaggggatatgatggcttagcttgggctcagaggtctgacgttcctgtcttcttatattaatacgaaaaataaaatgaaatagtggtaaagtattaggatggtgaaaattttttgggggtggtatggagagataatgggcgatgtttctaagggctgcttcaagggggattaggggtggcatgggaaccttgagtcgagagattaagctgaaggaagattttgtggtaaggggtgatattgtagggttgttagaagaaacatttgtcatttagaattattggtgatggcctgtatacagttttgtatgaattgaaaaactaaacggaataagagaaggagaaaaacaggcattaaaggacgaagaattgggaggacctaggacatctaattagagagtgcctaaggaggttcagcatagccttgccagcaaagattatttatttaagagttaagagtggtggtttggggatagcaccaggagatatcacctgtgatggcttggagaaacagtgtaaaccaccagtgtaaacaagagcagggcatatatgagtagttgagaacggtgaatagaagtatgactagacagaagacagtagggatgacaagttttttggggcacagtccaagttggtcttgtgtctggaatgagactggggcctaataaaaaggagcgtctatacaggagctcaagtgggctgtaccttatagcattccaaggacaggcctgacttctgagaagggaaagtggtaaaagtattgtccagtcctttttacgttggtggctgagcttggtaagatgtgtttttaaaagaccattagtctgttctacctttcctgaggactgaggactgtaagggatataaaggtttcactgaataccaggagcctgaaaaaatgcttggctgacttgattactaaaggccggtctgctatcagactgtatagaggtgggaaggctaaactgaggaattatgtctgacagaagggaagaaatgaccttggtggtcttcttacaccctgtgggaaaggcccctacctatccagtgaaagtgtctacctagaccaagaggtattttagtttcctgactcggggcacgttgagtaaagctaatttgccagtcctgggtgggggcaaatccctgagcttgatgtgtagggaagggagggggcctgaagaatccctgaggagtagtagaatagctgatggaacactgagaagttatttccttgaggatagatttccacgatggaaaggaaatgagaggttctaagaggcgggctagtggcttgtactatagcatagcctgcctttgctggtgtgtggcgattaggcctggtggaactgccatcaataaactaagtgtgatcagggtgagaaacagagaagaaggaaatgtggggaaatggggtgaatgtcagatggatcagagagatgaagtcatgagggtcaggtgtggtatcaggaataatgtgggaggccggattgaagtccgggccaggaacaatggtaattgtgggagactcaacaaagcgtgagtacagctgaaggagccagggagcagaaagtatatgtggcaggtgtgaggaagaaaatagattttggaagttatgagagctgtagagagtgagttgagcatagcttgtgattttaagggcctttaaaactattagggtggcagcagctgcttcacggagacataatggccaacctaaaacggtaaggtcaagttgtttggacaaaaaggctacaggacgcgatcctggtccttgtgtaagaatttcaactgcacagcgctgcacttcggctgtgtgtaatgaaaagggttgggatgagtcacggagagctagagtagcaggacgagttgcagacaaaactcctcagacaccggattaaagaaggaagaggtttttttattcggccgggagagtcagcagactcgtgtcttaagagccgagctccctgaaaaagaaattcctagcccttttaagggcttacaactctaagggatctacccgaaaaagtcataatagatcaagtaagcgtgagaaatgtgactgggggctacaaacatcagctaacagaacaaaaagtttttacagtgctttctcatacaatgtctgggatttacagataacaccagtagttttggtcaggggttaatattattgatattttaaccaccggggccaggtggtggcgccgagggcgtctagctatttattttacttctgttttttccagctttttgctttctcccttttttcctgtcttataaactagggaaaaagggaggttggggaggaactgggaaggacagcaggagacgtggtggtctcacaccatatttccctcctttgagaattttcacttttagtgggagttctcgctctcatctttactttttgagtctctctgtgagattgaacgatagtgatttatataatacacctgtgctgaagttttctgatgaatcaaagtagcaacaaaaccttttgtcatttgaaaaagcgagggtaatacacgggggagcagcaagcaagctcctatcactagcaatacacctacaatgaggggtttaaatcctcctatagctggaaaccattttccaaataaagactcagggttaaactcgtgccaaatctgtaaaggcacatgtgccacctttgtcatgtccctgactatccttgatcattttaacctcctatccttgatcatttatttgtaggcagcaattggttaagttaaattttccacaaactcctccttcagctactaacaagtagtctaaggccagtctattctgatagatagcattcctcatttgggtttcttgccaagctaaaacagtcaaagctctgccagtttcattagtaattatttctaagacagcctgcaaccgtatgatccaattgagcatgtagatgggggttcggtatccccatgagccatcttgtgcccatgtggcaggcccataatactgtatgatcctttcagggggccactcattatctttccagtttcctataactatgcctttcttttctcgggaagtatagacagggaaacctagcagcttacctgtttttatgggtaataagaaaaaggacggcttaatagtgccaataacacaactgcctgcccatttattaggtaactgaaagtaggctctgtgcctacatatctagtatagtccagagggaactgtccagtcctgatgagattctggatgagccaaagcagtttgtaatttagaaaatttactaaatggattcttttcagtgtggtttaggccctactaagtaattgtctttgttgtgctgttatacaacttctgtcctatacaattaagctttcctacagggatgataaagtctttcccttctctagctatacagtattgtctaataattgaggtttttggacctagaagttgctagcttgggccttctgaactggaattatatcaggagctggatcagtaggcaccaactctcgggcttcccaaggccatctgtctccgacagtggttcctccgcgtacataacaagaagtaacattaagggaatgagctacattttctgctaattggagaaacaaattttttgtctttttcggaagttctggtgctggcagattcagctcctcataaaaggtttgaaatactggttttgggagagcacttgtggacctcccctctaattaaaatggcaacttgagggtttaaccctgtcctattgatccccagggttacacgttctccctttttccaacggggatctagggaatggtaattattagttctagtgggttacagtgactggcagcacaggaggggttggcttcccccttctgaagataaaccgggtcctttttgttcttttttaaagtagcctaaataacacatgtccaatagccacaattttcacaaacccctgactcatgacaaacatatttattttctactctttagctcctttcttaattaagagaaccacatcctatttctagctgtttactattaatggctgcacaagcatcaaatcttaaagttatttgcttggggatttctttttcttctgttctagttattattttacttgtatcacctaggaaaaggccagttcttattcttttttcaaaaacggcggttgcagggggctcagatgggttataacacacatcaggtcggtcatttcttcggctacataccttgtactgagtggcattatacaaacaagtttcttttaatgttcccatacattcataactatagaacagaaagattgttttaatttgctgtcctacttcggtgacctgatgaatacactgggaacagtccccagtttgagtaaggtcagttgaagcccttactgtataagtccaaaatttaagaaaaatgaatctcatgatgagcttcctcaggcttcggccgtgcgtggaccagtcagcttctgggtgtgactggagcagggcttgtcgtcttcttcagggtcactctgcaagggttgtctgggcttggtcttgcctcccaggtttcaggccctgcaggttttatatggctgtgttggatccaggctgggattccttctaccttcacagcggtgggagtgctcaggacgatagtctggggtcctttccaccgtgggcacaaagaggctactttccagtccttgatccacactcgatcatctggggagaaagggtgaactggggagaataagctaacagggcatctctcatttacccaggctgagattgtttgtgtaatttttcataaggcctgtagctgtcgctgtaactcaatttcacctaactctcagggagtgcctggaagtccccgcaatataggagggggcctacgatataatatttcataaggggaatatcctgttcttttagaacgggtacatctaattttaaataataccatagggagagcctgtagccattttaatcctgtttcctgacatactttccctaaactatttttgatagtttgattcattcgctccacctttctgaaactctgaggccagtaggcagcatgcactttccatgtgatccctaacatctttgccaccttctgtactaagtcagccacaaacgccggcccattatctgagctgatccataagggcagtccaaatctaagaataggatctcgaagaagcacacgagttacttcacgaggtttctcagttcgtgttggataagcctccacctaccgagagtaggtgcgcccaagaactagtaaatacttgttacctctacactttggcatctcagtgaagtccacctggagatcttcaaagggggctgctccataagcttgtatgccgggtggaacggctggaccttgcctcgcattatgctgtcggcaggtaacacaccactgcgtcaccgttttggcaaggcctgacaaatgtgagatgtagaaataccagcctaacaacttttcaagtgattcctgacctcaatgggtggtttcatgcacagccagtacaactgcagctcctggcagctgtggcgcagctactctcccatccggtaaccgaattcatccttcctccatcacttgtcctccctctgcctggagaaagtccttttcttctttagaataagtaggtacaagatcaggtgcttgagggagcaggggggctgtgactgatgcccggaatggggcagatgctgcttttcgagcctctgagtcagcgcgggaattccctaaacccaccaaggtggaagctcgctggtgtcctctgcaatgcataactgccaccttgtggggtctccatactgcttttaataattgcaagatttcttgttgatattttatgtctttccccccagagttcaataggcccttttctttatataatgctccatgcactagaagggttaaaaaggcatattgagagtcagcgtaaatgttgacattcttagcttcactgagttctaaggcccgaattaaagcaatgagttcagctttctgagctgaagtgccctggggaaacgatctggcttcaacaacagtgtccagagttaccaccgcatatcttgcacatctctctcctcgtgggttgatgaagctgctcccatccacgtatagttcccagtctactgatgcctaaggctggtcctggaggttaggtctgctagagtaaactgagtccaacacttctacacagtcatgctcaacagggctctctgatactgggagcaaggtggcggggtgcagggtgttaaaaacttcaatggttatacggggattttcacagagcaaagtctggtacttggtgagtctggcattcgttagcccatgatgtcctttagtattcattaaagtcaccacagcacgggaggcctttatgttcaggttctgcccaagagtcagcttatttgcttcttgtactagcagggcagttgctaccaaggccctcaaacacgggggccgtcctttagaaaccctgtctagttgtttagagaggtaggccacccaccttggccagggccccacagtttgggttaaaactccaactgccatcttttctctctctgacacatacaatggaaaaggctttgttagatcgggtagccccaaggctggggctgacataagtctttcctttaactcatgaaaggcttgctgttgctgggatccccattcaaaaccttcccggttcccccactttgtgacctcatacaaaggcttggctaatactgcaaagtttgggatctacagtctacaaaaccccacagcccttaagaattctctcacctgccttctggtcttaggctccggtagattgccaatgacctgctttctttctgatcctaggctgcgctcccccttcggatagtaaatcctaagtaacgtacctgctgtcggcagatctgagcttttttcttggacaccttatacccacagtcctccaggtgccggagtagaatatctgttcccttggcgcacccaactgccgtggggtgtcccagcaaaaggtcatcaacctactggagcaacacgcagtctaggtctctggtgggaaatttctggaggtctcgaggcaatgcctccccgaagatggtggaggagttcttgaacccttggggaagccgggtccaagtgtactgagtagtgacacctgactccggatcttcccactgaaaggcaaacagcttctggctctctggggctaatctgaatctaaagaaagcatctttcaggtccaagcaggtgaagcagctgttctcagctggcagcaaccccagcaatgtgtacgggttaggtactgctggatgtaaagtcactgtagcctgattaaccaagtgcaaatcctgtacaggcctgtagtccttggtcctaggcttgggaacaggcaggaggggagtgttccatggagactgacaaggaactctaattcgaaaagttcttaggtgcttgagatggacctggataccttcaggagcttctctggggaccggctcctgtttttgcctaaacggctgggccctaggcttaacttctataagtatgggggcttggttgactgccaaccctggagggttgtcttccgcccacactcttggccactgcttagccagagctggtcttatctcttggcccaactcagttaagaaaaatctccattcctcctctggggggaccataagggttataatgactcccgttctgggtaactttagcagcaaaaagccatgctctgtaaaagagatagtggctctcagtttgctaagcaagtgccttcccaataagggcaagggacagtcaggcgtggacaaaaactgatgaatcactttatgtcctcctacagtagaagtccggggcaagcagaaagcttgctttgctgaaatccttttggctccgatgacgtcaataatctttttgtataagggggctaccggcgcggttactactgaatgtttagcaccggtatctacaagaaaatcaatgtctttacccctaactgtcatcctgacaataggctctttgggtgtccttgagccctgtccccctcagtccaataacccttctgccaggttgagcagggtcccttcctccttgtctggagcctcttgctccaagtcaccttgttttctttttagctgagggcattttttcttccaatgtcctatttatttacaataaacacactgattacgctgcaagctctgacagccaggctgagtttccttcctgggaccccccttcccttgcctcttttgggggacccttttgattgctgccgctaacaggtcggcatttcgctgggcctgatgtttcttctctctgcagttttccttacggcttgctgcatctctgtttacaaacacctggttagctatttctaataactgtgatgtgttcatccctgcaaacccagcctgattctgcagtttttttctaatgtcttctgtgctttgactaactaaagccgtgttaataatgcattggttttcagggctatggggatcaaagggagtatacataccataggcctcacagtctctcctagaattgtgctggactttcttcttttctctgaattacctcagagaccttgttaacgtttgtggcctcctgggttcccctctttaatccttccaagagagcttccctgtatcggtttagcctttgcatatcctctctttcatttgggtcctactgggggttggttcccagtaactgggtccttccatactcttgggggttttggtagtcagctggtgcatgttcctctagccacttagttgctgcttggagcactctccgcctttcatctgtgttaaagaggaacatgagcaactcgtggcaatcagcccaagtggggttatgggtctggataatagtttggagcaaatcaatcagagcttgtggctttttggtataggatggggtattgttttcccagttgagaaggtgggcagaggtgaagggctggtacacagaaacacgcctccccaccacgtggccatcctcatctatcccagtataccgctgttctcacaggggcatttgtatccccgttttgagtcttaaacgagctgccaagggaggggtttctcctgagtcctcacctcttctcttgtatactctgggtggcctagggatatgtttgtctcgtggaggcacaagcaccgtggactcaaaagtggggagcctctctccctggtaaggggagggcaccactgggatcactggtgccatctcctgcagtgcatcttctgatgttgggtcgaatagaacttcaggagttgatttccctcagcgggtggagcgggatccttccttggctatctgtccctttgctactagcactgctgctgcctgcccccttagccactgtggggggtttagcatcagctgtaaccaagtgtctatgtatggaaactggtctgagtgtcctgacttaccagttaccttgtgccataccttagaaacaagggacctgtccaggcttccttctgatggccatcctacttctaatattggccaatctattttacacaaagttctaagtttccctggtgtcatagtaaccccatagtctccattaaatcctttcttaaaatttttcaacatagttcctagcagagtaggcttactttgtgtctgacccacgtttcctcgagacaaaacaccaagctcacaccacacgcacacaacagaacaaagaatgggtaaaaagggcacacacacactttttcagttttcaccaaaccagaatcaaaaccaaaatcagagtatccagaaatccaagccaggtctaaccaaaaccaaagtatcaagcaattcaagtcaagtcaaaaacaaaaaccaaagtgccagtacaggcacgccgtgggtgatcaggccacacttccactcagatagagtgggcaagttccaaagaccagtcttaccaagtttcaaatgtccggactccaagtgcctgttccttcccagtgttcacccactgcgtcgatcctccacgggggcctaccacacactgctctgacgaggcattccaccgggtcaattgcctacttgggagagctctcagtatccgtgtcgctcaagctggcaggagtcccccgcagggatgctccacagggcaggcctaagccgcctaaagtgctgcctcaactgtccgccaattacctcgcttcccggtcaggtaaccaagactagggtgggggcagtctttaaagctgtcttcaaggaacagaaaggggagtggggaaaggatttaggatctatggggtcagctaggtttccttttgtgagtttatataatggttttgttaggatggcaaaaccaggtatctaaaggtgagagtgtctaaccatgcccaggaaggaaaggagttgttgttttgtagaagggtttggggtttgagagatgagtcacacacgatcggcagggagagcacgtgtgtttttatgagaattatgctgagataggtaacaggtaaggaagaaatttgggcttgactgaagtaatgggggctgtctgtgaagctttgcggcagtacagcccaggtaatttgctgagcctgataggtgtcagggtcagtccaagtgaaagtgaagagtggctgggatgaaaggtgcaaaggaatagtaaagaaagcatgtttgagatccagaacagaataatgggttgtggagggaggaattgaggataggagagtatatgtgtttggcaccttggggtggatgggcaaaacaatttggttgataaggcatagatcctgaactaacttgtaaggcttgtctggttttaggacaggtaaaatgggggaattgtaaggagagtttataggctttaaaaagccatgatgtagcaggtgagtgataacaggctttaatcctttcaaagcatgctgtgggatgggatattggcattgagcggggtaagggtgattaggttttaatgagatggtaaggggtgcatgataggttgccaaggagggagtagaggtatcttctacttgtgggttaaggtgggtggcaatgagacgtggctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggctgtcaatacccacaacagttatggagggaagggaaacaggcccttgaaaagaaggtaatgtggagtgggtagcctccgtattgattaagaaggggatggacttaccctccactgtgagagttacgtagagcatctgtgatggtcctgtaggcttctgaggcaatcgatcgggcattgtcagtcttcagctgctaagccaagaagatctgggaaggagtcagtcagagagccttgggctggagttccaggggctctgggagtggctgccaggtgagttgaacagtccaatttctagtggggtcctgcacagatgggacatggctcaggaggaatcctgggctgcaggcattccttggcctggtggccagatttctggcacttgtagcaagctcctgggagaggcggttctggaggaatgcctggccactgcgctttagccgtttggaagttcttgtgtgctggagatttggctggggtttgtctcacagtggaggcaaggaattgcaactgagaaatatgttgctacttggctgcctctgctctattattgtacaccttgaaggcgaggttaattaagtcctgttgtgggatttgagggccggaatttaatttttggagttttatttaatgtcgggagcagactgggtaataaaatgtatattgagaataagacggccttttgaccttttagggtctagggctgtaaggcaactcagggttgctgccaaacgagtcatgaacggggctggatttttaaatttgatgaaaaagagcctaaacgctatctgatttgagaaaaagaaaaaggagcattaaccttgactatgcctttagctccagccacctttttaagacgaaattgctgggcaggttggggagggctggtcacagaattaaactgcaagccagatccagtgtgaggaggggaggtgataaaaggattatagggtggaggagcagaggctgaggaagaattgggagctagctcagcctggcgaggaggggagaggtcagatgggtctgtagaaaaggaagattagaaagactcagcgacactaggggttgggactgaggggacaggtgggagggaaagaaggaagatttgggatgagttgcattgggaacagagactagggagggaccaatgtgtaagagaatacctggacatcaggcatctcagaccatttgctcattttatgactagaattatctagatattgtaggatggaaaatttgaaagtgccgttttctggctatttgaaaccactgttgggtttgtattggggtcaagcggcattgtagaagaaaataaggcatttaggttttaggtcaggtgtgagttgaagaggttttaggttttgaagaacacaggctaaggagaagaaaggggaatggaggatggaagcttgcccatagtgaaggaggcaagcctagagaaaagagacagtagagacatggagagaagggatggggggttcttgccttccagaaaagagggaaaggggttggggcacagaaataaaaggttggggtgcagagataagaggtcaggttgtggaaataagggatcggggctcagaaataagagggcgggcatggaaataagggatcagggcacagagataagaggtcagggcatgaaaataaggtatcggggtgcagagataagaggtcggggttcttgcccctcccccagaaaagcaggacttgctgctaagggtgaaggaccaaggcaggcatccctgcgtggtctgacacctctgaaacctgggtgaataatcagagaggcgtccctgcaatgattaaacaccaagggaaggctgccttccctagtccatgaccagcgccggagtttcgggtccacggataaaacgtgtctcctttgtctctaccagaaaatgaaaggaattgaaattaagagaagggagatattgaagtgtgatgccaagattggaaggagaaagaggttgagggatagtgagggaggttggagaagagagtaaaaagaagccgcttaccagatttgaaattggtgagatgttgcttgggctggtcagtctgaggacctgaggtcgtaggtggatctttctcacagagcaaagagcaggaggacaggggattgatctcccaagggaggtcccccgatctgagtcacagcacctaatttcacatgcatctgtgtgaagagaccaccaaagaggctttgtgtgagcaataaaactgtttatgtcacctgcgtacaggtgggctgagtccaaaaagagagtcagtgaagggagataggggtggggccattttacaggatttgggtaggtaaaggaaaaaggggggttgttctctggcaggcaggagtgggggtcacaaggtgctcagtaggggggcttttgagccaggatgagcaaggagaaggaatttcacaagataatgtcatcagttaaggcaggaactggccacctgggtatgtacatgcaggtcacagtggatatgatggcttagcttgggctcagaggcctgacactcttcctccagaggaggagacccagacagaagaggaggaggcaaggtgatcacagaggcaaagaatggatcatgcagccacaagttgaggaattctagtagcctctacaagctggaagaggcaaggaatggattcacctctagaacctctgaagaagcatgctcctgctgacatttgattgattttggacttctggcttccagacaattttttttttttttttttttttttagacagaggcttgctctgttgcccagtctggagtgcagtggcacgatctcagttcactgcaacctccgcctcccaggctcaagccattctcttgcctcagcctcccaagaagcagggactacaggtgcctgccaccatgcatggctaatttttgtatttttagtagagacgaggttttggcatagtggccaggctggtctcgaattcctggcctcaagtgatccacccacctcagcctcccaaagtgctgagattatttaggtgtgagccacggcacccggcccagacattgtttgaagccacccatttcatggttctttgctgcagtggttgtggaatatgaatgaactcgtgctgttggttagactttgctgcccttgtgtctgttattccctggcagttctacaaggcctggagctgatacgaaaaacctcccttctttccctaatggtccccagcttccccgttcactgaaggccctgcagtcaggaacagtcaggactttgcacccagttgttgtgggtgtttggccgacccttcctctagtgtgattcatggacccacagcattgcgtcaccagggagcttttggaattgaagactctcagggctcacccggaaggacctgctgggccagaatctgcattttaacaagatgcccacgtgatttgcatacacgttcagatctgagaagcgctagtaggagaggctttaaggtggtaattagatcttttctccacctgcaagaatcttagtttcttcatgttaaatcaattaagtgtggcaatgtcatgggtgttataaaacaaaacaaaatccttacatcaagaatgcaccctggcgtgttatggatgtgggtgaaatgaaatgtctggaatttgctttaaaatatcctaaaatagcaagaaggaaaagaaaagtgggaactggaatgagattggcgaaatgttgacaagttcttgcagtgggatgatgggtgcatgggggttcatcgtgcaattctctccctgctttttgtgcgtatgggaaatttccataatgaaaagttagaggtcgggcacggtggctcatgcctgtaatctcagcattttgggaggctgaggtgggtagattgcttgaacctaggagttcaagaccatcctggacaacatggtgaaaccccatctctactaaaaatgcaaaaattaggcatggtgacaacatgcctgtagtcatgttgaggtaagagtttgagatatgagaatcacttgaacccaggaggcggaggttgcagtgagtggagatcgcagcatttcactccagcctgggtgacagagtgagacttggtctcaaaaaaattttcaattttcttttttttttgagatagggtcttgcttttttgcccaggctggagtgtagtggggtgatcttggctcactgcaagctccacctcccgagttcactccattcttctgcctcagcctccagagtagctgggactataggcacccagcaccatatccggctaattgtttgtatttttagtagagatggggtttcaccgtgttagccaggatggtctcaatctcctgacctcgtgatctgcccaccttggcctcccaaagtgctaggattacgggcatgagcaatcgtgcccggccttaattttgtttaatttttttcttttttgagacaagatctgtagcccaggctggagtgcagtggtgcaatcccggctcactgcagcctctacctcctgggttcaagcgatcctcccacctcagcctcccgagtagctgagaccacaggcgtgtatcatcacacctggctaatttttttccctttttctagaggcaaggtcttgctattttgcccaggctggtcttgaactcctgagttcaagcaattttcccgtctcagcctgggagtaatcccaaagtgctgggattacaggtgtgattcactctatccagcctcaactgtttttcatgactccactttttctcccctcttggaaatgagtagtctttgagggaatgtcattttgtctcaatctctggtttctttgctcagtgcagctgtgtttggggctttgttgatctccaggcctttttcagcagcgttgtccctggagagcaggatgggagctgatggcttctcagcatcttttaacctcagtttaaagatgactatcaacaacatctagtcagcatctgttgctctcggcagctgggacttcatttcctttctctttctccacctctctaacctctttaagactctggctttgtcaggggtacagcatcacctgtgtggcccttaggctctcttacttacatgtgatctgcgtattatgtctttacttcagggcttctcagccagggggtgattttgccccccagagaacatgtggccatgtctggagacaattttggtggttgcggctggaggaggtggtgctactggcagctaatgggtagaggccagggatgctactaaacatcctacaatgccccggacaactcccactaagacaaaagaatgatccagccccaaatgtcaatagtgctgaaagtgagagaccctgattccatcttagagatcatccaagcacacttggccaaattgtttttgctactgtcccatgaagaaaaggcagactcatgactgatggcaacatcgatgggagttttgcttacctcttctttgtggactttgggatacgatgacttaccgtttgtgcaagttgtgcattacatacctccagggggcgccacccacatatttatgaaaatgccaccccaggaattgcacagtacatagtctacgtggcaataagcagttgctctggttttggggttgccctggggtgctctggaactgggaggaattttatctctggccattagaggccctgagcgtgacattgagtatcctttcaagaaaggagaaatgttgaacagagaggacctcatttttataactcttgaccatcatctagttacggagcgtccacttttctcccctgggccatatccatttgacggatgaaaaatcatcaaattataatatcatggcttatacttttgatagattctgcccggaacatggcggtaagagcttctcattttcaattgattcattgggggagagaatatacacagctgtcctaagactttcaatgacacaccatttgcttgatgggatttctttagtttctgtagcataacttattctaactggtcctcaatcactttgcaataaaacctgagattgtgaagatgttcattgtcattaccagtgatggagcagtaagtacagagttctggagagagaaggaattgagagagttaaactagcagaatgagccgctcaccctcagaattgcttttaatcttggtgagaactgaggggaattttgacagggttcagggagactgcggggagtggggctgggaggtggctgtttgcacgtgtggtcagcaaatccagtgaggggttcatgtactgtgggcagccccgcagatggagttgggattgccctggactgagtactgtgtcatcagtactcaagacatcgaggcccaggctggtgcaggagatacattgcactgtgtcagcctttcttctatcgctgctctccaatgacagtccccgattttccactgaggagtcactagtcccccatggcatgtgtgccactggctattccccaccctgatctggagctggggcatgtggtcccagcctggatgccagtgtccttccaccaccctggccacagtgattgggtctgagaagcagattagccaaaggagagacaatcttggaaatttcatgttcatgcttaagaaagtaaaatggaaagcggggggagggtgaggggtcattctgatgatatagttttaggacctggatgtagccacacctgtagctgtcaactctgtgctatagtactgcttttttttttttccttccaatttaaatactttctaaaggcaagatcttgctatgttgcttaggctggttttgaaaattccctttcgtggggatgctttctctgcttcacttcctttctatgacagctcagggaatcagaagacaagggagatgcctttttttttttttttttttttttgagacagggcttgctctattgcccaggctggagtgcagggttgcaatcacagctcgccacagccttgatcttctggactcaagcgaccctcctgcttcagcctcctgagtagctgggactgtaggtggctaccaccaagcccagctaattaattttttttttttagaaatgaggtctcactatgtcacccagactggcctcaaactcctgggctcaagtgatcgtcctaccttagcttcccaaacttacaggtgtgagcccccacaccagtcaacgctgtggtcttatgcacctggtgtcccctacgccctgagcaatgatcctcctgcttcaacctcccaaagtgctgggataacagatgtgaagcagcatgtgtggtccacatagtattcttacgggttaaattgagtcctcctcaaaacatgttgaaatcctaaattccagcagctcagaatgtgaccttatttagaaatagagttattgcggaccgggcgtggtggctcatgcctgtaatcccaacactttgggaggtcgaggcgggtggatcacctgagttcaggagtttgagaccagcctgaccaacatggagaaaccccatctctacgaaaaattcaaaattagctgggtgtggtggcccatacctgtaatcccaactactcgggaggctgaggcaggagaatcgcttgaacccaggaggcggaggttgcattgagctgagaccgcgctattgcactccagcctgggcaacaagagtgaaagtccctctcaaaaaaaagaaagaaagaaagaaataaggttattgcagatgctgttgattaggatgaagtcatcctggagtagggagggcctaagtcaatgactggtgtccttataaaagaggagaggacacaccgagtcacagagacacagggaagaaggccatggattggacagaagattggactgatgcgtatgcaaaccaaggaacactgaagactgccaggaaaccacagaaagctaggaagaggcaaggcaggaatccctgacaagtacaggagggaacgtggccctgctggcacttccatttcagactgctggccaccagagccacaagacaatcaatttctctggtttcaagtcacccagcttttggtacttggttgtggcagccctagggaatgaatataagtactttctttcttttttctttttttgagacggagtctcgatctgttgcccaggctggagtgcagtggcgggatctccgctcactgcaatctctgcctcctgggttcacgccattctcgtgcctcagcctcccaagtagcttggactacaggcacccgccaccatgcccagctaattttttgtatttttaatagagaagagatttcaccctgttagccaggatggtctccatctcctgacctcgtgatccgcctgcctcagcctcccaaagtgctgggattacaggcatgagccaccacacccggccgaatataagtacgtttaaattaactctcctcttctctccatcttcttctaaatcatcatttttgcctaagcaacagctagggtctaatacagatgtgacgactcacttgaaagtgggggaagcccccatgtgcacccaaagctcctgctgccttggccctgggttcagagactggaccatcattttggaggcttgctggagatctgagccagggcatcattctctgttgcctttaaacaaaggctggtgctctcccaggcatgtgagctccaccgaggatctatttggagggcagaattctgagatgaccccttaggttcttgccctggataaatgccaggtgtaatctcctctcccctggagtgtaggcaggacccgcgtcttgtttctaatctatacctatggaaaagttgaagggattttgcagatgtaactaagcccctaatccattcactttgagttaatcaaaagggagattattcagggtgggcctgacatctataggtgagatcttcaatgagggtctggaggagagagactccttcctcctggtttttgtttgtttatttgtttttgacatggagtctcactctgttgcccaggctggagtgcagtggcaaaatctcggcttactgcaacctctgcctcctgggttcaagtgattctcctgcctcagcttcccaagtagctgggattacaggcgtgcgcaatcatgcccggctaagttttgtatttttagtagagacggggtttcaccatattggccaggctggtctcgaactcctgacctcaggtgatccatctgcctcggcctccgaaagtgctgggattacaggcgtgagccaccatgcctggctggttttgaagaagccagccacatgagttccacagttgcatggaaataaattctgccaacaaccatgtgaggttgggagaagaccccaagcctcataggagacactaattcccgccaacaccttgatcacaaccttgtaagaacctgagcagagggcccagctaaagctgcacccccagactcctgacccacaggaaaggagagggaatagatgggtgttttaagctgctaaatttgtgttgatttgttatgcagcttagaaaatgaatacatcattccatttttaaaaaatcataagctaatcacaccactcgaattcttttttttttttttttctttgaaacagagactcactctatcgcccaggctggagtgcaatggtgcaatcttggctcactgtaacctctgcctcccaggttcaagtgattcccttgcctcagccacccaagtagctgggactacaggcatgcacaaacacacccagctaatttttgtatttttagtagagatggagtttcaccattttggccaggctggtctcgaactgctgacctcaagttacctgccttcctcagcctcccaaagtgctggggttactgacatgagccactgcacctggcctgacgtactattcaattttaaggaacttccaggttctgtggtcatgcccctcttgtgtggcatgcaggtggggagagatgggttggaagatgactggatgggggcatggagttaggtgggaagaggaaaagtgtcttgaaggaagtaagtcccttcagataagggagggagaagcttgatcaatatgcagactttcacagtccttcagtccttgggatattggaggagagacaggtcttgccttatatttgagagttaccatcccaggcagaggccctacttccaccttcttgcatgtggggctggggggcaaatacttagaggagaaacgaacaccctttgtaagtatgtgaaaagtttctggagtggagagatgatgaagcaggatatttggagtcaacagcaaaagtttttatttcattttttattttttattatactttaagttttagggtacatgtgtacaacgtgcaggtttgttacatatgtatacatgtgccttgttggtgtgctgtacctattaactcgtcatttcacattaggtatatctcttaatgctatccctccctcctccaccgaccccacaacaggccccggtgtgtgatattccccttcctgtgtccatgtgttctcattgtttaattcccacctatgagtgagaacatgcggtgtttggtttttcgtccttgcaatagtttgctgagaatgatggtttccagcttcatccatgtccctacaaaggacatgaactcatcattttttatggctgcatagtattccatggtgtatatgtgccacattttcctaatgcagtctactgttgttggacatttggcttggttccaagtctttgctattgtgagtagtgctgctataagcatacgtgttcatgtgtctttatagcagcatgatttataatcctttgggtatatacccagaaatgggatggctgtgtcaaatggtatttctagttctagatccctgaggaattgccacactgaattccacaatggttgaactagtttacagtcccaccaacagtgtaaaagtgttcctatgtccccacatcctctccagcacctgttgtttcctgacttgttaatgattgccattctaactggtgtgagatggtatctcattgttgttttgagttgcatttctctggccagtgatgatgagcattttttgacgtgtcttttggctgcataaatgtctgcttttgataagtgtcttttcatatccttcatccagtttttgatgggttgtttgtttttttcttgtaaatttgttggagttcattgtagattcttgatattagccctttgtcagatgagtagattgcaaaaattttctcccattctgtaggttgcctgttcactctgatggtagtttcttttgctgtgcagaacctctttagtttaattagatcccatttgttaattttggcttttgttgccattgcttttagtgttttagacatgaagtccttgcccaggcctatgtcctgaatggtattgctgaggttttcttctagggtttttatggttttaggtctaacatttaagtttttaatccatcttgaattaatttttgtgtaaggtgtaaggaagggatccagtttcagctttctacatatggctagccagttttcccagcaccatatattaaatagggaatcctttccccattgcttgtttttgttaggtttgtcaaagatcagatggttgtagatatgtggcattatttctgagggctctgttctgttccattcgtctatatctctgttttggtaccagtaccatgctgttttggtaactgtagccttgtagtatagtttgaagtcaggtagcatgatgcctctagctttgttcttttggcttaggattgacttggcaatgtgggctcttttttggttccatatgaactttaaagcagttttttccaattctgtgaagaaagtcattggtaacttgatggggggatggcattgaatctataaattaccttgggccgtatggccgttttcatgatattgattcttcctactcatgagcatggaatgttcttccatttgtttgtgtcctgttttattttgttgagcagtggtttatagttctccttgaagagttccttcacatcccttgtaagttagattcctaggtattttattctctttgaagcaattgtgaatgggagttcactcatgatttggctgtttgtctgttattggtatattagaatgcttgtgatttttgcacattgattttgtatcctgagactttgctgaagttgcctatcatcttaaggagactttgggctgagacaatggggttttccagatatacaatcatgtcatctgcaaacagggacaatttgacttcctctttttttaattgaataccctttatttccttctcctgcctgattgccctggccagaacttccaacactatgttgaataggagtggtgagatacggcatccctatcttgtgccaattttcaaagagaatgcttccagtttttgcccattcagtatgatattggctgtgggtttgtcatagatagctcttattattttgagatacgtcccatcaatacttaatttattgagaatttttagcctgaaggttgttgaattttgtcacaggacttttctgcatctaatgagataatcatatggtttttgtcattggttctgtttatatgctggattatgtttactgatttgtgtatgtcgaaccaatcttgcatcccagggaggaagcccacttgatcatggtcataagctttttgatgtgctgctggattcggtttgccagtattttatagaggatttttgcattgatattcatcggggatattggtctaaaattctcttttttgttgtgtctctgccaggctttggtatcaggatgatgctggcctcataaaatgagttagggaggattccctctttttctattgactggaatagtttcagaaggaatggtaccagctcctccttgtacctctggtagaattcagctgtgaatccgtctgttcctggacttttttttggttggtaagctgttaattattgcctcaatttcagagcctgttattggtctattcagagattcagcttcttcctggtttagtcttgggagggtatatgtgtcgaggaatttatccatttcttctagattgtctagtttatttgcgaagagttgtttacagtattctctgatggtagtttgtatttttgtgggattggtggtgatatcccctttatcaatttttattgtgtctatttgattcttctctcttttcttctttattagtcttgctagtggtctatcagtttttttgatcttttcaaaaaaccagctcctggattcatggattttttgaagggtttttggtgtctctatttacttccgttctgctctgatcttagttattcttgccttctgctagcttttgaatgtgtttgctctttgcttctgtagttcttttaattgtgatgttagggtgccaattttagatctttcctgctttcttttgtgggcatttagagctataaatttccctctacacactgctttgaatgtgtctgagagattctggtactttgtgtctttgttctcattggtttcaaagaacatctttatttctgccttcatttagttatgtacccatagtcattcaggagcaggttgttcagttttcatgtagttgagcagttttgagtgagtttcttaatcctgagttctagttggattgcactgtggtctgagagacagtttgttataatttctgttgttttacatttgctgaggagtgcttcacttccaaatatgtggtcaattttggaataagtgcagtgtggtgctgagaagaatgtatattctgttgatttggggtggagagttctgtagatgtctattaggtccgcttggtgaagagctgagttcaattcctaaatatccttgttaactttctgtctccttgatctgtctaatgttgacagtggggtgttaaaatctcccattattattttgtgggagtctaagtctctttgtaggcctctaaagacttgctttatgaatctgggtgctcctgtgttgggtgcatatatatttaggatagttagctcttcttgttgaattgatctctttaccattatgtaatggccttctttgtctcttttgatctttgttggtttaaagtctgttttatcagagactaggattgcaacacttgccttttttttgttttccatttgcttggtagatcttcctccatccctttattttgagcctaggtgtgtctctgcacatgagatgggttttctgaatacagcacactgatgggtcttgactctttatccaatttgccagtctgtcttttaatcggagaatttacccattgacatttaaggttaatattgttatgtgtgaatttgatcctgtcattatgatgttagctggttatttcgctcattagttgcagtttcttcctagccttgatggtctttacaatttggcatgtggctggtaccaatttgcagtggctggtaccagttgttcctttccatgttcagtgcttccttcaggagctcttgcagggcaggcctggtagtgacaaaatctctcagcatttgcttgtctgtaaagtattttatttttccttcgcttatgaagcttagtttggctggatatgagattctgggttgaaaattcttttctttttttttttctacagtgatgactttattttatttttttatatttcttttttaaaattaattaattaattaattaatttattttttaattgatcatttttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgtgggtaaggtcacagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaactgccattgtcatcatggcccgttctcaatgagctgttgggtacacctcccagacggggtggtggccgggcagaggggctcctcaattcccagtaggggcggccgggcagaggcgcccctcaactcccggacggggcggctggccgggcggggggctgacccccccacctcactgctggatggggcggctggccgggcggggggctgaccccccccacctccctcctggatggggtgctggtcgggcggggagctgacccccccacctccctcccggacggggcagctggccgggcagaggggctcctcacttcccagtaggggtggccgggcagaggcgcccctcacctcccggacagggcggctggccgggcggggggctgacccccccacctccctcccagacggggcggctggccgggtggggggctgacccccccacctccctcccggacggggcggctagctgggcggggggtgacccctcccacctcccttccggacggggtggctggcctggcgggggctgacccccacctccctcccggacggggtggctgcccggcggagacgctcctcacttcccagacggggtggctgccggacggaggggctcctcacttctcagatggggcggccaggcagagacgctcctcacctcccagacggggtcacggccgggcagaggcgctcctcacatcccagacggggcggcggggcagaggcactccccacgtttcagatgatgggcagccgggcagagacgctcctcatttcctagatgggatggcggccgggcagagacgctcctcactttccagactgggcagccaggcagaggggctcctcacatcccagacgatgggcagccaggcagagacgctcctcacttcccagatggggtggcggcccggcagaggctgcaatctccgctctttgggaggccaaggcaggtggctgggaggtggttgtagcgagccgagatctcgccactgcactccagcctgggcaccattgagcactgagtgaacgagactccgtctgcaatcccggcaccttgcgaggccgaggctggcggatcactcgcagttaggagctggagaccagcccagccaacacagcgaaaccctgtctccaccaaaaaaatacgaaatccagtcaggcgtggaagcgcgtgcctgcaatcgcaggcactcggcaggctgaggcaggagaatcaggcagggaggttgcagtgagctgagatggcagcagcacagtccaggtttgactcggcatcagagggagaccgtggggagagggagagggagagggagagggagagggagagggagagctacagtgatgaaaattcttttctttaagaatgttgaatattggcccccactctcttctggcttgtagagtttctgccaagagatcagctgttagtctgatgggcttccatttgtaggtaacccgacctttctctctggctgcccttaacattttttccttcattttaactttggtgaatctgacaattatgtgtcttggagttgctcttcttgaggagtgtctttgtggcgttctctgtatttccttaagttgaatgttggcctgccttgctagattggggaagttctcctgcataatatcctgcagagtgttttccaacttggttccattctccttgtcactttcaggtacaccaatcagatgtagatttggtcttttcacatagtcccatatttcttggagactttgttcatttctttttattcttttttctctaaacttctcttctcgcttcatttcattcatttcatgttccatcactgataccctttcttccagttgatcaaattggctactgaggcttgtgcatttgtcacgtagttcttctgtcttggttttcagctccatcaggtcctttaaggacttctctgcattggttattctagttagccattcatctaattttttttcaaggtttttagcttctttgccatgggttcaaacttcctcctttagcttagagtaatctgatcatctgaagccttcttctctcaactcatcaaagtcattctctgtccagctttgttccattgctggtgaggagctgcattcctttggagcaggagaggcactctgatttttagagtttccagtttttctgttctgttttttccccatctttgtggttttatctacctttggtctttgatgatggtgacgtacagatggggttttagtgtggaagtcctttctgtttgttagttttccttctgagagtcaggaccctcagctgcatgtctgttggagtttgcctgggtatcagcagtggaggctgcagaacagcagatattggtgagcaggaaatgttgctgcctgattgttcctctgcaagttttgtctcagaggagtacccggccatgtgaggtgtcagtctgcccctactgtggggtgcctcccagttaggctactcgggggtcagggacccacttgaggaggcagtctgtccattctcagatctccagctgtgtgctgggagaaccactactctcttcaaagctgtcagacagggatatttaagtctgcagaggattctgctgtcttttgtttgccagtgccctgcccttagaggtgcagtctacagatgcaggcaggcctccttgagctgtgttgggctccacccagttggagcttcccagctgctttgtttacctactgaagcctaggcaatggcaggcgcccctcccccagccttgctgtcaccttgcagtttgatctcagactgctgtgctagcaatgagtgaggctccatgggtgtagggccctctgagccaggcatgggatataatctcctggtgtgccatttgctaagaccattggaaaagtgcagtattagggtggaagtgacccgattttccaggtgccgtctgtgacccatttctttgacctggaaagggaattctctgaccccttgcacttcctcggtgaggcaatgcctcgccctgcttggactcatgctcactgcactgcaccaggtgtcctgcacccactttctgacactccccagtgagatgaacccagtacctcagttggaaatgcagaaatcacctgtcttctgcgtcgctcactccgggaactgtagactggagctgttcctattctgccatcttggctccacctccgctattatgattcttacacagagtcctttgcttttcagcagcctccttttcctcctttttaggttggaatccctctgttttagtggccactgggattctgaaatgaccaggtctttgtctcagagacctgacacatgctcttccctctgcctggaacacatttccttgttctggtcccctgagaactctttcagctcaactgccccatgctcagagaccccctttctccctctctagtttgaagccagtttactcctgtagtctgcgcctggaaaactcgttttcctccttgatgcctcccgagttgtcacgggatgtatgtgtctgtttgggtgtctggtgtctgtctccccgactggactgcatgctcctggtgagctggagggactggactaacacaggccaagactctggggctggagggagcagggcagaaggcacaggcaaaaggcctttgtgatccggaaggaagtgaaggagagggagagagatgagagaggctggcagaagatgggccaggcgccaggctgtgtgggatcttttgagccacagaaagacatttgaattctcatgtaagagaaccagaacaccattggagggtatgagtcacctcatctaactgagctctgtaaatgtcaatgttttattatttttatacaattatttaaaagtgactttagttatttacctttttatttttattacttttattttttttgagacaaaatctttctctgttgcccaaactggagtgcaatggcatgatcttggctcacttcaacttcaaccccacaggttcaagcgattctcctgtatcagactcccgagtagctgtggttataggcatctgccaccaagcccagcttatttttgtatttttaggatagacgacgtttcaccatgttggccaggctggtcttgaactcctgacctcaggtgatccacccacctcagcctcccaaagtgctgggattacaggggtgagtcactgtgcctggccctatttacttttttaaaaaagatcaggccaggcatggtagctcatgtctccaatctcagcactttgggaagctgaggtgggatgttcacttgaggccaggaattcaaaaccagcctaggcaacatagtgagacaccccctgccccaattcctaagaaaatgagaaaattagacacggtggcttgtctgtatccccagctactggggagcctgagctagggaggactgcttgacaccaggagtttgaggctccactgagctgtgattatgccacagtctgggcaacagagtgagaccccggagcctcctcagcctccctagagctgaccgagcttttgcttcttatcacagggaatgacggacgctggggctttgatgggcatcgggtgaaatgggcagagtggcgcttacctgtgatggcagtgaagtgggacggggaggtcattgtgacaaggggtggcatgaggtacttggccttgacgccctcctcggccagatggtccaggttgggggtgtccacatcctcatcctagttccagcggaagccctggaaggtgatcagcagcagctgtgagtgctcttcttccctgggacggggtggccacccagtaggacaggcggcggcagcagcagctggagggcaccgagccatgtcatcctacaagcacctgtcatgcactcctcacagagttcatgggcttcgccctctttagtccgttgttgaacaaagtccacattaataattcagcccagctctgttgtgggacagacaacctggagtgaagcaaggtgctgcatatttgcaggacaggatgaaagcgttctggggttggatgggggacatggttgtacaatgtggtggacgcacttaacaccactgaatttttcctttgaaaatggctaaaataatagattttgtatgtactttaccacaataaaaaatcaaactggccggacatggtggcttacacctgtaatcccagcactttgggacgccaagatgggtagatcatttgaggtcaggagttcaagaccagcctggcccatggagaaatcccatctctactaaaaatgcaaaaattagccgggcgtggtggtacatgtctgtaatcccagctacttgggaggctgaggctggagaattgcttgaacccgggaggcggaggttgcagtgagccgagattgtgccactgtattctaacctggacgatggaacgagactgcatctccaaagaaaaaaaaaatcaaactacatgaaatattttggactcttatactaattcgccacatgaaatattttggactcttatactaattccaacattttgaagatctggggagaacaaactagattggtgctttccttggcttagtatgtcctgtttttatagggagagcaaatttttttcaccagcactattaaaatagctacaacaggatgggcatggtggctcacacctgtaatcccagcactttgggaagctgaggtgggagaatcgcttgtgcccgggagttcaagatgccagcctgggcaacatggtgagaccctgccactaccaaaaaatacaaaaacaacaacaaaaacagctaggtgtggttgtctgcacctgtagtcccagctactttagaggctgaggtgggaggatcacttttgtccaggaggttgaggctgcaataagccatgattatgccactgtactcagcctgggtgtcagagtgagaccctgtctggggaaaaaaaaaaaaaagctgcagtggactcagtgaccatgaggccaggcactgtatacatatacgtcatctcatttaattttttctcttgtttaaaattattttttcctctaatccccatgttgatcgacatttttttaatcctaggaatatattagttgaaaatttcacataagaattaaaaattgcctggcctgatggcttacacctgttatcccagcactttgggaggctgagatgagagaatcacttgaatccaggagtttgggccagtctgggcaatatagtgagaatgcaactctataaaaaaaatttaaaaagctgggtgtggtaggattcacctgtagtcccagaaacttggaagactaggtgggaggattgcttgagcccaggcggtaaagacagcagtgagctatgattgtgccattgcactgcagcctaggtgacggagtgagactctatctctaaaataaatgaataaaattgtggtataacatatgcaacttttaccattttgtgcatctgaaagtgtacaattcagtgacattttgtacatttatcatgttgtgcaattatcaccactacctagtttcagggctttttcaacacctcaattggaagcctcatatccattcagcagtcactctccatgccctctcctctgcagccctcggaaacctctcatctactttctacctctgtcgattggcttagtctgaacattgcatataaatggaattgtacaatatatgacctttcatgtctgcttctttcactcagcatgtttttaacgttcatccatatcacagcatggataagttttattttctttttagacgctatctaaaaagaaaaaaaaattataaaaaacaaaaataaaaaattatataggatggagatcagatgagtcctgcaaagtttataatatttactatctagcagtttacatagaagcttgcctacctctgaatgatatgcaggtacagagatgacatttatcttggcacttatagaaagacctataaattgtataaagacatcatcattggatttccagtaacaagaagcggcaagacatgacagtgtgtccaggtgttcaggtgaagtttagggaaggtcttgtcttgacgaggtcggatgtgagacccagatgagataaccccatttcccctgctgaaattgcctgagaatttcattccagttatttgcgtaggttgattctttcggtgggggtggggtgggtgaggaggtgaagtgtcaggggagttctattgtgtatttgcacaacttggctttcttttcacttggtgtggggttttgctgtctgaggaatttcatagaattttgtgatgagtatgcagcatagtggtttgaatcctgccaggccgagggtcatatctcagctctgcaactcattatctatgacgccttggggcaggtcccataactccccaagcctctgttatatattccatggggttgtgaggttcagatgaaataatgcatgctggcgggaatggttactgctcatgggatttccatgtgctccccgtattcaccagacccccagtagttagatggatccatgccagggtccagtgctctataagtggaagtcactgacttcacctctagtctacagcttttgagggcttggggataactatctcattctctcatctcatggtgcagtaactatgggagaatccttgcattaagatggtagaatttccatcattctaggtcttcgagtggccatatggagcacaccgtacccagccaacccattgtggacatggaatgtaagaaatcaaccttggttgctaagctgctgagtctctgtggttaatttgttactgcagcataacctagtccatcctgatgcatgcagcatgcaaaccacttatgttgacccttagtcatggtaagtgctccacagatgttggttacttttggtaggaagatagattgcctctgaaagttttgttagctgatctcatgatgccaatgttgctattttgtaattggataaattggacttgtctctccttccagcaggtgggagagaaagatgactgagagacaataaagcactattatcttcagtttgtgtccttggatacccttggtggcaatgaacaatgtatgctcctctgagaaaactggacttaaatgagaatgggaggtgataccagaattgggaacgtccaaggccccaggcattccctggtctggagacaactttgagtccttggtgggaagattctccaagggaacataaatgcttttactatctagtttgtctctttgagaattaaaacatttttttttcattccagtagcttctgggatacagtttgtctctttgagaattgcatactaattaattttaggggtcatctgtacacatctctatattcctgaaacatggtagaaacagccagcagtcagacaacaatctaccatgaccactaaaacatccccaaagtgaaacaccagatgtgacccactaggtttagtggggatggctggctcgagagttgattatatttattattgtcactgtggtgattatggccacaacattgtgatgcgtgttggtcttcttttggtgagttgcagtttggaaggaataaatccattatttttttgtttgagtctcgctctgtcgcccaggctggagtacagtgatgccatctcagcgtgctgtaaactctgcctcccaggttcaagtgcttcccctgcctctatggccaggctggtcttgaactcctgacctcaggtgatccacctgcctcagcctcccaaagtgctgggattacaggcgtgagccaccatgcccggccctattattcatttaaccaatatctattgaacacattgggtgtggtggaggatgaactgctgactatgttttcaagttgtcctaatactccactgtgggacacgcaggcttgtgggtcccagagctccagaagcatcttctgaccgcaccatcctgacccagattctactgaaaaatacgtgagtctagcagagccatctctgacacttcccttcttttgaacggctgatctgtcagtcatggggagctcttatgaaagtgtagtgtgttttgtgaaacttgaggttggtcaaagaataccattaaactttgttaagaaatctacatattgatgacataggcagtggggtggaggtgggaaaattcccaaatacattttaggaattatctcagaaggaggtaatagtcagaactcttggttgccagtgacagaaactcatcttactagtgtggagtacaaaaggggtcatgtttttgtctgcactccccaaccccaagcagatcctgaaagagggacaggattgcaagtggattatttaggagatgattccagggaacaccaataggggagtgaggaactgattcatggaaaggcaggaggccacacaggggccttcaatgagcagcttaccactccaggcaactaggatttgaccccactggggacctctgggaggtgatgtggaatgcatttcaaagttgttccatccagggggcaaagatattgaagcatttatagcctagctcccatccgtcactggctgaggacaggtcccagggcatcaactctctggcttttcttttttctttttttttttgagacatagtcttgctctgttacccaggctggactgcaatggcatgatctcggctcactgcaacatctgcctcccaggttcaaacgattctcttgcctcagcttcctgagtagttgggattacaggtgcctgccaccatgccctgctattttttttattttttgtagagacggagatttgccatgttgatcagtctggtctcaaactcctgacctcgtgatccacctgcttcggcctcccagtgttgggattacaggagtgaaccactgtacctggcttctgtggcttttctgacataatccatgcctgactttgagaaagccctcaggtgaaagtcttggttgtatgtagtagcaagcatgtactagaatgataaaaaccaaggggtttaccataagatctctctctctatctctgtctctagctttgtctgcatactggcttaatttcttcttactcaagctttttctccataaggtgagaaacgtggccacaaaagctcctatatttctcactacacacagttcctgtcatcacggagaatgattaaattggtctagttacagtttggaaaaatattcaagggaagaattctgattggccaatttaggccagattctcatccctggaccaatcaactgaggccagaggggtggagtcatgtaagaatatggcagcccctatgagagccacgtgactggagtaggaagtgtgagtctctatagaggggagggctgctaggctgaaaaggcaatagatgtctgcagtgaaaggaatagatcaggagatacattctgttaaacctgttaattatttttgaaaaaagagaaactttcaatatacagttatagtataagtaagcgggtggctcacgcctataatcccagcactttgggaggctgaggtgggcagatcagaggtcaggagttcgagaccaacatgaccaacatggtgaaaccccgtcttgtgtgcctgtaatcccagctactcaggaagctgaggcaggagaatcacttgaacccagaaggcggaggttgcagtgagctgagatcatgccactgccctccagcctgggcaacagagtgagactcggtctcaaaaaaaaaaaaaaagttacattgtggttcccacagcatgatttatcagaaaggaaaaacttaaaatatgcgtattttctatgcacaggctactgctatgaattcaaattcttaaattccaaagattaactaaaatgtttctcaagacacataaactgttagaatctgcttataatgaggctgaagttgagtaagaagagaactggcatttgggaccctacttttcttctgtcgagtactgtcaagttttggttctgcctggaagtagatgcacctcaagggagggttacatgtaaagttgtgtgtgtgtgtgtgtgtgtgtgtgtgtgtgtgtatggtagtttccaaagatgggtacaactttctgcaaatgctcgtgcagtgtaatcgaaccaatctttcctttaagaggtagagtttatatttctctacataaatctgggctgcctatgacttgctttggccagtggaatgctgccaaagtgatggtgaccaacttctagccgtgaaaggaaaataaaccttgggtccccaagatcactaagctaggctgggctcggtggctcacacctgtaatcccagcacttttgggaagctgaggcaggcggatcacctgaggtcaggagttcccagcactttgggaagctgaggcgggcagatcacctgaggtcaggagttcaagaccagcctggccaacatgacaaaaccccgtctctactaaaatatatgaaaattagccaggcgtggtggcaggcgcctgtaatcccagctacttgggatgctgaggcagggaaattgcttgaacactggagttggaggttgcagtaagccgagatggtaccactgcactccagcctgcgcaacagagcgagactctgtcccccccaacaaaaaaaagttactaagctaaagagaaaagtcaagctgggaactgcttaggggaaacctgcctcccattctattcagttacccctttgctcactgagataaatgtatatctgattgcctcatttggagaggctaatcaggaactcaaaagaatgcaaccatttgtctcttaactacctatgacctggaagcccctaccccttgtctcaccatcaccttcacctggacttgtcccgactttccagactgaaccaatgtacatcttacacatattgattgatgtctcatgtctctctaaaatgtatcaaaccaagctgtgtccccaccaccttaggcacatattgtcaggacctcctgaggctgtgtcaggcgtgcgtcctcaaccttggcaaaataaactttctcaattaactgagacctcagatttttggggtgcatatagtcttaggccttgagagccctctcctagtttctatatttttgccctcttggatgctggcaccaagcaaaccttggctatcctgcttaaagggccatttggagaggggttctgcagggcgaggggccacatggaggaaaacaagtttccccagctgacagccagcaccaactgccaggcacatgcatgaggtcgtcctggatgttccacccagctggccctccagctgcaggtagccacacaaatgagccccggttaaaacagccaggaagtccccatgcaactcacagggtcatgagcaataatgacttgaggtggtttaaagtttctaattttaggtgcaataggtaactgaaacagcccacaagggtttgagcctgtggagggtgcatttcccacctgctgaagcttctcaattcccaggattcaatgcggataagactcttgttctcagtgtccttgatggaaatggcaatgaactttttgcagattggaccatctcaggggaatcccaaagatcggaaactattttctttctcagaatcttccacacaacattgagccttaggaatttctaagaaggatctggaatgaaaaaaaatcttttgaaaaggtatttgtatagcttcacttcagcaagattcatggtgggtgttagactaagtgctggtgttaagccaaaccatgtttttcaaagactcatctggcctcaaggttggcaggatcagagtggcctcccaggatctaccacatcctcaaaagagttggttcaactggcatgtacccagatctctttgagctagtatgatactcccttgagtcaaaggctgccacatcacatctcctttaagtctccctaagtacgaccccagaagtattgacaaaatagtgctattcctgaagatttcaggaggacataaatgaagagattaaactgcaaggtaccaaaacttccatctttgctaaagaccctcatccaggctgggcacggtgactcacgcctgtaatcccagcgctttgggaggccaaggcgggcggatcacctgaggtcgggagttcaagaccagcctgaccaacatggagaaaccccatctctatgaaaaatacacaattagccgggcgtggtggcacatgcctgtaatcccagctactagggaggctgaggaaggagaatcgcttgaacctgggaggcgtaggttgcagtgagctgagatcgtgccattgcactccagcctgggcaacaagagtaaaactccatctcaaaaacaaacaaaaagcccttatccaatggtcatgccactctatctggccatgtaatttctcctcctggctttctgtagcaacagccttctgaggaacctcactctgcctttcaaaaccccttcaacttgtacccttcatcagcaaagtacttagctcaacatgtatgcgtctgggggaactcatccacatgctatttaaggatatttccagcaacatcatcttcactaccccaggatggcattttagagtggattacgtgcctgccggatgtgttgtagttgaacgagttagagaaaatgccacactttgagacgaattaagagtctgttcatttagccggtggctaagaaatggctaacatttaaagttctctcggcctcgaagaaggggctagattttcttttatactttggtttagaaaggggagggggattttttacaaaagtaggaattttacagaagtagacaaaaaagttaaaaggataaattgttacaggaaagtaaacagttctaggtctaggggcttttagactattatgaggtgacagatgcggggctttgggcgttatcaattggacgaattcctgggaactgcggatattgctcgccacagtatcttatcagttaattgcattcttggatgtgctgggagtcagcttgcacaagttaagtccttgaggaaggggctgccagtgaaagagccaagatggagtctgtctggctctcttagctaagggagagtcagttcaggttgaaacaaggctaggtgattaaaagaaagggagagtctaagaacagggttagtaaaaacaaggttgggcattacattcctcacttgtgtttttggggagtcaaatcgttgattcttcagttataacaagggggttatattgagtcttaagatacataagtttgacagaagctatgcgttgttttacaaaattaagaaactaatttaatatacaaggtccaaaaattagacttaatactaggatggggagggggtctggctaacttagtaattagaatagttagctctgggttctagttgaacatgctttgatactagcggatgttattttcttgttcttgttggcgcttatctagattttcttgcactttctggagtgtatcttttatgactaagaatggtggaggaacagttaaatcaactttgtcagggtgtttctggaacatagggttacttagatcagttaaaggcctgattgacttgggtgggctttatgagactatggtttttttggatggtgaacatagacttaacattaaatcctgggatgtaaaatcttaatcttcatgacatgccatgatactattgagttgagttaaggtcatggacagttacagtaagaggattacaattttttctagtacataatttaggatgagaagcaggacttatggaaagagttgaagatctggttgatcttttagagtaggtggctaaagttacacatgtctaatcaggacaggaaaactgataagtatcttgacagctagcatcagggtgatttctaggacagaggtaaaagtcaatattttggagtcttttttctgcacttttggagcttctacacttagtttggctcttggagtgtctgaatcttgctgaaaggtcgacccttgctgctcctgggactggcagattgtgttgcttttcatgggtatgggctggctttgggaaaagtacaaataagtcaactgcaaaggagacttccttggaggtactggccttctaagtggtgtttgcaaatacaagtcctgttgtgaaagaggtgaggagaaaggagtaggaaggcacagaggacgtaaagggcaaaaacaaataagtgaggcagataaaaagaatgaatctaatgggttcacctgacttaggtgcagttttaaggggcctaacttaggcctggggacttatgtttttagttgggctctgttggcctttttgatgcgggagtgatgaatgtaagcaggaatgccgtctactttcagagccattggcgttgtgaggatgacggtgtgaggtcttttctaagcaggagtgagtctttctttctggaaatttttaacaaacactaggtctcatggctggaacgaatggctggactttggtcaggaattggattgggatgggctcctggaacaagtggcaggataatatcttgtacctgttggagagactataggtactgtaataaattattttgtgatatttctgctaatttggcatctcttagcttaggcaagatagggggttccttcttatacatgatttcaaaaggtgagaaactagcctggtaaggggtgcaccttactttaagtagggctaaaggaaggagacttacttaatttacacttttttttaagattaattttgtaagagtgttttttagggtgtggttcttgcgttctacttgcctggaactctggggttgataggcacaatggagcttctgttgaatgtttaaggccttactgactgactgagctataggcgaggtgaaggttggtctattatcagactttatggcagcaggcagcctatattgagggatgatttcattgagtaaaaatttaactactgtgttggtggtttcgttttcggtagcaaatgccttagtctatctggagaaggtgtctaccagtactagaaggtatttgtacttagcctggtgtggtttgacttctctaaagtcaatttcttacttttttcttggtgagttttttcagagacagtggcctgggctgggtttaggactttgtttggcatttacttgggcgcaggttgtgcactggagagctgcttaatctgttaggctttgaagatgggggatcttaaaatggctctggaggagctaaggtagatttgctcttcttaaatgggtggtagactgtaggtaactgattaaagtttctttaagagttcagggtatgaagattctaaagtctggaagaatctactaactttcctgatttttattggctctgagatccgaagccagttttttttgttgttgttgttgttgagtatacgggattgtcaggcagatctggctgtggaaaggagactgtgggcagcaagtttagaggcgtgactgaaagtcgcgctgagacctgagctgctgaatcacgtttctggttactatgggcaacgggtgtgttttctttttgatgtcctttgcagtggatcacagctacctgctgaggtgagtagcctgctttcctggtagatggctttacgtacatacacagtagcaaaggcgtacttgctgtcagtgtaaatgttaatacgtttattcttactttatcagagagcctgagtgagggctatcaattcagccttttgggctgaggtgttcgctggtaaagcttgagcttacaacacatgtgtctccgtggtaacagctgcactgacttttcatacttcctgcttgaggaagctgctactgtctctgaacacggcggtacctgccttttctaggggcacaccttgaagatcacatcggccagtttcgatagtttctaacagttcttgacagtcatgagcaggaatagtggagtctgagtcaggaagtactgtagctggatttaaacactttgtgggagagaaagtcaaacgaggctgatctaacagtaaacttcgatactgcaagatgcgagcatttgacatctatttgccagaagcacttcgtagtaaggtctttatggcgtgaggagctgtaagggttaaattttggcttagagttaatttatcgtcttcttgggccaggcttgctgtagccgctacggctcgcagacaacttggccatctagaggccacaggatctagcctcttagacaaataggccactgggcgtctttagggtcttagagtctgagtaaacacgtttttagcaactccttggcttttatggagatattagggagggctaaagcaggggcttcagttaatgctaaattaacgggctatttcattctgtacttcttggatagctgccactaagatttttgtttgtcttttgaatgctttatcagcggccttttcagctgccagtgtagcttgtttttgttttttaaacttttgattgtcaaaaacttcttgggctatttctaaaagctgactgatatttattctagcaaatctttttagtttttggagtttctttttaatatctggggctgccagagccacaaatgctaaatgaagagcacggctattttcgggagctgccgggtcaaaagggatgtaaatccaataagcctcctggaggcgctctaaaaacgttcttggtgacttatcgggcctttggacaacttcgcttgtcttagacaagtttatgggtttctgagcggctcttttaatacttgcgaggagataccggtgaaaatcacctaaagctccctttctacttgaggaatttgggtgctggttaggccgggtagagggaaagacctcctcaagggggtctctagcttcttcttccggtccgttggctgatgtgaggaagtactttttggcttctttttggatacgttctttcttttcagaggtgaaaagggttaaaaggagctgtcggcaatcatcttaggtgggcgggtgagtctggagtacagactctgtcagagaggtcaaagcctggggcttttcagagaagggaggattatgggttttcgaattacataagtcagaagtagaaaaagggacataaactaagaagggtgctgagcgctcatcacctggagggacttgtgcctctctcagtggtaggagaggggctacttcttcctgccacggtcatgattgagaggcaatgggtggcgagcctacaggggacgtcgtcgagcagacatgggataactttaagggagaaggttggtagtaaggcggtgggactgggtgagggagactcccctcttcttcagagggaggcagtacagggggagctgaaccggctgagggtcgaggcgaaaacgtggtctggcttaggaggaccttggaggtagaattatgaatggcgcatgaacggagccatggagagtggatcctgactaaacttagctcttgatcaatgtagggaaactgatcagggtggctaggagtttcagtaacaacctgccacacagcttgaacaattgtgaggttcaatgacccttcagggggccacttgactttaaactttggccattttattttgcagagtgtctagagcttgccttttttaaggcggactttataatctgagaaactgagaggaaaattctgcagcatacattggagagggctttaactttacaaggctgggaggaagtgtttcttttttttttttttgaaggcaatttaataagatttgagcatagatattaaacttagcatggacagagaaacttatttcttgggggactggagtagtgaaagaacagaatcaatatgactagaaagagcagaaaaacttacaacagctaatactacttgctacattgctgtagctttaagactgagggaggaggactagagccagcctgagatcttctgggtcagtttgatctaggcgttcttcttcttcttctagatctgcactttaaatacttttggtgtctttataacttaaacgcaaatagcttaaacttagctttttctcttaagggtttaaggagtgagagcagagccaagtcctggagacggtaaacttgctgtggcaccggaaaacgagatgtgcgggatacggggcagggacaaggtggaaaaggactactcggatcatttttaagatggaagagtagccacagaggaacagagtaagaatctcaatgaagtaaagcagtacgggcgtacatttctttacacagtgctctatttcagggcacaggaaaagttacagaatgacaagagaggtgagcaaggaaatctgcagggtggctgttttgaactcattactggtttagtttagaggacgtctaatcacttggacgtggagtatgatgatctaaatacttaacaactttcttggtgctagaaatcttaatcaggcgaatatttttcacacttgttcttgtaacaacacttgacttgcttctggcagaaaagacaggactgtggtggccagcctaaaagattgatgagaaatttaacctcctgtgacaaaaaatcagcactaaggactttgaagaagtttttacttagaggtcttgggcaataccaacgtcttgacatgcaaaactttgacaactactaacaagacaatagacgctgaacagaacaatcaatataaaacaaacagttgactttagggcatgtaaacagttatgacagtttttccttttttttttttttttttagacagacaaggggagggtttcctgtgatgggatcagtcagatgcctgcctggccactccccttgaggggacttgggctcctcttagcattggcaggccggtataaacttccggctcagatcaaggtacgcctgatgctgccttaagccttatgaggtcgccacggaaccgcaggtgagggcccacttgaactccgtagctttcgccgtggagctacaaactggaggacaagcgcaaacccttgtcctccctcattcattcattattcacacagagtatataacagttttttttttttctttcttggagattcttcaagaaacttgaacaagagaaagatgagagatacaaaaagagagagagagagtgaccggtctgccagaaaccaggactcagtcctccagcatcctgggatgtggactgagtcaagggagggcccctgtcagggccacttccctcctagaaagagacacagaggagcctaacagaaaaccagggctctaccttctagcgtcctagagaaacaggcagagtcaaaagagggacaccctcatcagggccgcttccctcttactagaactgaagtcaaatctgacctacctgacctcagggtcagaagtcgaggactcagaggtggaatttttatgggcacccacaaggtagtcgatccgctctcctctggaagacggtcacctttcgaggacctgaaaatttttttgtaggtggcaccccgcaacaagccggccgtccttccgggggagcccggagcgagcccggttctcgcctcgtggcgtttctcgctggggcctccaaatgttgtacttgaatgagttagagaaaatgccacactttcacatgaattaagagtctgcttatttagctggaggtcaagaaatggctaactcttaaagttctcttggccctgaagaaggggctagattttcttttatacttcagtttagaaaggggaaatgggtctagttaaaagaattttacagaagtaaagtaggcaaaaaagttaaaaggataaattgttacaggaaagtaaacagttctaggtctaagggctttaagactattacaaagtgatagacatggggctttaggcattatcaatcggacaaattcctgggaactgcggatattgcttgccccacagtatcttatcagttaattgcattcttagatctgctaagagtcagcttacacaagttaagtccttgaggaaggggctgccagtgaaaaagccaagataaaagctgtccccagtgttagaggtggggcctggtgggaagagattggatcatgggggtggatttctcatgaatgatttagtgtcatccttttggtcctgtccttgcaatagtgagtgagttccggcaagatcgggttgtttacgagtgtgtagcacctccctccttactctcttgctcccgcttcaccttctgccatcattgtaagtttcctgaggcctccacagaagctcagcagatgtcagtgtcatgctccctgtatagcctacaaaactgtgagccaattaaacctcttttctttatatattacccagcctcaggtatttctttatagcatgagagaacagccaaatccagcagccatagacaatatgcagcaaatgtgcatggctgtgtttcagtaaaactttattgacaaacacatgtgcaagcaggtcagatttggcccatgggccatagtgtcccaacctctgctctggaatattctcttcagcctggacggacatctctaggttgttgttgttttttttgtttgtttgttttgagacaaagtctcactgttgcccaggctggagtgcagtggtgcaatctttgctcaccgcaacctctgcctcctgggttcaagcaattctactgcctcagcctcccaagtagctgggattagaggcacctgccaccacacctggctaattcttgtattttttaatagaaatagggtttcaccatgttggccaggctggtctcaaactcctgacatcaggtgatccacccacctcagcctcccaaaatgctgggattacaggtgcccaccaccacacctggctaatttttgtatttttagtagagatgtgatttcactctgttgtccaggctggtctcgaactcctgatatcaagtgatccagctgcctcagcctcccaaagtgctgggattacacgtgtgagccactgcagctgccctctagatttttttttttttttgaccattgcttatttggtttgactttcattttcttccccattgtggtagtcattttctgaatgcctgttagtttgtccatctctctcctctgtagtccctagagtcagatgaactcctctgcaggtgcaatggtgtaacactctctagtgctgaattttgagcaggagaaagagagcaagagtgaccagtacctttggaaactctgccctcctgagaatttggtgtcttctctgcaaatgttgcaaacctgttaacccacaggctggagagagagacaagccagaatcatgatctgttgagcttcagtttaatatttgatgcacagagatcactgagtttttttataagaattagagggggaagaaatggccacagagagcaatttctatctccaggtgaggattcaggagataattctgcgaacagaacttcctgagaactgagatgggggaaatcgctggtattagaagagtgaaaagttcagtaattaaggctacgactgtgctcttagaggcaaaagaagaaaatgagactgccaggcatgaataatgagaaatctttgatggaattagccatgcagaacagatactaaatgcatcctcattcttctcatagtcaaaagtttttgcttaagctggataggaaaaagagcatcccatttcactaagtataaaagaggggattttagagaaggtctcagaagaaagagatgtgggggtttggtgaaactcaccagaggctggaccctctccagcataacacagggattgggaggagcggggcggcattaggccaggtgcatagcccagtgctgctatctctggactttctgctctctctggacttgtttactagctgagcttatccatttacataattttcagtgccatttctcagctgatgagtcctgaacttttgtcctgaggctagaattctccttgaaacagcagtcttaaacactcaacttctttcttgttttttccacttgtcaactcatgaacacctcaaccttgttacatccaaagccaaactcatggcttggtgtggtaggtgatggctgtaatcccagtgctatgggaggctgaggtgggaggattacttgaggccaggagtttgaagccagcctggaaaacacagtgagactccctatctacaaaaaaaaaaaaaaaaacaacaaaaacaaaaagctaggcatggtgatgtgcatctgtaggatctgtagtcctgctacatggcaggctgaggcaggaggatcaattgagcccaggagtttgaggctgcaaagagctatgatggcaccaatgcactccagcctgggtgacacagccagagaccctgtcttaaaaaaaacccaaagccaaactctctttttcctcctccttctccatgggctctgtccatgccatctctcttctgtaaatggcaccaccccctgctgagctgctcaaggtggtcataactcatgtgttgtgctaactctgcttttgccctcttctccagtcagcaagtcctgtgattctaaactttatccaacttgtccactctctctagcttcactgtcattatctttgcctaggacaccagtatctcagctgggctacagcagcagcctcctaactggtcttaactggtactctgcacctgctctccatgctcagcaatccatttcctacctggcagcttcagtgatcttaaggtgtccattgagtctcatccctgcctttcctgcccatggtacatagaataaaatcgagaccccgagtcttctgcctgttcctgccacctctccagccctctcctatctcctgcccttggcctactctatttcagccactatggcctccttttgttttcttggactttcaaacctttttccacaacagggcctttgcacttgctgcttcagcctggaatgattttcctctgcacctccccagattagaccatcctttaggtctcagctaaaatggtgcttccacagacagctctttcctgacccctttataaagtggacttccctgctcttctccaccttaacctcttattgtttcttgttgtgggaagtcagggaccccaaatggagagggactggctggagccatggcagaggaacataaatggtgaagatttcatggacatttatcagttcccaaataatacttttataatttcttatgcctgtctttagtctcttaattctgttatattcataagctaaggatgtacatcaccgcaggaccactgtgataattgtgttaactgtacaaattgattgtaaaacatgtgtgtttcaacaatatgaaatcagtgcaccttgaaaaagaagagaacagcaatttttagggaacaaaggaagacaaccataaggtctgactgcctgcagggttgggcaaaaagagccatatgtttcttcttgcagagagtctataaacggatatgcaggtaggagagatatcactaaattcttttcctagcaaggaatattaatagtaataccctgggaaaggaatgaattcctgggggaaggtctataaatggctgctctgggaatgtctgtcttatgcggttaagataaggactgagatacaccctggtctcctgcagtacccaaaggcttactagggtggagaaaaactccgccctgatatatctgtggtcagactggttctctgctcttgaaccctgttttctgttgtttaagatgtttatcaagacaatacatgcgtgaatgaacatagacccttatcagtggttctgcttttgtcctttgctttgtgatctttgctggacacttctcagtagttctgcttttgccctttgtcctgttccctcagaagcacgtgatctttgttagacccttagtagtagttctgctttgtaccatttgaagcatgtgacctttgtacctattccccattcttacaccccctccccttttgaagcccttaataaaaacttgctcatctgagactcagggggcatcatggtcctactgatgtgtaatgtcacccccagcagcccagctgtaaaattcctttctttgtagtgtctctctttatttctcagctgcctgacacttatagaaaatagaaagaacctacattgaaatattgggggcaggttccacctatacttctttcatggatttacttattttttgtttgtccccctgtgtatcctagaaactcctggagggcagaggcatgcctgccatcttcatcattgcattaccaccacccaacactattgggggacctgccccgataatcatgtaggttcttttctactttcctaagcgtcaactggcttgagaaataaaaggacagagtacaaaagagagaaattttaaagctgggcgtccgggggagacatcacacattggtaggatccgtgatgccccacaagccacaaaaaccagcaagtttttattagggagtttcaaaaggggaggcagtatacgaataggtgtgggtgacagacatcaagtacttaacaggataatagaatatcacaaggcaagtggagacagggcgagaccacaggacatttagccccccagctctcttacctcaaagcttgtctcctgaaggccacagcttctgtcaactgaccctttccacacctccttttcttcagattccaggaactgctccctatccagctactctatcacaatgctacttgctttctcactctaggatctgttaaaacaaaaagtgagtctgggtgcatggttcacgcctgtaattccagcactttgggaggccaaggcaagagggtggcttgaggccaggagttcaagaccagcctgctcaacatagtgagattctccccccactcccatctctggtctcacacacatacacatgggcacaaattaaattttatctaaaaatttaaaaattgttttaaaattgaaatagttacatggattatgtatatattcattttgtaaaactatagatctcatggaaatgggaactctttactcttccagcaaaacatttttttagccacaaataaaagaagaccagtgatttagcctgtacacacaaaaaagacataagaaaatactgctaaggctggggcaggggtgggggaaagagatctaaaaaattcaaattttactgggaaggaccactaattagaatcagaataattactgttttaaagcatttaagaatagagcacaatgaaccccgggaagaaatagatatgattcagagtcgagctcacagagcagatggtacctcagctgagactgatagaataacattaataagggcattcactgccatttattatctcctaactgcaatgcattttgtataagttatttgtactcttcacatcaaccatggaaaataataattattcttatcttttgacgttaaggaagtggtaagtggtgtaagaagataaattaacatgccaacaccaaacagctcaagttcgataactcaggagtgcccgtgtctccccaagaggttgcttagcaggcagaccaggtagagagagcccttccaagaagtggcagtgagatgtgaaacgtctcagtgtgtctctaagaacaacagaaaccagtacgtagaccaagtgggaaaagccaaggaagaggcaggaatttcctcttaagatagcaagaagaataaacaagagcaggactgagggaagccatgggaaatgggcaaaataccatgcattaagcgagaaaaaacaacttttactttagaataggaaagggggaaggaatggtggtagtctaggtaagcctagaagagtaaagggcagcagagaaaaaattagttgtactagggttctccagagggacagaatcaattggatacatgtatatgaaaaagggagtttattagagagaatcggttcacaggattacaaggcaaagtcccacaataggctgtctgcaagctggggaaagagagaagctggtggtggctcagtccaagtccaaaagcctcaaaaccagggaagcccacagtgcaaacttcagtctcaggctcagggcctgagagcctcggggaagctgctggtgcaagtcccagagtccaaaggcagaagaacctggagtctgatgtccaagtgaaggggtgggttgcccctccacacctgtgggtgttttaattaggtgaaacgagagacctggaaaagaaagagacacagagacaaagtatagagaaagaaaaagggagcccaggggaccggcgttcagcacacggaggatcccactggcctctgagttcccttagtatttattgatcattattgggtgtttctcagagagggggatgtggcagggtcataggataatagtggagagaaggacagcaggtaaacacgtgaacaaaggtctcagcatcataaacaaggtaaagaattaagtgctgtgcttcagagatacatacacataaacatctcaatgccttaaagagcagtattgctgtccacaggtcccatctccagccctaaggtggttttcacctatctcagtagatggaatatacaatcgggttttacaccgagacattccattgcccagggacgggaaggagacagatgccttcctcttgtctcaactgcaaagaggcgttccttcctcttactaatcctcctcagcacagaccctttacgggtgtcgggctgggggacagtcaggtctttctcttcccacgaggccatatttcagactatcacatggggagaaaccttggacaatacctggctttcctaggcagaggtccctgtggccttccgcagtgttttgtgtccctgggtacttgagattagggagtggtgatgactcttaacaggcatgctgccttcaagcatttgtttaacaaagaacatcctgcataaccctaaatccatttaaccctgagttgttgacacagcacatgtctcagggaacacaggtttgggggtagggttacagattaaaatggagtctcttatgtctactttgtatacagacacattaacaatctgatctctctttctttttcccacatccaaggtcaggaggaatggaagcaagcttcctgcatgggaagaagaaaaaaaggcttctggcagaagcctccactagcaagcctatcccaccttcctccgcctgctttgttctagctgctctggcagctgattgactggtgcccacccaccttgagggtgggtcttccttcccagtccaccaactcaaatgtcagtctcctctggcaacaccctcacaaacacactcaggaacaatactctaggcagctgtcaatccaatcaagttgacacctaattttaaccaacatacaagatttataagctaagtatgtcaatgatgataaataagtgttgtggagaaaagcagagcagagaggagaaaaggaatgcagagaagggtttacaagttttagaagaattcatacttacaggcccctgttttccataaaaaacaggaggctcatcttctgcaggtactgaagggcttgggatgttgtgagggtgaacttgaaaataacagacaaatatcagagttaatgaggggaaaaagaaaagatgagtgggcatcatggtggtccagcaaaggaggaaaacccaagcatgaatgtggactggcaccatcagagagggcagagcctccaataacatggggcagtctgagagccagagtcaagacgtgggggaaatggatccaggttctgtgtttggcacagtgtgtgtggaagaaggataagagggctcgggaggacaggtacagtgagtgtgcctccacagggatgctcttttggtatgttctattattgctgaaaaatatgcagtgcccctccctgggggaggattatgctatatctagcccattgatatcagtgtagccaggtgacttgctattgccagtgaaatgtgagtagaagtgacaggtgttacttgtgagcagaaattttaagaaccacgatgtagctcaacaccaactttttttcctctgccagtattccaggtaggagcgactcccccaaccaagggcccagaatgaaaattatgtagagaagggtcacagcctacccatgatcaatatgtagctggagtgagcaaacaaacttttctggttgtaagtgtctgagacttgggagtcattttgtaactgcagcataacccaatctaaactggctaattcaagcttgaatattttaagttgaaagggaaattagtaaagccataagtgacctaatttgttgagagcagtaacaggagctgatgattagaggcttggttgcaggctatgggagagaagtatgggaatgaaagagacagatgaactggacattttcatgggtaaggaatgtataattttacagtgttaaataaaatgatgaatgtaagattatctagcttaggtccctgaacacaatgtgtgttaaataaacaaaagctttcttcaaacagaattcccctaagcatttccaggttgttccctgtccagacatagatacaccctgtgcagtcatagatactgttgaaagattcggaaataggaatcaggagccctggagtaacaggcccccagaaaatcagagtggaattgttagtccagaagcttgacaaacatccaccttcattgtcttccaactgtatctctgacttccctctccctagttcattacatcccagtcatattgatatcgttgctgttcttgaacacattaaggagaggcgaatagggtttttagctgctgaaagttagactcgtggctagagaccagactaagtccttttccttcatgtggaggttatgattaggattgtcagagagagttagggtttaattttttcattaaactaataatatgttttgagtatctattgcattatggggcatggagcttattacattcatggtgcagaggaagagggggagttaacaaggcacataaattacatatataaatgaaggtaagtgctatagagaaaaatagagtagagaagaaaatgccataatggggcccgggcattgcattatgtaatatcatcctatatagtctgctatagtccaaatagtctgctatcatttggttttctcattggataaaatgttgtgaacatctctctgggatgaaacaaaaacattctgtattgctgtagtgaaaggtcctcagaagggaatcattttgtcattcctgaggcttgttagatatgaccaacccatccaccgcatctcagtcataactactctaaacaacacccaccaaagggggaaagggcttgctggaatccagccatcagtacatccttgcagcagctgaagactcatttcacttttaccctaacttggccatcatgacagcacccagcccaatattccaaagctaggtatttaacaccataatggggaccactgtttcctaggaggtactgaagggtttcagaggctgcagatacaaatgatgcttactgctatatctgcagtgcagaaagctgagagcaaaagtgatgagatatcaaggctgcctctgtggtctggatgctttctttaagaaactggcaccaagtgtaggctatatgcagactgtccagatcaattgtggcagaccttgaaataacaatcatagctactgtttattgagagcattttgggtcaccttttcaaagtgatttatttttgtccaatgttaagtaaccggcttagaagctgaactcacagggtatggcagggtcagccccaccctcagaaaatccttcagaccaagcatgtctcagccatcaggccccagcatagacagaaaaacacatctccccacggcatctggctgtgatctagaacatctggtgacaggacaaaggtgaggaagactgacaggaaattatcagagcaagcaaataacagtctgaaattcgggtttctctgtgaggctacctctgtccatttctatctctgagcatagtatgtaaaggagttggtgtagtagtcgaatggtggccccccaaaatatatacacatgtcccagaacctgtgaatgtgactttacctggaaaaaagcatttttgcagatgtaattaagtggaggacttcaggatgagaccaccctggattatccaggtgggccttaaatccaaggacaagcgttctttttttttttttattattatactttacagtttagggtacatgtgcacgacatgcaggttagtaacatatgtatacaagtgccatgttggtgtgctgcacccactaactcgtcatttaacattaggtatatctccgaatgctatccctcccctctccccccaccccacaacaggccccggtgtgtaatgttccccttcctgtgtccatgtgttctcattgttcaattcccacctgtgagtgagaacaggcagtgtttggttttttgtccttgcaatagtttgctgagaatgatggtttccagcttcatccatgtccctacaaaaaaggacatgaactcatcattttttatggctgcatagtattccatggtgtatatatgccacattttcttaatccagtccatcattgttggacatttaggttggttccaagtctttgctattgtgaatagtgccacaataaacatgtgtgcgtgtgtctttatagcagcatgatttataatcctttgggtctatacccagtaatgggatggctgggtcaaatggtatttctagttctagatccctgagggatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgacgatgagcattttttcatgtgtcttttggctgcataaatgtcttcttttgagaagtgtttgttcatatcctttgcccaatttttgatggggttgtttgtttttttcttgtaaatttgtttgagttcattgtagattctggatattagccttttgtcagatgagtagattgcaaaaattttctcccattctgtaggttgcctgttcactctgatgatagtttcttttgctgtgcagaagctctttagtttaattagatcccgtttgtcaattttggcttttgttgccattgcttttggttttttagacatgaagtccttgcccatgcctatgtcctgaatgatattgcctagcttttcttctagggcttttatggtttcaggtctaacatttaagtctttaatccatcttgaattaatttttgtatgaggtgtaaggaagggatccagtttcagctttctacatatggctagccagttttcccagcaccatttgttaaatagggaatcctttccccatttcttgtttttgtcaggtttgtcaaagatcagatggttgtagatatgcagcattatttctgagggctctgttctgttccattggtctatatctctgttttggtaccagtaccatgctgttttgtttactgtagccttgtagtatagtttgaagtcatgatgcctccagctttgttcttttggcttaggattgacttggcaatgcaggctcttttggttccatatgaactttaaagtagttttttccaattctgtgaagaaagtcattggcagtttgatggggatggcattgaatctataaattaccttgggcagtatggccattttcacgatattgattcttcctacccatgaccatggaatgttcttccatttgttcgtgtcctcttttatttcattgagcagtggtttgtagttctccttgaagaggtccttcacgtcccttgtaagttggattcccaggtattttattctctttgaagcaattgtgaatgagagttcactcatgatttggctctctgtctgttattggtgtataagaatgcttgtgatttttgcacactgattttgtatcctgagactttgctgaagttgcttatcagcttaaggagattttgggctgagacgatggggttttgtagatattcaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcaaagggaatgcttccagtttttgcccattgagtatgatattggctgtgggtttgtcatagatagctcttattattttgagatacgtcccatcaatacctaatttattgagagtttttagcatgaagggttgttgaattttgtcaaaggccttttctgcatctattgagataaacatatggtttttgtccttggttctgtttatacactggattacatttattgatttgcgtatgttgaaccagccttgcaacgcagggatgaagcccacttgatcatggtagataagctttttgatgtgctgctggattcagtttgccagtatttaattgaggatttttgcattaatattcatcaggaatattggtctaacattctctttttttgttgtgtctctgacaggctttggtatcaggatgatgctggcctcataaaatgaattagggaggattccttcttttgctattgattggaatagtttcagaaggaatggtaccagctcctcattgtacctctggtacaattcggctgtgaatccatctggtcctggactctttttggttggtaagctattaattactgcctcaatttcagagcctgttattggtctattcagggattcaacttcttcctggtttagtcttgggagggtgtatgtgtccaggaatttatccatttcttctagattttccagtttattggcataaaggtgtttatagtattctctgatggtagtttgtatttctgtaggatcagtggtgatatcccctttatcattttttattgtgtctatttgattattctctcttttcttctttattagtcttgctagcggtctatcaattttgtcgatcttttcaaaaaacttgctcctggattcattgattttctgaagggttttttgtgtctctatttccttcagttctgctctgatcttagttatttcttgccttctgctagcttttgaatgtgtttgctcttgcttctctagttcttttaattgtgatgttaaggtgtcaattttagatctttcctgctttctcttgtgggcatttagtgctataaatttccctgtacacactgctttgagtgtgtcccagaggttctggtatgttgtgtctttgttctcattggtttcaaagaacatctttctttctgccttcattttgttatgcacccagtagttattcaggagcaggttgttcagtttccatgtagttgagtggttttgagtgagtttcttaatcctgagttctagtttgcttgcactgtggtctgagacgcagtttgttataatttctattcttttacatttgctgaggagtgctttacttccaactatctggtcaattttggaataagtgtggtgtggtgctgagaagaatgtatattctgttgatttggggtggagagttctgtagatgtctattaggtccacttggtgcagagctgagttcaattcctggatatccttgttaactttctgtctcgttgatctctctaatgctgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattaatccatttaccattacgtaatggccttctttgtctcttctgatctttgttggtttaaagtctgttttatcagagactaggattgcaaccccgcctttttttttttttttttttccatttgcttgtgagatcttcctccatccctttattttgagcctatgtgtgtctctgcacgtgagatgagtttcctgaatacagcacactgatgggtcttgactctttatccaatttaccagtctgtgtcttttaattggaacatttagcccatttacatttaaagttaatattgttatgtgtgaatttgatcctgtcattatgatgctagctggttattttgctcattagttgatgcagtttcttcgtagccttgatggtctttacaatttggcatgtttttgcaatggctggtaccagttgttcctttccatgtttactgcttccttcaggagctcttgtaaggtgggcctggtggtgacaaaatctctcagcatttgcttttttgtaaagcattttatttctctttcacttatgaagcttagtttggctggatatgaaattctggattgaaaattcttttctttaagaatgttgaatattggcccccactctcttctggcttgcagattttctgccaagagatcagctgttagtctgatgggcttccctttgtgggtaacccaacctttctctctggcttcccttaacattttttccttcatttcaactttggtgaatctgacaattatgtgtcttggagttgctcttctcgaggagtatctttgtggcgttctctgtatttcctgaatttggatgttggcctgccttgctagattggggaagttctcctggataatatcctgcagagtgttttccaacttggttccattctccccgtcactttcaggtacactaatcagatgtagatttggtcttttcacatagtcccatatttcttggaggccttgtttgtttctttttattcttttttctctaaacttctcttcttgcttcatttcattcatttcatgttccatcactgataccctttcttccagttgatcgaatcggctactgaagcttgtgcatttttcacgtagttctcgtgccttggttttcagctccagcaggtcctttaaggacttctctgcattggttattctacttaggcattcgtctaatttttttcaaggtttttaacttctttgccatgggttcaaacttcctcctttagctcggagtagtttgatcatctgaagccttcttctctcaactcgtcaaagtcattctccatccagctttgttctcttgctggtgaggagatgtgttcctttggaggaggagaggtgctctgatttttagagtttccagtttttctgctctgttttttccccatctttgtggttttatctacctttggtctttgatgatggtaacatagagatggggttttggtgtgcatgtcctttctgtttgttagttttccttgtaacagtcaggatcctcagctgcaggtctgttggagtttgctggaggtccactccagaccctgtttgcctgggtatcagctgcggaggctgcagaacagcaaatactggtgagcagcaaatgttgctgcaggatcattcctccggaagttttgtctcagaggagtacccggccgtgtgaggtgtcagtctgcccctactgggggggtgcctcccaattaggctactcgggggtcaggcacccagttgaggaggcactctgtctgttctcagatctccagctgcatgctgggagaaccactactctcttcgaagctgtcagacagggacatttaggtctggagagggttctgctgccttttgtctgcctattccctgcccccagaggtggagtctaaagaggcaggcaggcctccttgtgctgtggtgggctccacccagttcgagattcctggccactttgtttacctactcaagcctcggcaatggtgggcgcccctcccccagtcttgctgccgccttgcagtttgatctcagactgctgtgctagcaatgagcaaggctccgtgggcacaggatcctctgagccaggcacgggatatctcctggtgtgccatttgctaagactgttggaaaagcacagtattagggtgggagcgacccaattttccaggtgctgtctgtcacccctttctttgactaggaaagggaattccctggccccctatgcttcccaggtgaggtgatgcctcgccctgctttggctcgtgctgggtgcgctgcacccactgtcctgcacccactttccggcactccccagtgagaagagcccagtaactcagttagaaatgcagaaatcacccatcttctgtgtcgctcactctgggagctctagactggagctgttcctatttggccatcttggctccaccccgacaagtgttcttaaagagacacacagaagggaaacagagaaggccacgtgaaggcaaagattggagtcatgcagtcacaagccaaggaacatctggagccaccagaagatggaaaaggcaaggaagggatcttccctagatgcttcttaggaagtgtggctctgctgacaccctaatgagagacttccagtttccagaacttcaagaaaataaatttctgttgctttaagccacttggtttgtggtaatgcattacagcagtcctaggaaactaatacacttgatgactctctttagcctgaccccacgtttgatgcctaccaccgacacaagaagaagcccaggcagcagcaccactgccaatcctaaatgcctctgcaattgtcatggcctccatttcatgtgcactccctgtcgtatttaaactaagggatctcttgcacctccatcctcccaacaaccatcgaggtcagagcaagctacataatcattaaagagattctccatcttcatggactattcagccaattagtctccaaccttccattctgatggatgcccccactttgcaagacaccattcaaaactatctatgtaattaccagatgcccttctgatacacccttccagacaccttggctcttttacctgctcagattgcatagaaatgggctacagtgaattagtaaattgctattttcctcttacagaatagccatttccctgaaagttatcatttcctcctctacattttctcaggtgtctgctgctcttgacacagtgcagagccaagcacaatgcgtggcacatagaaggcactcaataaatgcttgccaactgaataactagaggccaggcagcttaggaacacccaggaggataacctagaacccacaaaaacgtcagggagtgctctaaacactttcccactggcactgctaccactggcctcctaatacatttcaccactctccttagcttgaccctatttttgatgcctgcacctagtgatggtggaagcctattctgggctccccacagtgggcatatggagcttgcttcgggcaaagtcttcctgccaaagggagaggaatttaccaggtgaacaagcaaaacttcaaggacaacctctaccttctggctagcattctgcctcctgtctcttttctgttttgacctccctggttccatgcattgtgttcagacacccagaactccgtctcttagtgtttggatcaagttctctacttaatattaggctcacaagctctcatgctgtgttttgggagtgtgacagtaagaaatatatacttggtgtttgtctttggtttccaacacagagctttaaaaaataataataatttttaagagacagggtctcaccagtggcatgatcatagttcactgcagccttaaactcctgggcccaggtaatcctcctgcctcagtatcctgagtagctggaatgacaggtgcttgccaccatgctgactcctgacagaattctaaaacccttggaatttcctgagtgacaagggtgataggagcatcttttgttatcatagcaagcacctttcaaccatatctgagtttatgctaacaatgtgactcttggaggataagggctggttgtcctaggaaccaatgaagtgattagagggttggaatttcctccccgacccctcgacctcctgggaggggacaggggctggagattgaggtaatcaacaatggccaatgatttaataaatcatgcctatgtaatgaaagcttcataaaatgcctaaatggtggggctcagaatgctcctggattggtgaacacagccaggggctgagagggtggtgcacccagagagagcatggaagctccgtgtacccccataccttaaactatgcatcttttctgtttggctgtttctgagtcatatcctttaagataaattggtaatagtaggtaaagtgctttcctgagttctgtgagctgttctagcaaattatcaaacatggagagggagtcttgggggaatctccaatttgtaaccaatcagtcagaagtatgggaggcctgagacttgggactggtttctgaagcgagggcagtcttgtgggactgagtccttaacctgtgggattcacgcttactccaggtagatggttaaaactgaactgaattcttggacatccagttggagtccggagagttcagggagacaggatctgcgctatggtatcatacagatcaaacataagaacctcagctacattaccttgaagctgtatgaccttgagcaagtcctctcagattctcagtttcttcacttgccaagtggaaaaaagataagaactatgcaggcttgtttggagacttaggaataatgcgaggattagcaaactggcagggtagttggaacacaataaaatttcaaaatatatcagctcttgttatcactggactatattcacgtttggcctccaaattcatagcatttaatgcagaaaggagttcttgcagaaccctgggcagcctcgctcactctttcagacccgaagaggtgaacagaatactcccaactattcccagatgtttctacagttctctcttactgaactggggatggaaataacaaaagccattagaaaatactagtttgaaaaaattaactttcttagcacttaattttatctctagcaaatgtaactttctagttttacacagtgtcagcagatgtaactcaaaatgccttacaagaatacatcagtcacaaaacattgtgatgtactaaatatcactgaattgtacactttaaaatggtgaattttacctcaatttaaaaaatttgtttaaatgtggttgatacaggagttaagaagaaattacttaggcagatagtgaggctatggacataaggtaaggttttttccttttaatgaaaagcagccccaaattatttttctttctaacaaagagcagcctgtaaaatcaagctgcagatgatgctggcagttgtgccagtcggagcagaaaaaatggtgctgccaacgggaaagtgcatttgcataataagattatggtggggcagccagccttcccccttccctggctatgtaaatgttatacctgatcaaaaccaatctgtgagccctgtgtaaattagacactgcctcctcaagcctgactataaaatcctgcacatctgccacaggccagccttttcctctcagaagtcccctctctcccattaaagagagtgctgttttcctttctctttctttgtctttcttttgcctattaaacctccactctgaaactcctcatgtgtatctgtgtcctaaattttcttggcatgagatgacgaaccctgggtatttaccccatgcaacgtaactgccgcacagtgactgatgttgtctccaggatcagaatgttgacctggagttcattttaaaaacaggttcttgagattctgattctctaggtcaaggtaaagcatagtcatccatgccttgtaaaatctcccttagagattcagatgagtcagagttgagaaccattgattcacgatttaaaatatctcaaaattgggcaaaggatatgaatagagtagaaattgcacttaaaaaaagaaaaagactgttgttatctggctaagatggttggattctgggggcattcttttctctatcatttctattatttgaattatgataaagtttgggttttcttgttgttattttgggggatttttgagacagggtctcactcctgtttcccaggctggagtagctgggaatacagtcacataccaccaagcttggcttttctttttttcttttaatttttagtagagatggggtttcgccatgttgcccaggctgggcttattaatccagggcagattactcatgggcttaagaaatccacctgccttggcctcccaaagtgctgggattataggcatgggccaccatgcccagtctacgataacgtttgagcaatgcatttaactatgtacttttctgtgggtttttattcattttgtttttaggaagaagtgtctgtttagtggtaggggcaagcttgggagctatgaggggggaaaacaaaacatggtccctatagcaccctctggattctccttatccaggagaggatgagaggagctagggtagcatagcaagacctcatctctacattgaacctcttccattcgaaagggtcccaacaccaaaagcaatttcaataaaagcaagatttgatacatgggacctaattaaagagctctgcacagcaaaagaaactatcaacagagtaaacagacaatctacagaatgggagaaaatattggcaaactaggcatcccacaaaggtctaatatccagaatgtataatgagctcaaacaaatcaatgagcaaaaaacagccccattaagaaataggcaaataacatgaacagataacttttcaaaagaagaccttcatgtggccaataagcatatgaacaaatgctcaacatcactaatcattagggaaatgcaaatcaaaactacaatgagataccatctcacaccagtcacaatggctattactgttagtattattattattattatttagacaaagtctcactctgtcacccaggatggagtgcagtggtgctatcttggctcactgcaacctccacctcccgggttcaagtagttctcatcccttagcctcctaaatagctgggactacaggtgtgcgccaccacacctggctaatttttgtatttttagtagagacggggttttgccatgttggccaggctggtctccaactactgacctcaagtgacctgcctacctcagcctcccaaggtgctgggataacagacttgtgccctgatgcccagccacaatggctattagtaaaaagccaaaaaacaacagatgctgatgcggctacacagaaaacggaacgcttatacattgttggtgggaaggtaaattagttcagccactgtggaaagcagtttggtgatttctcaaagaacttatatcagaattgccacctgacccagcaatctcattattgggtatataaccaaaggaatataaatcattccaccataaagacatatgcacacctatgttcattgcagcactatttgcaatagcaaagacatggaatccacctaaatgtccatcagtgatagactgtataaagataatgtggtacatgtttacagtggaatactatgcagccacaaaaataatgagctatgtcctttgtagcaacatggatcaacatggatgcagctggaggccattatcctaagcaaactaacagacaggaacagaaaaccaaataccccacgttctcatttataagtggaagttaaatgttgagtacatatagatacaaagaggggaactatagacatcggggcctacttgaggatggagggtgagaggaagttgagaattgaaaaactacctatcaggtactatgctcattacccgggtgatgaaataatttgtacaccaaccacccctccattgcaacatgcaatttacctatttaacaaacctgcacatgtgcccctgaacctaaaataaaagtttagaaaataaaataaagtagttgtgaaactctttaaaagaaaaaaagggtccccaagcacagctcagcatccctttgtttcctgatgggaggtgggcagtggggatatgaactttccggggtgactgaggctcttcagtgaagcagggtgctatgagatctggaggagagaggctatataggaacagccagggtgcagcagacaacactccaatgctcggttgtcttcagctttccctctgacctcctcccctcacacctcctgccacccaccccacctcccccacaacccatcttccccgccacctccaagtccacttgtaactggcatatgaatgtagactgggcagtacctcatttctgaaagggcttgctgcttccaggaagatttcacctaaggcaaaatcttactagatttgcaagcaaagagcaaacaaccccattaaaaattgggcaaagaacatgaacagtcacttcaaaaacagacattggtgcagccaacaagcttgtaaaaaaatgttcaacattactaaccattagagatacgaaaatcaaaaccacaatgagatatcatctcataccagtcaaaagaaaacatgcggggagaaagggaatcaggtggcagaaataaagggaagtattaaacctacatctatgagccagagagaaaaaaaaagactgaattttaataaaaaaaaaaatgttcttactaggttcttcatttcacagggtaggagaaagaacctcatctctgactatttggagttttcccagtttgctattatccaagagaagatgcttttggatttttttgtatttcttttagggatgtaatcactacttgttattatcctcctctacatttcatttctccctcctccttttgattgtaaactctgacttttcagatcaactcaaacactccctggctgagttgttaccacataaatacctgttgaattactaagtgattagttgaagtggaaaatgtaagaatcgtagagtgttctgcttttactataaaagatttgatgaagcttttcttgtggttcctaggaaaatacattctttttttttgaagcttccacctctctcacagctgatgtcccagcttataagattggaaactgagttgagatatgagtctccaactaggccgtgaggtcctactggccccttcaagccatgttaacaatgccaggttaggagactagaatattgaggtctagtcccagatgcatatagtagtatattactatactgtatattaaggcttcacctgaatgcctcttttggaagttaataagagaccacagggaatttttaattactttaattgagctttttagaatgtggaatttattccattccagtttcaaaaagactctagtgtcagtatcccaatcttcccccacaccaattacctatttccactctgtaactgatacattaccaaagtttattatgcagaattaacatgacctagctgcaaggtccacagccagaaaacagacatgtcgaagagtattagttaaaatgagagcttttacataacaataatcaaatcggtatgtagttatgaatgagtatcttttttaatgtcaaaaaattgagcagactcataagacaatcgttgtgcattaagttacccattgagaaaaaataattgattacttttttccttttttttgagacagggtcttgctctgtcacccagggtggagtgcggtggcatgatctcagctcactgcagccttgacatcccaggctcaggcgatcctcccacctcagcttccccagtagctgggactacaggcctgtgccaccacgcccagctaattttttgtattttttgtagagacagggttttgtcatattgcccaggctggtcttgaactcctgggctcaagcaatcttcctgcctcagtctttcaaagtgctgggattccagatgtgagccaccaaaccaggtgaataactcatttttaatttaatgaatttatttaaaatttagtaaagattttgaaacttgttttcttcagcataagaagtatctacatatatcttaaaatgtaattattcacatatgttcatgatgtgtctgacaggcaaggaaggcacggccatttatgtctctataaatcctctaagaacacaagaaatcctctaagaacacaaatgactctggaggtgacaaggcccattggagatttttaggtggagtggaatgatgacattgattttttgaaaagctaaccttgacagctgtagggagaaccaactgcagttgggaactcagcagcccagaggtcaattaggaagcagaggggaatgccggctgcgctgggatgcagagacgcctctgtggtgacttggagaccaacggaaattacaatgagggagagagaaaatccaaagtgttcttaaggggtggattaaaggagaaagcatgataagaaataagaaatatcagagaaggaggtgttgaaatagggacaattgaagggtagaaaaggggttgaaaggagggacaagtaatatgaatttagtttaatacctactaaggcagaagtacctgagctacatccagtgggtagttggatgtcagtctaaaaccaaggagatctgagttagaggtttagaagataatgaaatatagtcgttataacaacagcttcaaagtcaaatagacaatgggttcaatcaaagttctgccacgggattagacaaaatttggggtcttactgagcatacacttcttcattttagaatgaagatggtaattctcagaagagtatttggtatgaattgggtgagacaaggcaggtacaaaagttagcaaagtgcctggcacaagtactatgctaactgctcagtaaatgttagatgccgttactattacgtaagttattgagtcatgaatagagtaggaattgaagccaggatggaagctgataaccctgaagtgtgtgagacaggagaatcaaagacagggccttggggatgccaacccaggaggggcaggcagagctggagcaggcaaaacagactaagaacacacagagacagggggacggagaatcaggattgggtgataacctggaagccaatgaaagaaagagttgcagcaagtaggaggatggttagaatcgtatttagcagataagcagcagaaaattaactattagatctatcaataagtatgtctttgttgacctgaacagcaatttgaagaaagatagggtagaggcagtgcacagagacagcattcagctttcctatcagtctgaaagtttaattattaaaatagccatataattctgaaagagtgaatataatctagctaaaaaccaggcagggactaattactagtattaacacagctgaagcggatctcctcaggaaccttcccctcagtgtgtgatcatgctagtatttctcccatcttaaaaaagtaaaaacaaaaacaaacaacacaataacaaaaaaatctcttaactttacaactctgcagctctacttctttttccattctacttctgctccatttctctcattaccttcacagcaaaactctgccagtggttggtctaaattccccatttccagtttttttatattctctcttacacctactccaaaatggcttctctctgacattccactaaaactcttgtcagagtcaccaaggacttccacattgcaaaatccgatggtcaattctcagtcctcatcttcgttgcctgattagcaacatttgatacacctaatcaccctttttctttaaatatttgattcatttagtttccagaatgcacattctcttcaccctcctcttttttcatcagccactctctgagtctcctttccttgttcccttttatcgtcttgacctcttaatattgaagagccctaagctcagtccttagacttctccaatatatattttaaatctatgcactcctcactcaacaatctaatccagtcttgtgacaaaaataaattgtatgctggtaactcctaaatttgtattttaagcctagaactttccagaaactccaaactactacttccatgttcatttaaagatttttatttgaaaccctttttttcaaaaaactgtccatttaaaaaataaatatcaacaaaagcaatgcatcatctcttttaatttttattttaggtttgggggtacatgtgaaggtttgttacatggataaacacgtgttgtacatattattacatcatcctcgtattaagctcaatatccaatagttatcttttctgcttctctccctcctcccaccctgccccttcaagtaaactcagtgtgtgttgtttccttttttgtgtccataagttcttatcattaagctccctcttataaatgaaaacatgcggtatttggttttctgttcctgtgatagttttctaaagatgataacctctggctccatccatattcccacaagagacatgatctcattcttttttaatggttgcataatattccatggtgtatatgtaccacattttctttatccagtctgtcgttgatgggcatttaggttgattccatgtctttgctattgtgaatagtgctgcaatgaacattcccatgcacgtgtctttatggtagaatgttttaaatttctctgggtatatacccagtaatgggattgctaggtcaaatggtaattctgcttttagctctctgaaaaatcaccatactgctttccacaatagttgaactaatttactctcccaccaacagtgtgtaggattcctttttctctgcaacctcacaagcatctgttatttttttctttttagtaacaaccattctgactggtgtgggatggtatctcattgtggttttgatttgcatttctctaatgatcagtgatattgagctttttctcatatgttcattggccacatgtatgtcttcttttgaaaagtgactgttcatgtcctttgcccccactttttaaggtggttgcttttttttttttgagacggagtttcactcttgttgcccaggttggagtgcaatggcgcaatctcggctcactgcaacctctgcctcccaggttcaagcgattctcctgcctcagcctccctagtagctgggattacaggcatgtgccaccacgcccggctaattgtgtatttttcatagagatggggtttctccatgttggtcaggctggtctcgaactcccgacctcaggtgatccacccaccttggcttcccgaagtgctggggttacaggagtgagcacccaaccttgtttttctcttacaaatgtcagttccttatagatgctggatattagaccttcgttgaatacatagttggcaaatattttctctcgttctgtagttacttgcttactctgttgatagttccttttgctgtgcagaagctcttaagtttaattagatctcatttgtaattttttatttttgtcgtgtttgctttttgtgtctttgtcgtgaaatctttgcccatttccagatccaggatggtattgcctaggttgccttctagggtttttatagttttgggttttacatttaagtccttaatccatcgttttaaatatttatttattcttcaacttttcttttaagttcaagtcctgcacatgtacaggacgtacaggtttgttacataggtaaacgtgtgccatgtggttggttgtacagatcataccattacttaggtattaagcccagcatccgtaaacaattcttcctgatgttctccctgcccttgcaccaccaacaggtcctactgtgtgttgttccccgcaatgtgttcatgtgttctcatcattcagctcccacttataagtgagaacatgcggcctttggttttctgttcgtgtgttagtttgctgcggataatggctcccagatccatccatgtccctgcaaaggacatgatctcattcctttttacgactccatagtattccatggtgtatatgtacaacattttctttatccagtctgtcactgatggacatttagattgattccatgtctgctattgtgaatgctgcaataaacatacacgtgcatgtatctttataatagaatgatttatattcctttggttatatacccagtaatgggactgctgggtcaaatggtatctctgcctctagttcttcgaggaatcaccacactgttttccacagtggttgaactaatttacgctccaacagggtaaaagtgttcctttttctctgcaactttgccaggatcttttgttttttgactttttaataaaagccattctgactgcagtgagatggtatctcactgtggtttcgatgtgcatttctttaatgatcagtgatgttgagctttttttcatacgttcgttggctgcatgcatgtcttcttttgagaagtgtctgttcatgtcctttgtgtgctttttaatggagttgtttgtttttctctcgtaaatttaagttccttgtagattctgatatcagatctttgtcagacagatagattgaaaaaattttctcccattctgtaggttgtctgttcactcttgtgatagtttcttttgctgtgcagaagctctttagtttaattagatcccatttgtcaatttttgcttttgttgcaattacttttggtgttttcatcataaaatctttgcccatgcctgtgtcctgaatggtattccctagattttctcctagagtttttagtttttggttatacatttaggtctttaattcattttgagttgatttttgtatatggtgtaaggaaggggtccagcttcaatcttctgcatatgactagccacctatgcaagcaccatttattgaatgaatagggagtcttttctccattgcttgtttttgtcagaaaagcaaaacatcttaaccttaaaactcaatcagttttcatgtgtcttcctcagaccaaaatttaagaagatgtcctactcctgctaggtgcatgtaaaactattactatttttggtctatagtagcaattatgggtctcaaatcaatcctttcagaaagtccatgatgtcaaagatattttcataatatgagacatgacctgaatttttcactttcatacacccaaatgtacggagtacaaaaagttcattgataccatttctgtttccacattatagcaaacctttagtaaactagtacttaaacaatttgatgtcatatcaaaaaatactcacaattgtctaaaaagaccattaaaatactactccttttttcagctatacatctgcatgaggccaaattatcttcatgtgtttatctaacacagtatatcacagcagattggaagtaaacagatgtgagaatccagctatcttctaggacaaacataaaagagattacaaaatttgtagacaatatcactcataactaatttttatgtttgggaaacataattatttcttgtaaaaattattatttatgttaaaatgtaaagggtttattattgttctatttttacttttgtccagctttattgaagtataattaacaaataaaaattgtatatatttatggtgcactatgtgatgttttgatatatattcacatagtgaaataatccctacagacaagctagttagcatatgcatcctctcacatagtcagcattttgtgtatgtgtgtgtgtggtaagaatatttaaaatctactctcttagcgaattttaagtatacaatatagtattattaactatagtcaccatgctgtccattagatctccagaactttcattctgcgtaactaaactttgaacatgctgaccaacatccctccctctgcctcatcccctagcctccagtaccacaatgctactctctgcttctatgaggttgacttttacatatttcacatgtaagtgagatcatgttactgtttatgtttctgtgcctggcttatttcacttagcatgatgttctctacattcatctatgttgttgtaaatgataggatctccttcctttttatggatgaataatattccattttatatgcccattgacacttagattgattctatatcttgactaatgtgaataatgctgcagtaaacatgggagtgcagatgtctctttgacatactgattttctttcaatatatgcccagaagttggattgcttcatcatatagtagtttcatttttaatttttttgaggaacctccacagtgttttccattatggctatgccatatcatgtacccaccaacagtgtgcaagggttttcttttttctctttgtccccatcagcatttgttatccttctttttttgatactaattattctaacagatatgaggtgatatctcactgtggtgttaatttgcattttcctgatgattagtgatttttagcacctttatatacccctgctgactattggcatgtcttctttttagaaatgtctatcaagccttttgcccttttgaaaattgtttttttttccttgttattagttggttgagtttctatatattttggatatcaacacctcatcaaatgtaaggtttgcaaataatttctcctaatctaatctgtaggttgtcttttcattctgctcactgttttctttgctgtgcagaaacgtttcagtttgatgcagtcccatttgtctatctttcctgttgttgctcatgcttttggggtcatatccaaaaaaatgatttcccaggccaacgtcagaacacttttttccctatattttgtctagtagttttacaggttcagacatacattcaaatatctaatccatttttagtttatttttgtatatggtatgtgataagggtccaatttcattttttgaatttggatcctgttttctcatgtagtgtgatgccttcagctttgttctatttctttcatctttcaaaagtttttttaattttaatttttatttcaatagttttggaggaacagatggtgtttggctgcacaaaaaagttctttactggtgatttcagagattttggtccacccgtcacctgagcagtgtacactgtacccaatgtatagtcttttatccctcacccccttcccatccttccccctaagtccccaaagtccattatatcatttttgtgtctatgcatcctcatagcttagctctcacttataaatgagaagatggacagtgtttgattttacattcctgagttacttcacttagaataatggtctccaactccatccaagttgctgcaaatgccattatttcattcctttttatggctgagtagtatgctgtggagtatgtatactatattttctttattcacttgttggttgatgggcatttggctggttccctatttttgcaattatgaattatgctgctataaatgtgtatgcaagtgtctttttcatataatgacttcttttcttctgggagacatccagtagtgggattcctggatcaaactagctctacttttagttatttaaggaatctccacactgttttccacagtggttataatactttgctttctaaccagcagtataaaagtgttcctttttcaccacatccacaccaacatctgttattttttaattttttgattttggccattcttgcaggagtaaggcggtatctcattgtgattttgatttgcatttccctgataattagtgatgttgagcattttttcatatgttttttggccatttctatatcttcttctgagaattgtctatttatgtcctttgcccacttttttatgggattatttgcttttttcttgctgatttgtttgagttccttacagattctgaatactagtcctttctcaaatgcatagtttgtgaatattttttcccactctatgggttgtctgtttactctgccaattatttctttggctgtgcagaaaccttttagtttaattaagtcccatctatttgtttttgtttctgttgcatttgcttttgggttcttggtcatgaactctttgcctaagccaatgtctagaagagtttttctgtagttacttttcaggatttttatggtttcaagtcttagatttaagtctttatccatcttgagttgatttttgtataagatgagagataaggatttagcttcattcttttagatgtggcttgccaattatcccagcaccattggttgaatatggtatccttttcccactttatgtttttgtttgccttgttgaggatcagttggctttatttctgggttctctattctgtcctattggtctatgtgcctatttttatgccagtaccatgctgttttggaaattgtagccttgaagtatagtttgaagttggataatgtaatgcctccagatttgttctttttgtttggtcttgctttggctacgcaggctcttttttggttccaaatgaatttagaattattttttctagttctgtgaagaatgatgaaggtattttgatgggagttgcattgaatttgtagattgcttttggcagtatggtcattttcttttcttttttttttttttttttgagatggagtctcgctctttcacccaggctggagtccagtggcatgatctcggttcactgcaagctgcgcctcccgggttcacgccattctcctgcctcagcctcccaagtagctgggactacaggcgcccgccaccatgcccggctacttttttgtatttttagtagagacggggtttcactgtgttagccaggatggtctccatctccttaccttgtgatccgcctgcctcggcctcccaaagtgctgggattacaggcttgagccaccgcaccagcagtatggtcattttcacaatattgactctacttatccataagcatgggaggtgtttccatttgtttgtgtcatccatgatttctttcagcaatattttgtagttttccttgtagagatctttcatgtccttggttaggtatatgcctaagtacttttttttttttcagctgttgtaaaaggggttgagttcttgattcaattctcagctttgtcactgttggtatgtagcatgctactgatttgtgaacatttattttatttcctgaaactttactgaattcatttatcagatctaggagctttttggatgagtctttagggttttctagatatacaatcatataatcaatgaaaagtgacagtttgacattctctttaccaatttggatgccttttatttctttctcttgtctgatttttctggctaggacttccagtagtatgttgaatagaagtggtgaaaatggacatccttgtcttgttccagatctcagggaaaatgctttcaacttttccccattcagaattacattggctatgggtttgtcataaatggcttttattacattaaggtatgtcccttctatgccgattttcctgagggttttaatcatagagggatgatggattttgtcaaatgctttttctgcatctattgaaatgattctgtgattttcgtttttaattctgtttatgtggtgtatcacatttattgacttgtgtatgttaaaccatccctgcatccctggtatgaaatccatttgataatggtgtgttatttttttttgatatgctgttggattcggttagctagtattttgttgaggatttttgcatctatgttcatcagggttattgatctattgttttcttgtagtgtcaacaagattggtacaaattcttctttgaatgtctgatagaattcagctgtgaatccattgggtcctagacctttttttgttgacaattttaaaattaccatttcaatcttgctgcttgttattggtgtgttcagactttctatttcttcctagtttaatctaggagggttgtatatttttaggaatttatccatttcctctaggttttctagtttatgcatgtaaaggtgttcatagtagccttgaatgataatcttttgtatttctatggtattagttgtaatatctcctgttttgtttctaattgaacttatttagatcttctctcttcttttcttggttaaccttgctgatggtctatcagttttatttatcttttcaaagaaccagctttttgtttcatttatcttttatattttttgtttcaatttcatttagttctgctgtgatctttgttatttcttttcttctgcttggtttgtgcttgatttgttcttgtttctctagttccttgaggtgtgaccttagattgtctatttgtgctctttcgggttgttttatgtaggcattttatgctatgaaatttctccttagtacaacatttgctgtatcccagaggttttgttaggttgtgtcactattattgttgagtttaaagactttttaaatttccatcttgatttcattgttgacccatcttgatttcattgttgacccatcttgatttcattgttgacccagtgatcattcaggagcataaaatacatggattttttttttttattatgagggttcatcttggagttaatttccgattctatcccactatggtttgagagggtacttgatatactttcaattatcttagatttattcagacttgttctgtggcctataatgtggtctgtctctgcgaatgtttcatgttctggtgaaaagaatgtatgttctgcatctgttgcatagaatgttctgtaaatatttattaagtccattttgttgtaggatatagtttaagttcattgtttctttgttggctttctgtcttggtgacctgtctagtgctgtcagtggagtactgaagtcccccactattattgtgctgccatctgtctcatttcatgtctagttataattgttttataaatttgggagcactcatgttaggtgtgtataaatttaggattatgatatttttctgttggactgatccttttatcattatataatgtccctctttgtctttttttaactgttgttgctttaaagtctgttttgtgagatataagaatagctacccctgctcacttttggtttccattttcatggaatatcttttcccactcatttaccttaagtttatgtgagtccttgtgcattgggtaagtctcgtgaagacagcagatacttgattggtagatttttctccattctgccattctgtatcttttaagtggagcatttaagccatttacattcattgttagtattgcgatgtgaagtactgtggtattcatttttgctacttgttgcctaaatccctttttataattgtattttgttttctaggccctgtgagatttatgctttaaataggttctattttggtatattttgaggatttgtttcaacatttagaactccttttagcatttcttgtagcactggattggtagtggtgaattctttcagtatttgtgtgtctgaaaatgactttatctctctttcatttatgaagcttagttttgctacagccaaaattcttggctgataattattttgtttgaggaggctaaagatatgaccccaatcccttttggcttgcaggatttctgctgagaaatctgttattcatctgataggttttcttttataggttacttaatgatttttgtctcacagctcttaacaatctttcctttattttgactttagataacctgattactatgtgcctgggattactatctttctgcgatgaatttcacaggtgttctttgagcttcttgtatttggatgtctagatcttttgcaaggccagggacatttttctcaattattccctcaaatatgttttccaaacttttagatttctcttctacctcaggaataccaattattcttagatttggccatttaacataattccaagtttcttggaggccttcttcatttttaccaaattccttcttctttgtttttgtctgattgaattaatttgaaaagccttgtatttgagctctgaagttctttcttctacttgtttgattctattgttgaaactttccactgcattttgtatttctctaagtctgtctttcattactagaagttgttatttaaaaaatatatatatacacatatatatacttatacacatatatacatacatatatatatagacacatacatatatatatatataatacgtggagcatttttcatccatatcctgttttttttaatttaagttagtctccacctttctctgttatctccttgagtagcttaataatcaaccttctgaattctttggcaatttagagctttcttcttggtttggatccattgctaaggaactagtgtggtcttttagggatgttacagaaccttgttttgtcatattgccagactaacttttctgattccttctcatttgggtagactatttctgcacaaaagtctggaactcaagggctactgttcagattcttttgtctcatgaagtggtcccttggtgtggtgtgttccccctttccctagggatggggcttcctgttagccagactgcagtgattcttattgctcttcttggtctagccacccatttgggctactgagctctgggctggtgctagataatgtctccaaacaatcctgtgatgtgatccatcttcaggtctcccattcatggataccagcacctgctctggtggaggtggcaggggagtgaagcagactctgtgacagtcctcggttgtagatatttttagtgtgctggcttcttaaatacttgttacgctagcagtgaagttgttacatggacacactcaggacacactctggttagccaggatgttgcgggcagtggaattagctgttgccttgttcttcctgggatcaggcttattttgtcatgagttgctataaggatctgagttggttggcctccagccaggaggtggtgctttcaagagggcaccagctatgatagtagaaggtggatataagcttgccctaagttgaccagggtaactatttgggtttctcaggcaatgggaagggtcataaagctcccaagagtttatattttgtgatacgctaccaggacaggtagagaaataccatcaggtgggagcagggttaggtgggtctgagctcagacacttgagtggggcttgttgtgaccactgtgggggatagggggtagttcttgggccaataggcttatgttccagaggaaattatggctgcatccgtggctagggaagtggtggaaaggcattagtgataggccttacccagttcccacgtgttggtgagactggtatcttttccactgtaccctgctaacagcgctaagtttgtctccaggcagcctgtccacaggactcagaccttaccccagactataagtttccccactgagaaagcaagcaaggctttcaggccatgccccttcctgtctgtccacactgtctgcctcaactcctgctctactctttgaggcaattcctgttcacccccagattctgctcaagaaagtttgcacccagtcaaaattattacatagttcagttggaagctcctttcatgctgtgacccctcccgaattttgccagctgccttcaccaaggttccctgtgagatatagtcagggatggcttctctgggctcaagctggagaacgagagtgcctacaaggctcttcccctgctgcttctatttttatattttatgctaaatccgtttaatctctaggtaaggttaagtcctttcctcatgatttgaattttcaggctctccagtggcaacatgtattcagaggcaggttttccccgctcacgctttgggaatgcacggttttttgcctgtctcatggaatatacagcatactgccacttctttcaaaggatctgtgaattctttcagtttttctgttatggtgctgctattgttcctgaaccaaaagtccatggtgtgagtctttatacactgttgtgtctgtccaagtgggtgctgcacatcagccctgtcccatatccatcttccatttatctcctggctttgttctttttattcaagatgactttggctactcggggccttttgtgcttccatactaattttaagattttttttttctatttctgtgaataatatcatcagaattttggcagacattgaattgaatctgtacactgctttgggtagcatagacattttgataatattaattcttacaacctatgaacacaggatatctttccatttatttgtatcttcttcaatttttttcatcagtgttttatagttttcaatgtacagatcttttgcctccttggttaaatttattcttatgtatgttttggcagctattgtcattgaaattgctttcttgatttctattttggatagttcattgttagtatgcagaaatgctactgacttttgtatgttgattttgtctcctgcagttttattgaatttattggttctaacagttttttgatggtgtctttaggattcttctgtgtataaaatcatgtcatctgcaaacaaagaaaattttacttctttctttttgatttggatgattttatttctttctcttgtctaattgttgtggctaggacttccagtactacatatattgtttgtttgtttgttcgtttggagatggaggcttgctatgttgcacaggctggactcaaactcctgggctcaagtgattcttccatctcagcctcccaagtagctggaactataggggtacacaagcatgcccagcttagtactatattgaatggaagaggggagattgggcaatcttgtcttgttcctaatcttaaaggaaaagctttcaatttgtcactgttgagtaagatgttatctgtgaacttgtcatgtatgacctttgttatgtttaggtagtttctctctcttcctactttattgggtgtttttatcacaaaagagtgttgaattttatcacatgcttttttttaatctattgagatgatcacatggtttttgtcctttattctgtgaatgtggtatattacatttattaatttatttatatttaaaagtctgcaccctagggacaaattccacttaatcatggtgaatgagccttttaatgtcctgatgaatttggtttgctagtattttcctgagaattcctgcatctatgttcatcaaggatattggcttgtattttattttcttgttgttttctgacctgactttagtattaacatactggcttcataacatgagtttgaaagtgttccctccgcttcaatgttttggaaaaatttgagaaggattgacattagttccttaagtatttggtagaattcaccagtgaagccatcaggtcctaggcttttctttttattgctgattcaatctttttcctccttattggtctgttcaaattttctattttttcatgactcagtcttggtggctgtttatttatttattctaggttctttgatttgttggtatataattgttcatggcagtctcttatgacactatatttttgtggcacctgatgtaatttgtctttcatttctgattttatttatttcattcttttccctttttttcttactctagttaaaatattgttgattttgtttatcttttcagaaaactcactcttatttgcattgatcttttctattgcttttctggtctctatttcatttatttctaccctcatctctgttacttccttccttctactaactttggccttagtttgcttttcttttttctaattccttgaggtgtaacagaaagctgtttatctgaaatctttttttcttttttgatataggtgtttattggtataaactcctgtcttggaactgcttttgcttctttctataagttttggtatgctgttgtccattttcatttttctcaagattttttttaaatttctctttcaatttcttctttgatgcattcattgttaagtagcatgttgtttaattttcatatacttgtggaactcagaatctttggacaggctgactggtgaagggctttccctgccaaagccagtttataaagactgaaagaggtgcctacttcttcaattgtgcaaataccaatgcaaggccacaggattatagataattggggaaagataacactaccaagggaacaacaacaacaagaaatggagatctataaactgtctaaagaagaatgcaaaataatcatttttaagaagctctagggagttccacagacttggtcaagctggtctggtgtttggtcagtgggtagatgatcctagtaccctgatccatcaagttaattttgggatctaggtctgtaagtgcaaggctggatcttgagtttacaagggttttctggtgctggggtccacttatgtgggtctggaaactagagccacaggggtatttcagaagcctgggtccatgggggctaacctgatgttggggggaactcctgatcttgaatacaaaggcttatatagccctggggcagtcctagtgtctggagtctggcggggatgtcctgaacctgggtttatgagtgtgggcctgggtttatgagtgtgtgtatgcaggggccagccctggtgctggggtctactggggcaggcctggaaaccagatttgtagggttgggcctggatcctgcatctggggttcaggtctggagcctgagtccaatggagcatatatcattaatttaaaaagaatagataaataaatatttttaaaatttttcttttctaatttcttatactgtaaatattgatcagtaccattcaggtaaacaaaagctctttgggggtcctaaataattttctcaggctctaaagaagtcctaagattttaaaaagtttaagaatcattggtttataaaaatttttttgttaaatggagctataatgctcagaataggcaaatcaatagagacagaaatgagattagtgattgcctagggttggtggcggtagtgggctggggtgggattagaaattagttacttaacaggtacagaatttctttttgaggtgatgaaaatattctaagattgtctgtggtgatggttgcacaattctatgaatcaagtaaaaagcactgaattgactttaataggtggattttatggtatatgaattatatctcaataatattgttacccaaaaaattgagttataatactggagattgtgggaaatttcagctcctcagcttttgtaaccatgacatcctcccacatatctaaaaatatgtggcatttttagcttaaagaacaaagataatatgccttgtggtatctccgccaaactgagtgaagatctcaaggtacctctaagattctcaaggagactcaaacaaataacattatgacctgggtatgtactggtaaaaccactgagccaataccccagtggaaggatccttcttctctgcttctaatcacatatgtctctggtaagtgtcactgaaagtggtagtcaatcattacaccccctagaaagacccataaatatatgggtatagatatttgggttaaaatctacaagggagtggaagctgatgaagaagaaaaacagtttccataataaacagaacttgttgtcatatatcctaacaggtaaatctcaaggtttccttattctactgcctttcagaataaacactgagactcctgcattgtgtgttagtgttttactttcctaggcaaatattgtgaattctccttaaatcttaaatattttattggataattaatataacttctttcaactgcaggtagtcgcctttaaacaatcttcttccaatttgccaacttaagaccacaaggtatgaccttcaccagtctgacccattcccacatatcacaaaatcccagtgtgtcacaagacccaagatttccatttatagtacatgttgtgatagaccataaatgcctatataagtttaaaaagaaagaaaaggaaacaagaatgtaagtaatgggaagaatatgggaaaatggaggctaatgtggtctctattcgttgagtgagttgaagtagcatgtcagaggttgctcatcacatcataatcatcataaatttgtatagatttacacaaatttgtattgatttatgatgtaaaactataacaattttctagcatgtggcagtacagtgtcttgaggaaggggtgctttttttctagttcacaaaaagttgccaacattagtcagcagtgatggaaatagcccttcttattggctgactatggagtactttccaagaggaaattaggttacagaatatatataatgaaaacccatcattttgaggtgctaaggaactaggagtgatattttctttagcctcttgctggtttgtggccattatcctccttccatcttgcaatatggttttcatgtacaaaaatgttttatttaaaattctgaggctagggtcttttttcacaataccacacacaacaagcaaaagattggttgatccagaattggggttgattagagcaatgctagaagtaaaaaagaacaaggaagaaaaaaaggtatgggatgaatatcactgatgtcacagaatgtaagtttagactggaaaggttaaggaaaaataaatcattaatagaatggaagcatatagaggaatggaagaaaatgtggtctcagtgagttgaggtagataaagcaatggaaggagcagaagaattgagaacttccctgccctaataactgaaacaaaaatgcccatgagaagagaaagatgtgtgcttgatctccagccataagtttagcctatagaagctgaagacagaattatctgtgcacaattctgaccaacatgaacaggcccagcattagatttcaaaatctaggcttgcaaaatcacagaaagcctcatgtgtctcaagagtatctgggtaccaatggcccacccctgcccctacttgctagggaactagaatcaagaattattagcaaccaaagctgcctttaagtatatgtagaatgtcgaataatggcccacccaaagatgttcatctaaattcccagaatttgtgaatatgttatgttatacagcaaggaaaaataagattgaggataaaatgaaggttgctaatcaactgactttaagattagaagagtgtcctggattattcaagtgtgcccaatgtaatgacaagggtcttttaagtgagtaagagggaggtagaggccaggtgagaagagagatttgaagatgacactctgctggctttcaagatgaaagtgggccatgagctgagtaatgtgggtaacttctagaagcttcaaaagatgggggtatagattctctcctaaagcttctgaaaagaaaagcagccttgccaacatcttggttttggaatttcagcagatgcagaaataacaataaatgctagcatttaataaatctactttaattcatcatttcaagtacgtgcacttctccatttgctaagtgcccagtggccaacactatctgaaagatgcccaatctggaaatgcagacaccaggtgaaaaggttgctattaacccagatatctttcaagtaagaactttaccactacctggtcctcatggaagaagcagaaagacattctttctgtagagaacatctagagggaattctaggtattaggaaggctgagagctttatcaaaacaagtaaaggaacaggaagcagcaaaatggagatgcttccccagcagaccctactgtgttggttgatttttgctgtggaataaagagttgcaaaattttatgcaacaacacatttgttctactcatgagtttttgggtcaatggaggtggctctgccttggattgcaggtctcagtcagctgtataaggcttttttttttttttttcggggtctcactctgtcacccaaactgaaatgcagtgatgcaatcacagcttattgtagtctcaacatgcaggctcaagcaaccctccgacctcagccaccctgagtagttgggactacaggcatgcaccactatgcaagtaaccctcctacctcagccatcccgagtagctgggactacaggcatgcaccaccgtgcctggctaatttttgtagtttttgtagagacagggttttgccttgttgcccaggctggtcttgaactcctgggctcaagcaattcgcctgcctcagcctcctatagtgttgggattacaggtgtgagactccatggccagccctctgtgtaacttttatcctctttgatcactaggcttaccatggcatgtccctcaaaatgataacagatacgcaagatgattaaccccactgtgcaaggatatttcaagtggatgaaagtgctaatatcctattgctcaaagcaagtcacatggccaagcccaatgttaagggatggggaatttcactctttccacaagaaaatgtgtggataaagagaggagtgaagaattgaagctaataattcaatctaccaaaaatattatctgtcttagtctattttgtgctgctgtaacagaacacttgagactgggtaatttataaagaatggaaatttattttctcacatttttggaggctaggaagtttaagatcaaggtaccagtagattatagcctggtttatctgcttccaagatggcaccttgaatactgtatcctccagaggaaagggacaccatgtcttcacatgagaagagcagaagagagggaaagagagagagtgagacagagagacagagagcccactcccataagcccttttttatggtgacattagtccattcataagggtagaacccttttgatcaaacacttcccattagcctccacttcccaatactgttgtattggggattaagtttcttacacatgcattttggtgggacacattcaaaccatagcactgtccattggatatctgaaccgaatctgcagggaactttggtgacacagatattcccaattagtctctctagctggatattgactttgacatctacctacagggaaaggacaagcctaggtggccaaagggtctactttagccttgcaatctaaaatgtctttggaaaaacctgactatggcttctattttattttattttatttttttagagataggatcttactctgttgcccaggctggagtgcagtagtgggattatggctcactgcagcctcaaaccctggactcaagcaaccctccacactcagcttcctaagtaactaggactgcagagatacaccaccacacccagttaattttttaatttttgtagtggcagggtcccatgttgcaaaggctggtcttgacctctgttctcaaggaattgtcctgccctcaattcccaaagtgctaggattatagccctgaaccactgtgcccagttggcctttattttagatacatttcctgccaccttcaacctatattgtgtcccgaaagttcttcctaaaagcaaggccatctattacaatcttatttatcaaagaacatttttgtatttatgtactgtccagctgtctgcaccccaatcttcaattcacatgctttttccacgtaggaggacattattccaagtagccctgctttgcaatgcccgaaatactcagacagaagggactctttttgtatacctgctaagacatcatagcttttgcacctacccaagccaaatggcattttcctgtggcaatcactgcctttgttgcaggttgcattctcccagaagcagactttgagaaagcaattaacataaaggagttttatttgggagtactctttaggtcaacagctatggaagggaaagggccaggatagagcagggagaggttggattataacgtgtcaatgaacatgtcatccaaccccattggagctctgaagctgaaagagcccttaaagttgtcccaagttgggattatatagctaggcctttatgactctgcatcaatcagtcgttggttaaggagtgtaacgttagacaagaaaagtcctcagctgaaagcagtgaatggagggctctcaaccagcagtactcggatatggctggtgcaccacaccagcctatcctatgcaaaatggcatagttccctccaataagttcctgttataacagttccctgatccccactcttcctggagccactgacagctaacagcaataaaatatcaagagaagcaaaacaacacatggtaggttcagagggaaagctgagggcagcatctctgtaatttttgagattcgtggatagcctctctaattacgaatatctcaaaattgtgcaaaacagagaatacatttgctggcaagatggccgaataggaagagctctggtctgcagctcccagtgagatcgacacagaaggcaggtgatttctgcatttccaattgaggtacccggttcatctcattgggattggttggacagtgggtgcagcccatgtggagggcaagcagaagcaaggtggtgcgtcacctcacctgggaagcacaaggggtcgggggatttccctcccatagccaagggaagccatgagggactgggctgggaggaacggtgaactccagcccagatactgcacttttcccatggttttcacaacccacagaccaggagactccctccggttcctaggccaccagggccctgggtttcaagcataaaactgggcagccatttgggcagacactgagctagctccaggattttttttgttcatatcccagcggcacctggaaccctagtgagatagaactgttcactcccctggaaagggggctgaagccagggagccgagtggtcttgcccagtggatcccacccccacagagccagcaagctaagatccactggcttgaaattcttgctgccggcacagcagtctgaggttgccctgggatggtagagcttggtggtgggaggggcgtctgccattgctgaggcttgagtaggcagttttaccctcacattgtaaacaaagccgtcaggaagtttgaactgggtggaacccaccgcagctcagcaaggctgctgcagccagactgcctctctagattcctcctctctgggcagggcatctctgaaaaaaagacagcagccccagtcagggacctatagataaaaccccatctccctaggacagaacacctgcgggaaggggcggctgtgggtgcagcttcatcagacttaaatgtccctgcctgatagctctgaagagagcagcagatctcccagcacagtgttcaagctctgataagggtcagactgcctcctcaagtgtgtccctgacccccatgtatcctgactgggagacacctcccagtaaaggctgacagacatctcatacaggagagctctgggtggcatctggcaggtgcccctctgggacaaagcttccagaggaaggaacagacagcaatctttgctgttctgcagcctctgctggtgatacgcaggcaaatggtctggagtagacctccagcaaactctagcaaacctgcagcagaggggcctgactgttagaaggaaaactaataagcagaaaggaatagcatcaacatcaacaaaaagaacgtccactcagagacctcatcccaaggtcaccaacattaaagaccaaaggtagacaaatccacaaaaatggggagaaaccagcacaaaaaggctgaaaattccaaaaaccagagtgcctcttctcctccaaaggatcacaactccttgccagcaagggaacaaaactggacagagaatgagtttgacagattgacagaagtaggcttcagaaggtgggtaataacaaacaacaaactccttcaagctaaagaggcatgttctaacccaatgcaaagaagctaagaacattgacaaaaggttacatgaattgctaactagaataaccagtttaaagaagaatataaacgacctgatggagctgaaaaacacagcacaagaacttcatgaagcatacacaagtatcaatagctgaatcaatcaagcagaagaaagtatatcagagattgaagatgaacttaatgaaaaaaagcgagaagacaagattagagaaaaaagaatgaaaaggaacgaacaaaccgtccaagaaatatgagactatgtgaaaagaccaaatatacttttgtttggtgtacctgaaagtgatggggagaatggaaccaagttggaaaacactcttcaggatattatccaggagaacttcgccagcctagcaagacacaccaacattaaaattcaggaaatacagagaacgccaccaagttactcctcgagaagaacaaccccaagacacataattgtgagattccccaaggttgaaatgtaggaaaaaatgctaagggcagccagagagaaaggtcgggttacccacaaagggaagcccatcagacaaacagtggatctctctgcagaaaccctacaagccagaagagagtgggggccaatattcaacattcttaaagaaaagaattttcaacccagaatttcatatccagccaaactaagcttcataagcaaaggagaaataaaatgctttacagacagacaaacgctgagagattttatcaccaccaggcctgccttacaagagctcctgaaggaagcactaaacatggaaaggaacaaccggtagtagccactgcaaaaacataccaaattgcaaagactatcgacgctatgaagaaactgcattaactaacgggcactaaattaatttgatgtttcttaccttcttggtatactactaaagggaactaaaggcctagggagattgataagctgaagtgagtaagtacctgttcagatactggctaagttcctcagaatggttcagaggatacatctttcatttcagctttccaaaatacattgggaaagaaagatctttgtggtagctgttctctaaaggttctaaatgagagggggaaatgctaccttctaactggggtctgtgacttcagtggaagtgatgagatcccagggagaatgcgccaattgctggcatttgatcacaaaagatgaggaaggtagctgggaccacaggtgtgtaccaccatacctggctaatttttgttgtttgttttgtagagacagggcctcactttgttgcccaggccgatcttgaatccctggcttcaagcagtcctcccacctgggcctcccaaagtactgggattacaggcatgagccactgcacacagccagatagagatctttaacattccacttaatagttgatcatggtatccctagaactgaaacaggtaattatcatatgccttagtcattcaggctgctatagcaaaatactatatactgggtagcttacaaacaacagaaatttatttttcacatttgttaagccttggaagtgcaagatcaaggtaccagcagatctggtgtctggtgaggtccacttcctcatagacagcacattctggccatgtcctcacgtggtggaagaggcaagaatctctctgaagtctcttttataaggccactattcccattcatgagggcttggccctcatgacctaatcacttcccaaagacctcatctcctaaagccatcaccttgggggttagggtttcaacaaatgaatttggcggaatgtaaacattcagtccattgcactccattaatgtcctacttgattcacaaacagtctggtgaaccgacgccatacctgcattagcacaataaggaattgtggaacctcaaccaattttcagacttaagatgcaaagattttgaaagaaaggaagacagcgtctctttgaggattgcttctatgagaccaaatatgtacactctagccctagccctagttggcggtgtctcaacccagggcaatttgcccccaagaagatatttgccaatgtctgcagacatttttggttgtcacgactaggagcatgctactgacatctaatagatagaatccagggatactaaatatcctacaaagcacaggacaaccccactacaacaaagaattatcttgcctgaaatgctgaaagtgctaaggttaagaaatcctgcttttctcaaaagacctgtgaccaccgagttacaacaacagaaagtgaaccaacatcatcatactttgcagtaattcaggaggacctagactaaagtcacactgggcaataaaaaagtcataacacagattgaagagtgatatgagcttaatgttaatacacagggacaatattcagtctcccctagagttctgcaatgttaattatccaaaacattacataattgcaagagagataaagtaatctggattaaaaataggaagaatataattaaccgtattaacaaactgaaataaaatgttgttttaaaaaaagttaatcttctttcatttaccaaatccaatccatccacaactgccatgtaaaaatcaataacaaatccattcccttctcctctctccttcttctcttctactaccttccctagtaaagccaccaccatctctctcctggacagcctgtttactgtagctttctacttcctcccttgttcctgcataatcttttttgatatgctgttgccaagtactcttcttaaaatgtcaactactcacaacactcctgagcatcacagagagtcccagtgaggagggaagctacggtgtgtgagatgaaattggaatctttttcctgcctcaaaggaaagcccggaagtatgagttaaaaaaaaaacaaacaaaacactggccaggcatagtggctcacgcctgtaatcccagcactttgggaggccgaggtgggttgatcacctgaggtcaggagtttgagaccagcctggccaacatgatgaaattctgtctctactaaaaatacaaaaattagcccattgtggtggtgcatgcctgtaatcccagctacgtgggaggctgaggcaagagaatcacttggacccaggtggcagaagttgcagtgagtctagatcatgccactgcactccagcttgggcaacagagtgagacactgtcttgaaaaaaaaaaaaaaagaaagaaaacattgatgcagttttgctctgcctaatacagcctgtatggaaggtctccgtggtctccttgctttcattcctggccctgcctgccttccacacccactcacaaattatcctctgtagcagagggatctatgcaaaccataaatcaggtcactcaatataaaaccatacctgcaagtaccttcccaagccagtgcttgatctaagttgtttcaagtagggcctaggaatcttatattgtctaatatgtccaggagattctaacttagccaagactgaacacccctggcctagagctgtacttctcaaaatttaacttaacgggtctctgaactacactttctcctggacagcctctttagtaggctttctacttcctctcttgttcctgcatgatctatttttgatatgctgttgccgtttgatatgcatgttgtccaggagacccattaaggctgagtggatcccgatatgctgcatttctaacaagctcccaggtggtgctggtgctgcctcccgaggactatactctgagcagccagagcctagaagggaaaaacattgctcccctctacctaaaccacccttgttcatcattactagcaactatattttccaccctttacccaaccttctggacctggtaatctgcagccagcccgctcaagattgcctgacaggaccttcagggcagacttttatagatgaaagaatgacataatgatggtgcgcactaggaacagatcagaatatgtgagaaacactatttttttcccagtgtacagcaggctttcttctggtaaaattaagcaaaactcagccctgccctgcccagttagagactagttcatcaagggggcaggttgaaatttagccacagtaccctcctatgcctgatatgcaactaaaaagcagtgactgtcaaccttttaactatcatgacctccctaaggagcctttttagacttttttttttcctgatcacaccctccgtataaaatgtcaataccacagatatacgatatatatggttatgaactcttgacctttgtaggactacaaaccattaaatgagacctaagaatttttggccgctccctgtgggcaatacaaccctcattgagaatgcatgattgagatccattcgctcattccagtcagctagattccaggcctggtgtgtagaccacatgtttggacacatttctccagctttccctaccaggccaagtggtggagaggacactatctttagaatcacacaaatcaagttaaaaccaagcctcagccatttacaagttgtaggactctaagcaagaatctttacctctcttatcctaagtgccccaactgttaaatggaattaaaatactcacactgaaaatttgctgtaaggtgtagaggtgaggtaatgttcctgtaaagtataaactgtagtgtccagggcaggacaggtattcaagaaatagtagtaactggccataatttagtggtggccctccacagctttctatttcctttgagattagattcattacacctgggctcagtagcgccttgatggcccagtacaccagcccagtacaactgcagagttagatgtctctctcgtcatgccccagtgcagaaaaaagaaagacacaccttccctaagtatctacctgagaaccagggcatcttgaagcagttccgggagtttgattaaagtggagtggggagctgagaaggatttgtcagcacaagcaaaggtacaatctgcatccaaggccactgctatcagtttgtagccctgacccagtctcttcgactcaacactacccttgacgcccatcttctggataagaataagcctagtcagcctacgtctaccacactacactttatctcaaatgctcctggacaatctgactacagttccatttcaagaatcatctttaacctcatttgccacattggtcctaatttgtcttttgaaatacacttcctgccaaacagtactagctatctgttagagagcaaagagattttccattttctcaaactacccgccacctagtttataacctcaacctcagtgtttatcccaattttgcagagtaccattgatatgcttaggccactcaaatctcatcttgaattttaatccccaaaatccccacatgtcaagggagagaccaggtggaggtaattgaatcacggggggcagcttccccaatgctgttctcctgatactatgtgagttctcatgaaatccaatggggctcttccccctttgctcaacccttcttcctgccaccttatgaagaaggtgtcttgctttcccttcactttctgctgtgattgtgtttcctgaggcttccccagcaatgctgaactgtgagtcaattatacctctttcctttataaactatccagtcttgggtagttctttatagcaatatgaaaatggactaatacaactattcaaagctgtcattgaatatcttctcctgtcaagctcccaaccacaacagaaagagtgaatcagctcttgcccttttttttaatattcgaaaatatttccaaaaaatagcctcgtctctcaaaatgaaaatcttgccttataccaactccctggtctccactcctcttggaaccccttgtcataagccagtgcttagcccagttccccacaaatagaaagccctaaataaacacctgttgcctgttcctctattgtcagcaccagaaatacccatctcctagggagtatctggctctgtcacctgcaggctgtgtgaccttcctacaggtggccttgcctccctgagcctcaactcctttacctgtcaaatggaagtaaaagaaccacctcccagggccatttcaagtgttgggacaattaaagaattagacacctagcagagagactgaatcctacccaagacctctctagtgagaaattaacccatcctcttttgatggcctggtaatgctgcctgaaactgatggcttcactgggaggggaaatcattttcagtctctttttttaaatttcaggatgtagctgaggaccaagttatattgtactactgtacagatttattactaaggaattattactactttttcctgactttaacctcttcccatattagatcctatcatcaaagccaaatacttcttaagattctaccacataaaaaatagaaatgatcttgaaaacatttagtatttcaacaaataacaaaaaaccttagtattttatagataaatacattttagccataactattattaaggctttgtctcttacaaaggagaaaggtaaaggcttataatttccctattaagtcagcacataaaatgcaattttaacttaaaattctgttaaaagtatatttattgtcatagtttccagccctgattggtcctaagaatcacctgtagagcatcttaaacataaagagctgtttggggccattacaaatgtagtactaagaacatcttatatagtacctatcttttggggcacatatgtatgcatctctgtgaagtgtatatctgagaatagaattgctaaatcaggatatgcatgtgatgagctttcatagatatcaccaaagagttttccaaaatggttgtacaaattaacactcacaccaatgcaatatgagaatccccattgttccatattcaataccattgcttggtattttatatctttttaattttaaccactccagtggatattttaatttttatttcctgagccataaatgaagttgagcatatatttattgagtatttgcatattttctctgaggtgtgccaagtatttttaaaattgagctgtgttttactggttaatacataggattcctgtctatatattcattccctctcactggggtacaggtcttttattttttatatgtgtattgagaatatttttcttcacatatccctctctttaatggtgacttttgttaaattttgttgttccttaactttaatatgctccaatttatcaattgttaactacctaggtgcccatcaacagtgaaatggataaataaattgtggtttattcaatcaatgaaatactataaagcaatgaaaatgaacaaatcacaactacctgcaacaaatataagtgaatctcatataacattgagggaaggaagctagcacaggagtagatattattttaattttttttttttttagtttcaaaaacaaacaaaactaacccatgatgttagaagttaggatgttgacaactttcactgggctgcagtagctagaaaggggccctagtggctctcttgagctgctggtgagaatctgtttctgaatctggaaagctagtcactcagttttgttcagtttgtgaaaatctatctagcttcacatttataatatatgtttatttcaataaaaatttaaccaaaatagaggtacatatatctgagcctcaacacctggacatccatatttcttagtgattcaaatgggcagccagggcaaggaccttcgatcaatattctgatcacaaatatgtgtgcaaatataaggactggaagccccattttttgaaaaatgtctgtggtttatgggaaacattaaaatggtgggattctagagtttcttttttctctaacattgtaatttgtattcttacaatgttgttttgtgcaattgtgaaaatcctgtgaattacacttctctgtgctctcatttgtcagtgttgtccatttctaggaagaaacatttgcttgcatgtctagaagtgtggcaagagggaggagggacagaagctatgaggaagtgagaaaataagtgctggctttcctccatcttgtgctactctgattagtcccagctcacagccaaacatcctcctctgaccagatgtgggggcacagtggtgatgtacactcgccaggagggcagagtccaatgtttatggggttctgcaaattactggagcagagtgtggtcccgaagaacaggagagacagaggaagcttccagctacagctttctcctccactttttctctgccctctcatgccctgcttgtctggcaatttgaatgcagactagacatttcatcatttgttacaaggacttatgaaaagggatacggactccgatgttgttgggcagattctagtttaggctagaagctggggagtaggggaggagatataagggaggaggatgaggtgttaatgttgtgtgtacttttgagccaggaaagaaatgtgattctgggtggtgaaggtcttggccaaatggatctgtttttcagagagacaaagagcccctgtgatattgtgaagtatatatttggtatccgtcccctttcctggcatacaacttttaaaatactttgaatctccaaagtgcttttttttttttcatatgcaattgttgactgatagattgaggatgggactggccactaaaaagacaaaggcatgatcacagggttgggactttcagccccaccccccaaccttccggggaggggagagaggctgaaggtcaagttgatcaccaatggccaatagtttaatcaatcatgcctatgtaataaagcctccataaaaacccaaaagggcagagttcagagagctgaacacatgcaggctgacaggaaggtgaaccagaatttattcatgtgccaggaagatggaacaccccaactccacaaggcagaaactcctgtgcttgggacccttgcagacctcaccctaggtacctcttctctagctgcttatttgtatcttttaaaataggccaggtgttgtggctcccacctataatcccagtaacgctttggaaggccgaggtgggagggtcatatgagcccaagagttcgagaccagcccagccaacatagtaagactccgtctctatgaaaaataaaagaaattatccaggcatggtggcatgagcctgtagtcttacctatttgggaggctgaggcaggaggatcactggagcccaagagtttaaggttacaatgagctatgatcatactgctacactccatcctgggcacatgcgcaagaccctgtcttaaaaaaaaaaaaaaagaggaaaatcctttaaaataaaccaataaaaggctgggcgcagtggctcacgcctgtaatcccagcactttgggaggccgaggcgggttgatcatgaggtcaggagatcgaggccatcctggctaacacggtgaaaccccgtctctactaaaaatagaaaaaattagccaggtgtggtggcgggcacctgtagtcccagctactcgggaggctgaggcaggagaatagcgtgaacctgggaggtggagcttgcagtgagccgagatcgcgccactgcactccagcctgggtgacagagcaagactccatctcaaaataaataaataaaccaataaacaaaagtaagtgtttcctgagtctggtgagccaatctagcaaattaattaaacccaaagaggggattgtgagaaccccaacttgaagccggtcagtcagaagttctagaggcctgaacttgcaactggtgcctgagacggtggagcaatgttgaggactgagccctttgcctgtggaatctgacatgatctccaggtagatagtgttggaactgaactgaaggacacccagctggtgtctgctgcagaattgattgcttgtttgctaggggggagaaatatccacatattttggggtcacagaagtcttttgtgttgatgattattgatgtgtggtatgagagcagaggaaaaaacacagtttgagtttttcccaacagttcccatccccagctgcttgatggttgcgagttttttgccactataaatcaggggacttctgtaatcatttacgcctcgtttagggaaaaaaatcaaattattgcattgtttgcttctgtatcttatttcctcctcccttaaaccgttagttgttttcaaatacaaaatcctatgtagcccaaaattagcatttctacaccataaattgattgtattgaattagcgaataatgaggcaaattggaagaaccagaacaactgaaggcaaacctcccaaagccttactttttatcgcagacaaagcaaatccctcctttcttttcttctgctgtgcttgtcacttctgtagagctgctattccagctggcctgccctgttcttggtgatattagagatctgtaactcaccctagaccacaggttctcagagtgtggtccccagagcagaagcatcatctggaaactttcagacatgcacattttaaggccgcagcccagacctcctgaatcagaaactctgggaatggggcccagtgccctgggatttaacaagtgttctaggtgatcctaatgcagtctacagtggttctcaaactctatgagttcctttaggtagagagcacatctgaggtacctcctgcaggacttggaaaccaattgaatgtgggaaggtagagaggaagtaaaagataaagatgtttcaacaaaccaagtaaggaatacaaagaaaagaggtgttttggttttgttattgtttacttgtttgtggtatttacacagaaagaagtaggtgataaaaagcttttttatgcctattttcaaaagcccgttctacatacatgtgttgtccgctcaaaacatccatctgctacggacagcagcgaccatagctgaggagccacatgggtttggctgtaaatcgaagctctgccatgtttaattcttcgagcctgggcaaagccttgcacattcctgagctttagcttcctcatctgacaattggaatagtcatacctaccccacagagttcctggaagtattaaatgagatcatgtatacaaatcaattagcaaaattcctgactcagaaatggctggtactatttgcgtatagatttgtgagcctgcagaatgtatatgagaaatgtagacaatagaatggctctgattatcctagttgtgcaagagagatggaaaactgagcacacttgaggatgccagcagtgggagcgggtggaggaggagcaggcagagagactgatgagaaggcacatgggagaggcaggaagagaatcaggagagtggcctgggagccaatggaggaaggagtgaatcaacagccacacatggggcagagattaagtaggactgaaactaagaattagccattttatttggccgtgaaaaattcactgttggcctggaaaacagcaacgtccacgaaggtgtaaagggagaggcagaacccactagcgggaccatgcaatcctgaagtgctgtaactttaatcatggaaatggattgataactgggagagagaaagagaatgtaagccatcttcaaaatggatagagcctgattaatggtattaatacatataatgaaagaattttcctgaaatgaaaattttggagttatccatgatttatttctttccatcacatctcacatgtgatatgtgaaatatttgttaatatttggtgataggtccaacagaggttgttgagttcatcagcagcctctcttggacctatcaccaaaataaatcccaaatatatccacttttctgctccactactgtcacactaatccaggctaccctcacctgacttccaggcaactacaatggctacaactggcctccctatctcctctcttgatttcctccctgcctcagctctcttcccagcagcctcagagatgttttatcatgtaaataaactacagtagtcccctaattcaaacccttcacaattagcaaataattcacaagatttaccttggtgagcaaagcctcacctacctggttcctgctaatcttctgacaccatgtcgtccaatacaactgccactagccacatgtgactcctgagaatttgcaatgaagctggtgtaatagaaaagctaaatgttagattttatttaatttatatcaacttaaatttaaacagccacatgtgactactgagaatttgcaatgaagctggtgtaatagaaaagctaaatgttagattttatttaatttatatcaacttaaatttaaatagccacatgtggctagtggctaccatattatccagcacagattcagaacacgtctatcatcacaagttctgttgaatagtgcttatctgacctggtgtctctgtgctcttccttgcttattgcacttcagcagcattggcaaactcacccacaacaagctacttcacccttgaaagcctttgcacaaactggatattatgagaggaagatattactcccaatattgcagaggcagagagaatgttactaccaatatcgtaaacaccctgggtatacaccatctgtgatattgttcataatatccatgggggagaggaagatactactccccatattgcaggcggcgaacaacccaccatcatattgtttgtaatattcaggggggaagaagataaaattacttcccatatcgcagggggtatacacttccttgtgatattgtctgtaatatccggcgggggagaggatgacattactccccataatgcagggggtacacaccccacggtgatattgttcgtactatccagagagggaaaggatatcactccccatatcgcaggggggtacatccccctgtgatattgttcgtaatatccagggggagagaggatgatattacttacctgtgacgttgttcataataaccagaagggaagaggatattacactccatattgcaggaggtgtacactccccctgtgatattcttcataatatccaggggggagaggatgatattactcccaatatttcagggggtgtacacccacctgggatattgttcgtaatatccaggggggtggggcataagattacttccaatatcgtaaacacctgtgtacacctactgtgatattgtttgtaatatccagggagggagaggataacattactcccaatttcatagggggtgtacatccccttgtgatattgtccgtactattcacagaggcagaggatgatattactcccaatatcgcagggtttgttcactgccctgtgatattgttcataatatccagggggacagaggatgatattactgcgattattgcaggcagtgtgcaccttcctgtgatactggtcataatatccagagggggagaggataatattactctcaatatcgcagggggtgtacacccatctgtgatattgtccgtaatatcaaggatggagaggaagatattactccccatatcgcagggtttcttcacctttctgtaattttgtttgtaacatccacggggggagaggatgatatttctcccaatattgcagggggtgtacacccgtctgtgatactgtctgtaacatcagggtggagaggaagatattactccccatatcacagggtttcttcacctttctgtaattttgttcataatatccacgggaggagagcatgatatttctcccaatatcgctgggggtgtacaccccctgctagatattcttcataatatttaggggggagaggatgatattactcccaatttcgcagggggtgtacacctccctgtgacattgtccacaacatcaagtgtggagaggaagatattactccacatattgcagggtgtgtacacccactatgatattgtccctaacatccggtggggggggggagtggctgatattactccccatatcgcagggagtgtacacactcctgtgatattgtccataacatctagagtgggagagggtgacattactccccatattgctggtggtggtattcaccccacctgtgatattgtctgtaacatccaggggtggaggtgatgatattactccccatattgcagggggtgtacgccctccggtgttttgttcgtaacatctagggaaggaaaggattatattactccccatatggcagggtgtgtactcctttctgtgatattgtccataacatctagagcgggagaggaagacattactccccacatcgcagggaatgaaagcccccttaagatatggactgtaacatccagagagggagagaataatattactccccatatcgcagggggtacacacccctgtgatattgtttgtaacatccaagaggggagaggatgatatttctccccatatcaaaggggatgtacacctcactctggtattgtccgtaatatctagggagggggagaggatgatgcaactccccaaatccaggggcacacccctgcgatattgtgtgtaaagtccgggggtggagagaaggtgtacacacccctgcgattttgtccataatatccagaaagggagacgatgatgtatctctccatatcgcaggaggtgtacaccctactgcgatattgtccataataaccagggggtaaggatgctgttactccccatatcgcaggggctgtacaccctccagcaatattgtccataatgtccagggtggagaggatgatgctactcctcatatcgcaggggtgtataccgctgtgtgatattgtctgtaaaatcaaggggaggagagggtgattttcctccctatatcggagggaatatacagctgtctgggatattgttcataatatccaaggagggagagagtgatgctactccccatatcgcaggatgtgtaaaaacccctgtgatattctttgcattatacccgggggaggagatgatgttaccaatcatatcgccgtgtgtgtgtgcccccctgcgatattcttcgggatattcagtggtggagaggataatattactctctgtatcacggggggtgtacaccacactgacatattgttacccccagcgatatgaggagtagtagcaaccccctttccccccccggctactacgatccacatcgcagggggctgcacacaccccaccgtgatgcggggagtagtagcaaccccctctccccacctgactattacgatccacggtggacctacacagtgtttatgatattgtgagtaaatcatgtccccctcagcaaattacgaactatttcacagacgggtgtacaacctctgccgtattgggaacaatatcatcctctcccccactggatattaacaacaatatcacaggggtgtttttactctctatgataatgcatgtcatatcatcctctcccacgttgaaattaggaacaatatcactgggtgtgtgtacacctgcgatgttcaaagtaatattatcctcttctctcctggatcatgggaacaatgtcacttgggggtgcacactttttccaatattgggagtaataccatcccctctgctttggaatatcaaagacactctcacacgggggtgtacatctcctgcgatactgggaataatattatcctctccccccctgcatattaggaaatatatcacagagtgggtgtacaccttctgcgatattgggagtaatatcctcttctccccttctggatattagcaactgtgtcgcacggggtttacactttctctgatatctggagtaatgtcatcgtctcctcctttgaacgttaagaacaatatcacagggggcatgtacaccccctgccatattgggagtaatatcaggctctcccccttctcttgatattaggaacaatatcccagcgtgggtgtacacctcctagtatatggggagtaatatcatcctctcccttcctggatattaggaacaatatcacagggtgggggtacagagcctgcaatattgaaagtaatgtcatcctctccgcctccggatattaggaacaatatcacagaagggttgtacactctcttcgatattgggagtattattattttctccttccctgaatattaggagcaatattcctgggtggatgtacacccactgttatattggcagtaatgtcatactctgccccctggatattaggagcaatatcacagggtgggtgtacacccacggcgatattgggagtaatgtcatgctctccctccctggatattcggaacaatatcacaggtgggtgtacatctcctgcagtataaggaataatattatcttctcttcctttagctagtaagaacaatatcacatgggggtgtacaccccctgcactattgggagtaatatcattctctcttattccggatagtagaaataacatcacaggcgaagtgtacaccccctgcgatattgggagtaatatcatcctctcccaacgtagatattaggaacaatatcgcagggggcgtgtacacttcttcgatattggtagtaatatcaacctctcccccttggatatatgaaacaatatgacaggcggggtggacacacctcgccatatagggagtaatatcaccctgtctccctccctggatattacgatccacgtggacacaccacgttgtttacgatattgtgagtaatgtcatctccccctctagaaattacgaacaatatcaaagatgcgtgtacaccctctgcaatatagggagtaatatcatcctctccccacctggatattagttacaatgtcaaaagagtgtgtataaccccagagacattgggagtaatatcatcctatcccacgttgaaattaggaacagtatcaccgggggcgtgtacgccccctgcgatattgaaagtaatatcatcctcttccctcctgggtgataggaacaatatcactggggggtgtacacttcctgtgatattgggagtaatatcatcctctccgtctttgaatattgaggacaatatcacgggaggtgtacaccctttgcgatattgggaataacatcctctcccctcctgcatattaaaaaaaatcacagagtgggtgtacacctcctgcgatatagggagtaatatcctcttctcctcttctgtatattaggaacaatatcacacgggggtatacactttctgcgatattgggagtaatatcaacctctcggcctttgaatattaagaacatcacagggtggatgtacaccccctgcgatattgggagtaatatcagcctctcacctccatggatattaggaacaatatcccagggtgggtgtacacctcctgctaggtgtggagtaatagcatcctctcccttcctggatattacgaacaatgtcacagggtgggtgtacacagcctgcgatactggaagtattatcatcctcttccccctccagatacctggaacagtatcacagaagaggtgtacactccctgcgatattgggagtaatatcgttctcttcttccgtgaatattaaaagcaatatcaccgggtggatgtacacccaccgctatattgggagtaatgtcatactctaatccatgaatattaggatcaatatcacagggttgctgtacacctactgcgacactgaaacgaatatcatgccctctctccctggatattagaaacaatatcaccagggggtgtagacaccctgcggtattaggagtaataacattattaatgattaatcctagcttcttaatattaatattaatgatcaatattaatatgaattttttctaatatgatattaattaatagtaacagtaattaatattaattactcattattttgttattgatagcaccatcaactaatgttaatcattaatattaatttttattaacatgattaataacataattgataatattaattggtatgattgtcatgtttattaatatttataatcaatattaattaataattatcaatgttattgtaacaatgattattaataataaataactaataatgtgttgattattcataattacaacttaattagaattaattaaaatcaattattaattattaataaatagtattattatttctgatatcggggcggggagggtgtgatattactgccaacatcgcaggaactgtgcacccttctgtgatattgttcctaatagccagaaggggagagcattactctcaatatcacagggggtgtacacctgtgatagtgttcttaatatctatgatgggagaggatgatattactcccaatatcacaagaactgtacagcgtcccgtgatatagttcctaatatctaagtggggagaggatgatattactcccaatatggcacaaattgtaaaaccctttcgatatatttcctacaatccatggggagagggtgatattactcccaatatcgaaggaggtgtacaccctcccgtgacagtgtcctcaatatccatgttgtcagacgatgatattacacctaatattgcaggggctgtacacccaccctgggacattgttcctaatatcgagaaggggagaggatgatattaatcccaatatcgctggggctgtacacccctcctgtgatattgttcctaatatcctaggtgggagagcatgatattactcccaatatcgcagggctgtatacccacccagtgatattgtccttaatgtccagaagggaaaggatgttattactcccgacattgaaggggttgtacccctcgacacgccaggatattgttcctaatatccggggaggagagggtaacattgtacccaatatcgcagggggtgtgcaccccccctgcgatattgttcctaatatccaaaggtagagaggattatacactctcaatatcgcagggggtgtacaccccacttgtgatactgttcttaatatttacggggggagacaatggtattactgtccatatctcaggggtggacaacacccctgtgatattgtttttactattcagtggggcagagaatgataatttcaatatcacaggggacacactccctgtgatatcgtttctaatattcaggggaagagaaatcatatgactcacagtatgacagggggtgtactcaccctccataatattgtatctaaaatccaggggggatttgaaagatattactcctaatatcacagtgggtgtaaaagacccctttgatattgttcctaatatccggggagggagaggatgatattactcccaatgtctttggaggtgtacacccccccgtgatattgtttctaatatttacgtggggaaaggatgatattactatcaatatctcagagggtgtacacccttcttgggatattttttctaatatcaagtgggggagagcaagatattactcccaatatcgcaggaggtgtacaccccgcctgttattttgtttccaatatccaggttggtagaggatgacgttactgccaatattgcaggagttgtacccccaacctgtgatattattcctaatagccaggggaagagaggatgatattactcaaaacagcgcaggaggtgtacacacccctgtgatattggtgctaatatccagtgtgggagacgatgatattactggccatatcgcgggggttgtacaccccctctgatatttattttaatatccagggggtagagtatcacattactcccaatatcgcagtgggtgtacaccaactctgtggtattgttcttaaaatccagggagggagaggatgatattactgtcaatatcgcaaggggtggacaccccctctttgatattgttcctaatatccagggggagagcatgatattaatccccatatcgctgggggatacacccctttttgatattgttcctaatatcccggggggagtcagtgatattggcaatatcacagggtgtgtacaccacacctgttatattgttttttttttccggcaatgaagaaattgatactattgtcaaaacagaatgcgcggtacaccccgcatgagatattgtttctaatatccatgggagaaaggatgatattactcccaatgtttcagtgggtgtataatccgcctgtgatattgttcctagtatcaagtggggggtgaggatgatattactcccagtctcgcagagggtgtacaccgcccctgtgatatcgttctcaatatcgatgggggtagaaaactatattactcccaatgtcgctggtgatgttcaccttcccggtgatattgtttctaatatttaggtgagggaatgatattactctcaatatcgcaagtggtgtacacagcttctttgatatttttcctactattttcggggggagaagaggatattactttcagtattgaagaacgtgtacacgacccctgtgatattgctcctaatatcaaggttaaaaaaggatgatattacccccattatcgcagggggtggggtgtacacttcacctgtgatattatttctaatatccaggggaagagagaatagtattactcccaatagcgcagggggagtacacaccttttgatattgttcctaatatccagggaaggagccgatgatattggtggccatatcacagggtgtgtatatccttgtctgatattgttcctagtattcagtgggggagaggataacattaatcccaatattgcaggaggtgtacatatttgctgtgatatagttcctaatgtacagggaaaagagaataatattattcccaatatcgcaggggatatattgtctctgtacattgttcctaatatggagaggggtagaggctgatattactcccaatatcgcagggggtgtacacaccccttttgatattgttcctgatatccagcgggaaagcggctgatattactcccaatatcgcagtgggtgtacacctcctttctggtattgtttctaatatacagggtggaaaaggatattactgacaatatcgcagggggtttacaccccttctgtgatatggttcctgatatccagggggtgagtagatgatattactcccaataacgtaggaagtgtacacccccctgtgatattgtccccaataaccacatggggagaggtgatattactcccaatattgcaaggggtgtacacaccgcctgtaatgctatttcttatatccaggaggtgagaagatgatattactaccaatattgatggaatgtacaccacccatgtgatattgttttgaaaatccacgtggatagaagatgatattactcccaatataacaaggggtgtacacaccgcctgtgatattattcgtaaaatcgagaagaagagagaatgatattacttccaatagtgcagggggagtacactcttcctgtgatgttgttcctaatatctaaatgaagagataatgatattactttcaataccgcagagagtgtacaaccccctgtgatattgttcccaataaactagtaggggagagaatgatattacttctaacattgcagtggctcttctccacacccccaaccccgtgatattgctcttaatttccagctggtatagtataatgtttctcccagtatagcagtgggtgtacactcaacctgtgatatttctccgaatattcagggaaaaacaggatgatactactctgaatatcgcaaagaatgtacactccttttgtgatattgttcctaatatccagaaggggagaggatgatattacttttaatatcgcaggcagtgtacacccccctgtgatattgttcgtaatatccaggtgaggataaaatgatattactcccaatattgcatggggtatacattctcctgtgatattgttagtaatatccaggggagcagaggttgatattactgtcagcatcgcaggtggtatacatttccctgtgatatttttcgtaatatcaagggaagaagaggttgatattaatcccaatatcgcaaaggtcatacaccctctgtgatattgttcgtaatatacggggggggggggaaggatgatattactctcaatatcgcagaggaatatacacatatcacagaggaccatatcacagaggaggtacgccccctgagacacccccctgccatatggttcataatatccagagggggagagaatgatattactgccaatatcgcagggagtgtacaccttcttctgatattgtttgtgatatccatagtggaagaggatggtattactcccaatttcgtagggggtgtacacccccttgtgatattgttagtaatattcagagggggagaggatgatattaccctcaatatcacaggttttgttcaccgccctgttatattgttcataatatccaagagtagagatgacataactcccaatgtcacatggaatttaccttctatgtgatattgttcatgatatccaaggtggcagatgatgttactttcaatgtcgcaggaggtgtacaccctaactcataatgttcgtaatatctaagggcggagatcatattactcccagagtcgcaggggatgtacaacctctgtgatactgtttttcatatccaagggggaagatgatattactcccaagatcgtaaacaccctgtgtatgcactctctgtgatattgttcataatatccaaggagggagatgattttactcccagtatcgcagggggtgtacaccctgtgtgaaattgtttctaatatcccaagggtagatgacgcttctcccagtatcacagaaggtatacatcctctgtgatattgttcgtaatatccaatgcgggagatgacgttgctcccagtatcgaagggcgtgtaccccctctctctgtattgttgttcatgatattcaaggggggagatgactttactcccagcatttcagggggtgtaccaccttttagatgttgttcgtaatatccaaggagggagatgacgttacccccagtatcgcagaaagtgtgccccctctgtaatattgttcataatatcccatgtggtagatgacgttacttcgagtattgcagcaggagtaccctgtgatattatttgtaatatctaaggggaaagatgacgttactcccagtatctcagagagtgtaccctctctctgatattgttcataatatccacggggtgagatgacgttactcccaggattgcagggggtgtaccccctctgcgatattgtttgtaatatcaaaggtggacgatgatactactctcagtgtcgcaggtggtgtacaccctctgtgatattgttcataatactcaaggggggagatgatactacacccaatgtcgcagggggtgtacactctctgtgctattgtttgtactatacaaggggaaaatgatactactcacaatgttgccggaggtgcacaccctctgtgatattgtacgtattatctaaacggggagatgacacaaatcccaatgtcacagttgttggacaccctctgtgatgctgttcgtaataatcaagggggacgatgatactacccccgatgttgcaggaggtgtacaacctctgcgatattgtgtgtgatacccaagatgggagataatactactcccagtgtcgcagggggtgtacaccttctgtgatattgttcgtagcatccaagggagagatgatactacttccaatgtcgcagggggtgtacaccctctgtgttattgttcataatatccaaggggtgagatggtactacttccaaagtcataggggatgtacttcctctgtgatattgatttgtgatatccaagggaaaagataatattactcccaatgtcgcattgggtgtacaccctctgtgatattgtttgtaatatccatggggggagataatattactcccaatgtcgcaaggggtgtataccttctgtgttattgttcataatatttaagaggggggaatgatattactcccaatgtcccatgggtgtacattccaagggtggatataatattactcccaatgctgcagggggtgtacaccctctctgttattgtttgtattatccaaggggggagatgatactacttccaatgtctcaggggatgtacatcctctgtgatattgtttgtacaaaatcacagaggatgtacaccctttctgttattgttcttaatatccaaggggggaatgatgttacaatgtcgcagggggtgtacaccctctgtgatattggtcttaatatccaaggtgggagatgatataactcccaatgtcgcatggggtgtacaccctctgtgatattgtttgtaatatccaagttgggagatgatataactgtcaatgttgcctggggtgtacaccctttgcgatatttttggtaatatccaagggggatgatgatgttactcccagtattgcaggaggtgtaccccctctgtgatattcttcataatatccaaggagggagatgtcataacacccattatcgcaggggatgtacccctctatatcatttgcaatatgcaatggaggagatgacattactcccagtatcgcagcaggtgtacccccttgtgatattgttcataatattgaaggaaggatatgatactactccccatatcataacaccgtgtgtatacactctctgtaatattgtttgtaatatccaagggggggagatgatactacttccaatgttacagggggtgtacaccctctgtgataatgttcttaatatccaaggggggaaatgatactactcccaatgtcgcagagcatgtacatcctctgtgatattgtttgtaatatctaaaaggggagataatactacctccaaatgtcacagggggtggacaccctctgtgatattgtttgtaatatccaaggagggagatgatactacacccaatgtcgcagggggtgtacaccctctgtgacattgttcataatatccaaggggggagatgatactactcccaatgttgcagagggtgtacaccctctgtgatactgtttgtaatatccaagggggaggtaatactactccaaatttcgcagcggatgaacaccctctgtgatattgttcacaatatccaaggtgggagactatactattcccaatgtctcaggggatatacaccttttgtgatattgtttgtaatatccaaggggggggggatgatactacttccaatgtcacaggtgtgtataccctctatgatattgtttgtaatattcaaggggggagatgatactactcccagtgtcacagggggtgtacaccctctgtctattgttcataatatccaagaggggagatgatactaccttccttgtcacaggggatgtacatcctctgtgatattgtttgtaatatccaaggggaaagatgatattactcttaatgtcacaaggggtttataccctctgtgatattgctcataatatttaaggggggaataatattactcccaatgtcgcatgggtgtacactttctgtgttattatttgtaatatccaaggggagatatgatattactcccaatgtcgcagctggtgtacaccttctgtgatgttgtttgttatatccaaggggggagatgatattatgccctgtgtcgcagggggtgtataccgtctgtgatattgtttataatatccaagaagttagatgatattactcacaatgtcgcaggggtgtacacccttggtcatattgttcgtaatatccaaagggggagatgatataactcccaatgttgcattcagtgtacaccctctgtgatattgttcataatatccaaggaggggagataatattaccttcagtgtcacaagggtgtatacaccctatgtgatattgttcataatatccaagggggagatcatattactcccattgtagcagtgggtgtacaacttctgtactattgttcataatatccaagggggaagatgatattactcccaatgtcataaacaccctatgtgtacaccctctgtgatattgttcgtaatatcaaaggagggagatgacattactcccagtattgcaggcgatgtgtaccctctgaaattattcctaatatccaaggaggagatgacgttattcccagtatcacagaagatgtatcccctctgtgatattgttcataacatccaaggggggagatgacgttactctcagtatctcatggggtgtaccccctttgtgatattgttcgtaatatccaaggggggagattacattactcccagtattgcagcaggtgtaccctcactgtgatattgttcgtaatatctaaggggaaagatgacgttattcccagtatgtcaggaaatgtacccactctgtgatattgttcgtaatatccaaggggggagatgacgttgctcccagagtcgcagagagtgtaacccgtctgtgatattgcttgtaacatcaaaaaacggagatgacgttaccctagtatcacaaagggtgtatccccccctgtatattgttcgtaatatgcaaggggtgagatgacgttactcccagtatcgtagggggtgtaccttctctgtgatatttttcataatatctaagaagggaggtgacgtttattccggtatcacagggggttgtacccactctgtgatattatttgtaatatccaaggtgagagatgactttactcccaggatagcagggggtgtactgcctctgcaatattgtttgtaatatccaatagagaagatgacgttactttcagtatcacagcacgcgtaccccctctgtgatattgtttgtaatatccaagggagcaaatgacataactcccagtatctcagggggtgtactgctcctgtaatattgttcataacttttaaggggaaagatgacgttactcccagtatctcagggggtctaccttctctgtgatattgttcgtgatatgtaaggggggagacgacgtcactcccagtgtcgcagggggtgtaccccttctgtgatactgttcttaatatttaaggggggagattatgtgccgagaccagctcggtcggtcggggagaccctaacccagcggagctagaggaattaaagacacacataatgtaaatgacgagttaatgggtgcagcacaccaacatggcgcatatatacatatgtaacaaaccagcacgttttgcacatgtaccctgtaacttaaagtataataataaataaataataaaaaaataaagttacaaaaaaaaaaaaaagaaacatataagtgtggagtaggaaatcaggggtctcacagccttcagagctgagagcctcaaatagagatttacccacgtatttattgacagcaagccagtgataagcattgttcctagagattatagattaacaaagtattccttagggaaaataaagggaggggctgaaataaagggatgggtttggcaggagtgtgtccttaaggcacagaccgctcatgctattgtttgtggtttaagaaggcctttaagcagttttccaccctgggtgggccaggtgttccctgccctcattccggtaaacctacaaccttccagcgtgggcatcatggccatcatgaacatgtcacagcgctgcagagattttgtttatggccagttttggggcaagtttatggccagattttggggggtctgttcccaacaattatgtaactcccactatcgcagacggtgtaccctctcagtgatattattcgtaataaccaagggggagatgacgttactctcagtatcacgggggtgaaccgcctgtgaaatggttcataatatccaagctggaagaggacgttactcccaatatcgcagagggtgtaccccctctgttatatggttcataacatacaagaggggagatgatggtactttcaatatcgcagtgggtgtaccccctctgtggtatgattcttgtagtataaaatgggggagaagacttaactcccaatataacacgggatgtaccccctctgagatatgtttcataatatccaaggaggaagaagactcccaatatcgtagagggtgtaccccctctgtgacatgggtcgtagtaaccaagaaaggagatgacgttactcccaatatcgcagagggtgtgctccctctctgatacagtttgcaatatccaaggggggagatgacattactcccagtactgcagaaggtgtacaccctctgtgatatggttcataatatccaaggaggggaatgacgttactcccaatatcgcaggttgtgtatcccctctgtgatatggttcgtactatccaatagaggagatgacgttactcccaatatctaaggaagtgtacgcactctgtgatatggttcataatatccaagagggaaatgacgttcacccaatatcacacagggtggacccttctgtgatattgttcataatatacaagggaggagatgatgttactcccaatatttcagggggtggacttcctctgtcatattgttcgtaatattcaagaagggagatgatgttacacccaatatcaaaggggatgtaccccatctatgattttgctcataatatccaattggggagatggtgttattaccaatatcacagggggtgtacaccctctgtgatattctttgtaatatctcaagggggagatgatattacttctaatatcgctgggggtgtaaaccctctgcgagattctacataatatccaagcggggaggagatgatattactcctaataatatcgcaggtgtgcagcgcctctgtgagattcttcgtaatatccctgcggggaagagatgacgttacttttaataatatcgtaaggggtgtaccccctctgcgagattcttcgtaatatcccaatggggaggagatgatgttactcgtaaaaatatcgtggggtgtaccccctctgcgagattatttgtaatatcccgggggagaggatgatattactcttaataatatctcagtgtgtgtaccccaactgcgagatttttcataatatccccgggggaggtgacattacccctcataatatcgcaggggggtgtaccttcactgtgagattcttcgtaatatcccagaagggagatgatattaatcctaataatatcgcagggggtgtacaccctctgcgatattattcttaatatcccagtggggagatgatattacttataatattgtaaacaccctgtgtgtacaccctctgtgatattcttcaaaatatccatgaagggagatgatgttactcttaataacgcagggggtgtacaccttctgtgatactcttcgtgatatccaaaattggagatgatgttactcctaatattgcagggggttaaaacctctgtgatattcttcctaatatccaaggggggaaatgatgttactcctaatatagcagggggtgtacaccctctgtgaaattcttcatatgatccgagcggggagatgatgttactcctaatatcgcagggggtgtacacgctctgtaacattctttgtaatatccaaggggggagatgatattactactaatatagcagaaaacgtacactctctgtgatatgcttggtaatatccaaggggagaaatgattaatttcgcagggggtgtacatcccctgtgatatttttcataatatccaagggggtagatgatgttactccaaatatcgcagggggtgtacaccctctgtgatattctttgtaacatcccagggaagaaatgatgttactccttacatcgtgtacactctccgtgatacttttcgcaatatcccagggggcaatgacattacttctaatattgcagggggtgtacaccctctgtgatagtctttgaaatatccaaggggggagataatgttactcctaatatcgtagagtgtgtacaccctctgtgatattcttcctaatatcccaggaagagatgatgttactcctaatatcgcaggggatgtacaccctctgtaatattcttggtaatatcccaggggggagatgatattacttctattatggctgggggtgtacaccctctgtgatgttctttgtaacattccaggggggagataattttacttctaatatctcagggggcgtacaccctccgtgatatttctcgtaatcattttcaagaaaggagatgacattacttctaatatcgcagtgaacgtacaccctttgcgatattattcgtaatgatgtccaagggaggagaaaacattacttctaatacctcagtgtgcatacacactccattatataattcataatcatgtccaaggcaggagattacattactcccaatatctcaggaggtttataatatcgcagtgggcatacaccctccgtgatattattcgtaatgatgtccaaaaagtagatgacatttctcttaatattgcagtaggcttaaaccctctctgatattgttcgtaatgatgtccaagggaggagatgacattactcctaatatcgcagtggacgtacaccctttgtgatattattcataataaagtccacgggaggagatgacattactcctaatatcgcagtgggtgtaaatcctctgtgatattatttgtaatgatgtccaagggaggatatgacattactcctaataccgcagtgggcatacaccctctgtgatattattcgtaacaatatccacgggaggagatgacattactcctgatatcgcagtgggtgtacaccctctgtgatattattcataatatccaaaaaaggagatgacattacttctaatatcgcagtggatgtacaccctctgtgatattatttgtaatatgcaaggaaggaggtgatattactcccaatatcctacacaccctgtgtgtacaccctctgtggttatatttgtaatatccaaggaaggagatgatattacccctaatgtttcagtggtcgtacaccctttgtgatattattggtaatatccaaggaaggagatattactcctaatgtagtagtgggtgtacactttttgtgatattattcgtaatatccaagggaggagatgatattactcctaacatcgtacacactttgtatgtacaccctctgtaatattattcataatatccaagggaggaaattatactgctcccagtatcgcagggggtgtacactctctgtgatactctttgtaatatccaaatgagatgatattactcctaatatcgtgctgggtgtacaccctctgtgataatattcataacatccaatggaggagaggaattactcctaataatgcagggagtgtacaccctctgtgatactatttgtaatatccaacagaggacatgatattacttctaatatcacagagggtttacaccctctatgatactattcagaatatccacgggaggagatgatgttacttctaacagcgcatggggtgtacaccctcagtgatactattcttcataatatccaagggaggtgatgatgttacttctaatattgcacagggtgtacaccctctgtgatactattattcgcgatatttaaggaaagaggttatgttacttctaatatcgcatggggtgtacaccctctgtgatactattattcataatacttaagggagaatatgatgttactcctaatatcgcacggggtgtacacccttcatgatactattattcataatgtctcagaaaggagatgatgttactgctaatatcgcatggggtgtacaccctctgtgatactattattcataatatttagaaaaggagatgacgttactcctaatattgaacagggtgtatattctctgtgatactattatttgtaatatacaaggaaagatataatgttactcctaatatcgcatgggacgtacactctttgtgatgctattattcataatatccatgggaggagatcatgttccttctaatatcacattggatgtacaccctctgtgatgctattatttgtaatatccgagggaggagatgatgttactcctaatattgcatggttacaccctctgtgatgttattgttcgtaatatccaagggagtagatgatgttacttgtaatatcccacggaatgtacaccctcggtgatactattattcataatatccaaggaaggagattatattccttctaatgtcacaaaggtgtacatccttggtgatattattattcataatatccaaaaaagaagactatattattcctaatatcacagggggtgtacacccttagtgacattattcataatatccatggcgtatgatgacattgccactaatatcaccgtgggtggtcaccctttgtgacattattcataatattcatgagagataattatattgccacaaatatccccatgggcggacattatgtgacattatgtcacataatgaggtgacaatatgtcacctctgtgacattattcgtaatatccaaaggagatgatgatgttgcccctcgtgggtggactccctctgtgatactttttgtaaaggaggattatagagtgagcaatatatttttatatatttgttgagggtccctagcaaatattataacatctgaactatgaaagcctggcttgacaactagaattttaaataacacttgtcttattcacaaaatgttataaagcttaagatggaaaaatataaaatgctttgacattacctaaagaagcatgagctcttgttaggtatatgatggtggccctgaacttgagccgacatctataatcccttttatcaatcaaaaagccatgttcttttatatggcatgcagactattaaaatacgaaaatgtgataatggataagcaactaacacaaagcccccacacttcaaatactgtcctggattgatgagggaagactggttggtgtgggggtgggggagaattcaaatatttatctgcaatcctaatggttaaaattttaccaggaacagacctgccactctcttgaaatactgtctctgagattaacgttaagaacagcatcatctctgttgaaaggctacattcccttatgatgctgattttttttttgtatgtttttgttttttgttttgttttgttttgttttgagatggagtcttggccagctggagtgcagtggcgatctcggctcactgcaacctccgcctgccaggatcaagcgattctcctgcctcagcctcctgagtagctgacactacaggcacgtgccaccacgcctggctaatttttatatttttaacagagacagggtttcaccatgttggccagaatggtctccacctcctgacctcgtgatccacccgcctcaacctcccaaagtgctgggataacagatgtgagccaccgcacccagcctgtgtatgttctttgtgtttaccgtaccaaaagcagacctgagcattttgctggccttagaggtctataaaagaactctaagcttaggcatgcagaacaggcactggatgtatgtagtgagcttaccaggagtcttgttggctccctgatgtccttatcatctctctttgcaggctgtggatgcacacaaggcaactaaaatcttgggcatcgtttgaaaatgtttggctgcctgctacaaactcagaagagagaacacttacttatattcatacttgtattggactggatatattttaaatccaattcttttttaaaaaagatgcctcactttaggaaataagacatcagaccagcaacatcaactaggtatggaatacttgctggtgagacacttaaaactaggaatcttctaaatcttctaaaggtgcttaagagcatggagaaatcaataaacaggcatccaagtgttgtggctgtaaagcaataacatagggtccctagtaaagagtaggcctaagagttggttttggagagaacttgggccaagaacagcagaaaaagctaaatgagctacttatgttgatgtgttttaatactggtgcattcgcagtatcttatggaagttgtgaacactaagaaccaatttcaagaaaaataaaaatgtttatagggcatattaaaataaaaacagcttaaattagttctgtaaataaaataggcctagcacagtgactgatgcctgtaactccagcactttgggaggacaaggtgagaagatcacttgaggccaggagttcgagaccagcctgggcaacaaagtgagaccccatctctgttctttttaatatcaaaattattataataaaaaagtaaaaataaatgtacctacttagaacacatattaaataaaggaatgccatgagaaaatggcactgcatttaccaagtcaccactagattcttgtgcaatgataaagtttgagactatgtattaacaatttcataaataaataatcaacaattttctttccactattttgatgttgggtaaagcctgacatgtgctgtcaagttttccatttgcattacatcaaattcttgtctactatggatattctgatataaaaaagactagttaaactcctattgaaagatttgccattcactacactcacataacttctcttagatatagattctttgatgttgaatgagcgttgggttgtgactgaatctcctcgtgcacatacacatttattacattcataatctttttgcatggcatgaatttgatactaaacaaggtagtttctttgactgatggctttttcacattcattgcagtaatggaattttattcccatacgaattctccaaatgtgactaaggtatgaaattattaatagcatgaaaattgaattatctgatgctgagtaacggttgagctatgactgaaggctttaccacatgcagtacgtacatgatttctccctggtgtgaactcccggatgttgaatgaagcctgaatttgactagactaaatgtcttctcaccctcgttatattcatgagttctctttggtatgaatgctccgatattgaaccaggtgtgctctctgactggagttctttttccgtacatcacaatcaaagactttctgtctggtgaggacatcttgttgcaggataaggtctgagctatgactgaaactgccctcatactcgttacatttatatgatttctctttcctatacattatttgatggtgaataaggcatgaggtttgactgaaagcttttccatattcattacactcatgcagtttcattcctgtgtgaattttttgatgctgaataagatgtgaattcaatctgaagtcttttctacattcattacatgtatagggcttttctctgaaatgaattccttgtttaatataggccaacccatattcatcatattcataggatttctcttcatggtggaccctctgatgttcaagcagatatgaaggatggcagaagtcactgccagatatagtacacttacagggcatctctttgtgaattttctgatgttgagtaaggtggacactatgactgaagattctttcacaactgctacatgtgtaagctttggctctggtgtgaattttcttgtgttgaattatgcctgagcttggactacaggatttatcagatgcttcacatttgtaaggtttttctctagtgtgtattcttttatgtcgactaagactcgagctctgactgaaacgcttttcacattctttacatttgtagggcttctctctagtatggattctctgatgtctagtaagggctgagctctgatggaaaactttctcacatacatcacatttataggattcctcagtgttagggatgctgtcccatttattaaggagggagagatccattaagctttccttacatatactactctgaaaatcctgtgttagatttatgtgttcatgtttaccagaggctgaattctggctgaagctcatgtcgttcttatcattatcatcagtgttctgtattctaagaactttctgatctgcatcaatagtagagtccagactgaagcttttttcaggtttattacattcattgttcttctcactggtgaaggcttctttgctgattgttatttgcctaaactctccaggtacaggaatttccttagaatttcctgaagcctttctaatctgtcctcagacttatacacttctctagtctcaggaacttaggtaatattgtgtttgagtcttcctactatcactttgcatgaatgtacttcttctgaaattttctccttaggaatcaacagcttgttctctggtctctccatctgatacaatatataaatagaagatacaaatgtaatctgtaccctgtgcttaggaaaagaaaactcagatgagaaaactgaacaatgtaatatctacaaggacaagaaaagtttatttatgctgaaaaacaggctcaaaatctcaacagcagaagtaagggcatgaacaggagcagtgaggtaaaacagcggacatctttagcaaagtaagaagacaccagttaaggagataatagggaaagagtttgaaagaattttagataagcaacttgattagcggtccagtacaacatgtgcacaggtcctaaacaaatggaaagggtcaacctaactgaaggaaaaagaaaataactctccatgctgggacacacacagaactcttcattctgagtgccaaagcagctacaacttggctcaacaattgaactttacttccctactaattccatctgattgattctgccttcctcacctgagaagtcatctcttaagacttctctagtcttagtttccagatcaaagacctgtagatcctgttccagctgggagagcccatcaggcttggaaattggaaatcctgatcatagagaaggaaatgggtgtggcaatgtatccccagatgctacaccagccactttttcttttaactaatgattaagacagagagaaggtaaactctgagaagacgttaattaggaaggcctggagagtgaagagggcaaagatcttctacaaggagctcaaatttgggctctagaaagatgtgtgttaaggggcaagttgatggcttgggagcagaaggattcatttaaacattattcggacaacaggatgtgtgcatgggtttgtcttcacagaagttatccttatcactctccatctgttacctaaagatcaatctttggattagagctggtctacaagcatcaaaatggaggtcatcaaaatataattctgctggactggagaaaggtgaaactcaagcatctgctacatggttagctaacctgtagcaaaagaatcagtgaaaactgaataaatattctaagaaccaatctcaagaaacaattcgtttcagtgcacataagaaaacaaagaataatatgacacattcttacccattaggagtgtagcatttattcagtaaacatttgtggagtgcctcctttacgcaaagtatgcaggggataaagagggcaagcaaggtcccttcccttaaggacctcaaggatcccacactctacacagagagagctctaaacaactaactacaataaaatgtagatagaggaaagtgcaatcaaagtgcatcttcacataaaacggtctttctatggcttgcataatggaatgcttggatctaaatctctttaaaagcgaaagcaataggcagtctgcttctgaggagacagaattttaatactattagcatcaaagggcagtttttatatgtgtccagcccagaaagcttctaatagcacacatacaaggtctagctcaagctcctcatctccaaaaacctttctctccatttactgaatgtctacaaaatttattagttgttcctcttaccctgacatgtcacatatcatggtgtttacatagatttgttttgttttttgtttttttgtgacagagtttcttcactctgccgtccaggttggagtgcagtggcatgagctcagctcactgcaaactttgccttccgggttcaagtgattcccctgcctcagcttcctgagtagctgggattacaggagtgcaccaccacacccagttactttttgtatttttagtagagatggggtttcaacatgcctgaactcctgacctcaggtgatccacctgcctctacctcccaaactgctgggattacaggcatgagccatagcacccggccctttacatagattttttaaagtagtttcaggtattatcattcatacttgatttataaactctttgacagaagggaccatgtatcttgtatcttgcacttcttttgattcatttacttaacagctacttattgaatgccaactctgtgcccaagtatcaatgtattaacagctacccaattttgtaaaaagggtattggggctggaaaatatgaagaacagctccccagaagattccatgtgacagcctatgagcaaggagatcaggacagatagaaaaaggtatttacaccccctgcgatattgggagtaatatcatcctctcccccctggatatttaatccttataaccgcctctgagatgtgtgctaaagaattcacacttggctgggtgcagtggcttatgcctgtaatctcagcactttgagaggccgaggcgggcagatcacctgaggtcaggagtttgagaccagcctggccaacatggtgaaaccccatctctattaaaatacaaaaattagctgggcatggtggtgcatgcctgtagtcccagctactcaggaggctgaggcaggagaattgcttgaacctggaggtggaggttgcagtgagtcaagatcgcgccactgcactccagcctggcgacagagtgagacttcgtctcaggaaaaaagaaaaaaaaagagaaagtattcacactttacaggtgattaaatcaaaagcaaacaggcccaagtaatctgtccaagcccaagaagctagtaaatggaggagtgagaattcgaaccctggcattcagaacccagagccagagctctttgccacattgtcatactgccttcctccttattacagaggtgcatatagtagccatttcattaaaaatgtaataaatgaatgttcattgcagggctctgatagctcctcattccttccaaagtagcaaaccaggcataaataaaagatgagatacataacttagaaacgtttacataaatttctacatattagaaatttagcacacaaaatggtacacattatgcaagaatacaaacaaaaagatgttaaacatttgagaatggttatgtatggagcattgtaaataaacaggaatagacaaaacaagagaggcctcccgatatcgcatggacatataatgataatgtgccatgaactgaaaatacaattatttggcactcagcacctgaggtcttagcacctgggcccacgtctccagaggtgaagagcagagtcacatgcctccctcctcccccacggaggtctcccaccattctaacctcacagggcttggggtgggatgagatttaaatttatatgaaaatacttacaaatattttaaaattatttcttactgttgctatatttattatataaaaatatgaatacttaatcatttttaggtgaggctagtgtaaaaaaatggaccttccaatcaaaactctataaataaaaattttaaatgttatcttggttctcatccttggcaatgattcttaaatatatctctatatattaggaatctgcagctctgcagtgtggcccaggcatctggtagtgtgtgtatgtacgtgtgtgtgtgtgtgtgtgtgtatgtgtctgtgtttatttctgtcattgctttttttaaattttaacacattttcagcactccaaaaaagaaaccaatacactttaagagtcactcctcattctccagtctcacacctgacccacagtcccaggcaatctcctttatgtctctttagagtgactcaatttccggacattttaacctactttctgtatcttggaattggtctattctggacacttcatatagatagaacaatacaatatgtaaccttttgtgattggtttctttcacttgacataatattttgaagtttcaaccatgttgtagcatatgtcagtatttcattccttttttttaaaaatatactttaagttctgggatacatgtgcagaatgtgcaggtttgttacataggtatacacgtgccatggtggtttgctgcacccatcaacctgtcatctacattagatatttctcctaatgctatccctcccctacccccctacccccagacaggccccggggtgtgatgttcccctccctgtgtccatgtgttctcattgctcaactcccacttataagtgagaacatgcggtgtttggttttctgttcctgtgttagtttgctgagaatgatggtttctggcttcatccatatccctgcaaaggacatgaactcatccttttttatggctgcatagtattccatggtgtacatgtgccacattttctttatccagtccatcattgatgggtatttgggttggttccaagtctttgctattgtgaacagtgctgcaataaacacacgtgtacatgtgtctttatactagaatgatttacactcctttgggtatatgcccagtaatgggattgctgggtcaaatggtatttctgtttctagatccttgagaaattgccacactgtcttccacaatggttgaactaatttacactcccaccaacactgtaaaagcattcctatttctccatatcctctccagcatctgttgtttcctgactttttaatggtcaccactctaactggtgtgtgatggtatttcattgtggttttaatttgcatttctctaatgatcactgatgatgagcattttttcgtatgttttttggccacataaatgtcttcttttgagaagtgtctgttcgtatttttcacccacttttggatagggttttttttttcttgtaaatttgtttaagttcctgtagattctggatattagccatttgtcagatggataggttgcaaaatttttctcccattctgtaggttgcctattcattctgataatagtttttttgctgtgcagaagctctttagtttaattaaatctcatttgtcaattttggcttttgttgccattgcttttggtgttttagacatgaagtctttgcccatgcctatggcctgaatggtaatgcctaggttttcttctagggtctttatggttttaggtcttacatttaagtctttaatccatcttcagctaacttttgtataaggtgtaaggatggggtccagtttcagttttctgcatatggctagccagttttcccagcaccatttattaaatagggaatcctttccccatttcttgtttttgtcaggtttgtcagagatctgatggttgtagataagtggcattatttctaaggcctcacttctgttccattggtctatatatctgttttggtaccagtaccatgctgtttgggttctgtagtcttatagcatagtttgaagtcaggtagcatgatgcctccagctttgtttttttttccttaggattgtctcggctatatgggctcttttttggttgcaatatgaactttaaagtagttttttccaattctgtgaagaaagtcaatgatagcttgatgaggatagcattgaatctacaaattactttgggcagtatgaccattttcacaaaaatgattcttcctatccatgagcatggaatgtttttccatttgtttgtgtcctctcttatttccttgagcagtggtttgtagttctccttgaagacgtccttcacatcccttgtaagttggatttcttgttattttattctctgtagcaattgtgaactggagttcactcatgatttggctgtttgtctgttattggtgtataggaatgcttgtgatttttgcacactgatttttatatcttgagtttgctgaagttgcttatcagcttaaggagacttggggctgagacgatcgggttttctaaatatactatcttgttatctgcaaatctgcaaacagagacagtttgacttcctctcttcctatttgaatacgctttatttctttctcttgcctgattgccctggccagaacttccaacagtatgttcaacaggagtggtgagacaaccttgtcttgtgccggttttcaaagggaatgcttccaggttttgccctttcagtatgatattggctgtgggtttgtcataaatagctcttattattttgagatacattccatcaatacctagtttactgagagtttttagcatgaaggtgtgttgaattttatcgaagaccttttctgcatctattgagataatcatgtggtttttgttgttggttctgtttatgtgttgaattatatttattgatttgtgtatgttgaactagccttgcatcctagtaatgaagccaacttgatcgtggtgggtaagttttttgatgtgctgctggattcagtttgccagtatttaattgaggattttcacatcaatgttcttcagggatattggcctgaaattctctttttttgttgtgtctctgccaggttgtggtatcaggatcatgctggcctcataaaatgaatcagggaggagtccctctttttctattgtttggaatagtttcagaaggaatggtactggctcctctttttatctctggtagagtttggctgtgaatctgtctggtcctgggctttttttgttggtaggctattagttactgcctcaatttcataacttgttattggtctattcagagatttgacttcttcatggtttagtctggagagggtgtatatgtccagtaatttatccatttcctctagattttctagtttatttgcataaaggtgtttatagtattctctgatggtagtttgtatttctgtgggatcagtggtgagatcccctttattatttttattgtgtctatttgattcttctctcttttcttctttattagtctggctagtggtctattttgttaatcttttcaaaaaatcagctcctggattcactgattttttaaggatttttcatgtctctatcttcttcagtgctgctctgatcttagttatttttggtcttctgctagcttttgaatttgtttgctctttgcaaaagaacaaaatttgttcttttaattgttatgctagggtgtcgattttagatctttctcactttctcctatgggcttttggtgctataaatttccctcaaaacactgctttacctgtgtcccagagattctggtacgttgtgtctttgttcttattggtatcaaagaacttatttatttccaccttaatttcgttatttatccagtagtcattcaggagcagattgttcagtttccatgtaattgtgtggttttgagtgagtttcttaatcctgagttctaatttgattgcactgtggtctgagagactgttacgatttccatgattttgtacttgctgaggcattttttacttccaattatgtggtcaatttcagcataagtgcaatgtggtactgagaagaatgtatattctgttgatttggggtggagagttttgtagagaacttgctttgtgaatctgggtgctcctgtattgggtgcatatatatttagtatagttagctcttcttgttgcattgatccctttaccattatgtaatgcccttctttatcttttttgatctttgttggtttaaagtctgttttatcagagactaggatggcaatccctgcctttttcccttccatttgcttggtaaatattcctccatccctttattttcagcccatgtgtgtccttgcatgtgagatgggtctcctgaatacagcacactgatgagtcttgactcgttatccaattttccagtctgtgtcttttaattggggcatttagtccatttacatttaaggttaacactgttatgtgtgaatttgatcctgtcattatgatgctagctggttatactgcccattagttgatgcagtttcttcatagtgtcagtggtccttacaatttggtatgtttttgcagtggctggtaccggtttttcctttccatgtttactgtttccttcaggagctcttgtaaggcaggccttgtggtgataaaatctctcagcatttgcttgtttgtaaagtatttcatttctccttcacttatgaagcttagtttggctggatatgcagttctgggttgaaaattgttttctttaagaatgtcgaatattggcccccactctcttctggcttgtagggtttctgcagagagatctgctgttagtctgatgggcttccctttgtgggtaacccaacctttctctctggctgcccttaacattttttccttcacttcaaccttgatgaatctgaggattatgtgtcttggggttgctcttctcaaggagtatctttgtggtatcctctgtatttcctgaacttgaacgttggcctgtcttgctaggttggggaagttctcctggataatatcctgaagagtgttttccaacttggttccattctccccatcactttcaggtacaccaatcaaatgtaggtttggtcttttcacatagtcccatatttcttggatgcttcattcattccttttcattttttttctttctaattttgtcttcatgctttatttcattaagttgatcttcaatctctgatacctttcttctgtttgattgattcagctattcatacttgtttatgcttcacgaagttctcatgctgtgtttttcagctccatcaggtcatttatattcttctccaaactggttattctagttagcaattcttctaacattttttcaaggttcttagcttccttgcattgggttagaacatgcccctttagctcagaggagtttcttattacccaccttctgaagtctccttctgtcaattcgtcaaactcattctccatccagtttacttcccttgctggcaaggagttgtgatcctttagagaagaagaggcattctggtttttggaatattcagctttttaccctggtttttcctcatcttcatggatttatctactgttggtctttgatgctagtgaccttcagatggggtttttgtgtgcaagttcttgttgatgttgatgctattcctttctgttagttttccttctaatagtcgggcccctctgctgcaggtctgctagagtttgctggaggtcccctccagacacagtttgcctgggtatcatcagtggaggctgcagaacagcaaatattgctgcctgttccttcctctggaagcttcatcccagaggggcacccgccagatgtcagctggagctctcttgtatgaggtgtctgtcgactcctgcagggagatgtctcccagttgggaggcatgggggtcggagacctacttgaggaggcattctgtccctcagcagagtttgagcactttgctgggggatacgctgttctcttcagagccagcaggcaggaatgtttaagtctgctgaagctgcgcccacagctgcaccttccccaggtgctctgttccagggagatgggagttttatctataagcctttgactggggctgctgcctttctttcaggagccctgcccagaaaggaggaatctagagaggtattctgactacagcagctttgctgagctgcagtgggctccacccagtttgaacttcccagcagttttgtttacactgtgagaggaaaatcacctactcaagcctcagtaatggcagacaccccttcctccaccaagctggagcatcccaggtcaactgtagactgctgtgctggcagtgagaatttcaagccagtgggtcttagcttgctgggctccatgggggtggggtccactgagctagaccacttggctccctggcttcagccctttttccagggaagtgaatggttcggtctcgctggtgttccaggccccactggggtatgaaaaaaactcctgcagctaccttggtgtgtgcccaaagggccgcccagttttgtgcttggaacccagggcccttgtggtgtaggcaggcacctgagggaatctcctggtctgcaggttgcgaagacagtggaaaaagtgtagtatctgcgcctgaatgcactgttccacgtggcatagtcccttatggcttcccttggctaggggagggagttcctggaccccttgcacttcccaggtgaggtgatggcccaccctgcttctgcttaccctccatgggctgcacccactgtctaaccagtctcagtgagatgagctgggtacctcagttggaaatgcagaaatcacctgccaactgcattgatctcgcttggagctgcagatcgcagctgttcctatttggccgtcttgccagccccctcattcgtttttaagactaaatgatatttcattgtatgtagatgctaattttgtttatccatttatctattgataggcacatgctaattttttatgattacgaataatactactatgaacatttatgtgtaagttttgtgtgaatgcatatttttgtttctcttggctacatacctaggaaaataatttctgggtcatgtgggaactctacatttaactttttgatgagtttaagcatcttcatgctttaaagttccctggaaggacaaggacctggctctctgactccccaggctgtctcttgaaaggtccacactccaggtcaggtttttgagaagttactttaatgttttatgaaaagagaggtgtcttcacttcaactttttaatgaaaagattcatcataatgattattatctccctttcatcatacctctctccttagctctatatactttgagaatgacattattcacctttttaagtaaataggtcacatagcacagttatgagcacatgctatagaggcagccttcctggcttacatgctgccttccctacttaccagctatataattttggccatgttacttaacagtttctcatgtataaaaatgatatgatgacaatatgatattactttcttagggttattgtggaaattcaattaattaatatctgtgaagtccatagaatggtacctggcatagtctaagtattctataaatgttcatttttattatcctactaccaacattccacaatgtttgtcatacagatggtgctccacgagtatttgctgaatgagatacatgataagagggcttagctagagcaagactcatcacatgtaaagtattaatagaatgaaccagtccttcccatttgttcctagggaaactaatcactccttcctggttgcacctacagcacttagaacatccaatagagctgacatctgggccttggaatattgtggctgtgctcatatctgtggctcacaaacagctccaaactcttcttcacctttttatagctgacacccagcagaggagccaagcactaagcaggtttgcaaatattcaatgcaacaccttattggtacttgattggcaataagaccagtcttaaataaaatctatatatatatattagccattaaccaagaccaccaagttttatgtgcagttttataattagctagtagtacgacatttgaccatatagctaccctcttttgtgttttcctaaggtataatattggcccagatgaaaatgggatttgtttggttcaaaaatcgtcaaaaatcagctatttcatatgattcaagctgatacttccagccctcaagttctatgccctaagcaagtagttctcaaaagactcctttagtcgagaaagaaaaaatactccttatgacagactcgtacaacataacgtacacacaagcatgagtgtacttaataagcataggtaactttgaagcacagcactaaacgaagggaaatacgtatttattaacagtcaggaccacaatcccatttaaatttcaaacaactttcagaaataggtatctcttcacattacaaatgaaagaaacagatgccaaatgaatcacttgtaaatgatacagaagtattaagtgtggatccaggactcccacctacccccaagtctatctgaatatagagcctatgttttccccaccacgaccctctgctttcgctgaggaagcctaacctacacagaatggccctggaaagaatgactaaaggataagcagccaaaaccagaatggaaaataattcgtatactctaattttactgcaggatgcaactgcaattttatttcagtcgtaccatttattatgaaatatctcttcttgatttcctccccaaacctgacattgaagtctcgatggtaacattaaaaaatctcttagctatatccttaagggttcagaataaaatcttcctgtacatgataagaggcagcataggtcaagagcctactctgatttctgcttcttggtgatcatacaacttcatacaagttacttggcctcctcttgcctcagcttctcacttctggaaaaattaagaaaatatcagtaactatcatggaattttaaaacacaccttccttttcttacagaaaaaaaaaagaggagctaaaaaattatatttctggggttttttgtttgtttgttttttgtccattcttggttaaaaaggaatcagctaaggaaacttgaaggcaaaagagtgacgtagaaactacagatactttattgataaacagttgatgtaaatatcttattttgagtaggtgatgtaatggaaatggtactaaaacttgattaagtaaagacaaaactggccaggcatggtggctcatgcctgtaatctaagccctttgagaggctgaggtaggtagatcatctgagcctgggagttccagaccagcctgggctacatggcagaaccctatctatacaaaaaatacgaaaattagccaggtatggtggtgtgcacctgtggtcccagctacttgggaggctgaagtgggaagattgtgtgagctgagaagtcgaggctgcagtgagctgagattgcgccattgcactccagcatgggtgacagagtgagaccctgtctcaaaaacaacaacaaccaccaccaaacaaacctaatatgttatgaataaatttaactctgtaactcctctgtataagtcatggcagttttcctcttgtgtgatttccttcttttcactataaaaaaaatgaggactcttctgttgtcgaactttgctaaatcatattaataaaatgtatgccagttaaggtgtgattttttctttttctcttctttcttttttctccaaaaagccatcacaagagagaacaattttgtttttttttgagataacgactaagattaatgtggtcccttttatataagctaataagacaaattgtttttaatttttaaacaaaattattattttttagagacacggtctcactctgtcacccaggctggagtgcaatgacagtattactgctcactgcagccttgacttcccaggctcaagggatcctcctgcctcagcctcctgagtagctaggactacaggtgcacaacaccacacctggctaattttttattttttgtagagacagggtctcatcatgttgcccaggctggtctggaactcctgggctcaagtgatctgcccacctcagcctcccaaagtgctgggattacaggtgtgggccactgtgcccggcctataatattttaaattgtaaaattaaaacattaataagtttctaaacctgaatctaacatgtggctttatgtcctgataactccacatgatgttacgatgattaaaggagtaaattcatgaaaaacacttaggacagtgtctggcacaagctaagtgttcaggaaattattattattagtgttgcatcttaatggtctcaagctattatttttcacccatcatatttagtgtaaaatagaatttggccctgggaatcaatgaccacatacatggtataactaatctcaaatatttaaattgactaagatatctatgtttcattaaggtaatcttggcccatagagtctaactagatcaatcgtttacaatcattaaaagaaaaaaaagtgaagcacataatgcaaaaacatttcacaggactccatgtgatataaattatataaattgttattttgttttatcccctagctgaaaaaaatacataaagagtaaaagctaccataaatcctctaatgctttgaaattaatttgtattttgtttttgacaacgtatatttgaaaatttatatttgagccatattcattcacacggcagttaagcttgtagaatatacagattcactggcgttttaatagcttaatgagctcctgggaagccatggctagccattaggaataatgagttagaaaggtcagcaaaaccttttctgcaaagggccagagagtaaatatattaggctctgctggccatgtatgtctctgttgaaacaactcaactttgccattgtagcagtgggcaacatgtaaacaaatgggtgtagctgtgttccaataagacttcactttcaaaagcctcagcccacactgaaggtggggaggttatgcaaaggtgtaaatgccaggcagcaggcatcactgggagtcctcgcagaggctgctggccacataacccaatgctcacgatccccaaagtgtatttggaggaacatgaattgttgatgtgtttgggaatttttttgaagctgcattttatatttaaactatattttcaaaatttcacacaggagcttcaatcaagctgtgtaataagtatatgggagtcatttatattattctctataatttatttgtaatatatcaaaacaaaaatgcctcaaaaatatacagtaaaagaatcaaacacattcctagagttgtttttatgaacaatctgtttatatagtgctggtttatgttttatatcttgtcataattttaacatatgtttaagtatgaatgtttatataatagtaagtttctctcatagaccatctctcttctgcttaccacatttcctttaacaccctaattacaacgactctgagattctacctgaaaaattagcaagatgcccccacattctagcttttctctccacaaatattgaggaaagtcccagctttgtttacacatgtccttgagtcagacctcattgccacctactgatgtgatataatttgggtgtgtgtctcctccaaatctcatgttcaaatgtgacctccaatgttgcagatgagcctagtgagaggtgtttgggtcacgggggcaaatctttcatcaatggcttggtgccatcccaatggtaatgagtgagctctcattctggcagttcacacgagagctaggttatttaaaggagactgggacctcctcctccctctcttactacctctctcctgccatgtgatatgtccacttcccctttgtcttccactatgaatggaagcttcctgaggccctcccgaagcagatgctgttatcatgcttcttacacagaactatgagccaaataaacctcttttctttataaattacccagcctcaggcattcctttatagcaatgcaaggtagactaacacgtgatgctcatttttttttaaagcctgcaaacagtaagaagattcccctctctttctcagtggatgtaaagcagtgattctgcataaatgtatcaacactatagctcaactccttctggagtggacttcccctagacctggagagcgagtcctgcctagcatacacggcctgaagttcgagatctcttccaattcaggtaatattccgctttctgtatgcctgatctctacatatatctgacattgatttttaactcaaatgaggaaacaggaaattattaattacaatctcctaaaactacaacaggtgttataaaacttctgaatataaacaggcagacagcaaaaatgtacacaggcataaaatgtaaacttgagtgagaaaaaggagctgaaaaatgaaaggctcgctttgaaacaaaacagcactgaagagtctacaaagagagagtgactggagagagactgatgtgggagagcagaatggggatcagattataatgagtatctctcccacactaaggaatttgcagctttttttgataggcaataaagagttacatataacagctgtatttaaattgttcctaggtgatggagctgcaggtaattcttttcttcttcctttttgtattttactttttctttttttttttttttttttgagacagagtctcactctgtcacccaggctggagtgcagtggcgtgatctcagctcactgcaacctccacctcctgggttcaagcaattctcctgcctcagcctcctgagtagctgggattataggcgcacaccaccatgtccagctaatttttgtattttagtagagacggggtttcaccattttggccaggctggtctcgaactcctgaccttgtgatccacccaccttgatctcccaaagtgctgggattacaggtgtgagccactgcacctggccttaatttttgtttattggaaaagaaggaaaatctatatttttaaggccaccagccacagcacttagagaagaaggaggacgtatattgcttttgctgtttcctgttagcctgacatttgcgactacattgactctgctggggtcactttctctaatttgtggatttttttttctttctcaactgcctggaggatatgtatgggtccatgactcggccaccacataagattgtgaagattatacctgtcaagggtgcccagtcaaggaagaagagtggctgaattcagcctgtgctctgcctgaaagccctatgctctgtgtgggccttagtccacctagaggaaggggtaccttttaaaagtacacacaaaggcacatcatgggctggccgcagccctgcctggccccaggtgagctagcagtgccagatgcctccagaatagactggaaggccttctgtccctctattatgtcaaaactgcaactggaactactttgtccaaggaaaggagagagaaaccataggaaaaggccataggagaatggtgtctggaaaaaaaaactgcaacgaatataagagatatgaatgaagcagatgcaatgaaacaacaggtttaatttcaggcttattttagcgaatggaatagaatccccattgagtaaacacgaatacaaagggtttattgagaagatacagaggaattgcacagagccaaaagcccagtctggcttcacaagacttggaaaactagagtgaggttcaaggaggttttccccgttcatttctccagagtcacacagcctctcctctcctcacctctgtactgtctgctctactcttcagtctctctctaaagacaagtttttcttactcgttagaaagctcacggcaaaaaatggctcctcgatctcaactttatgggaccattctcttcatgcattcactgttctccgaccacaatgtctatagatttggatcaaatttccaagagatgagagagcaaattcctattttactcacttgcagattcaaaattaacacagatatgatttgtaaagagagtatttctaccagtcttgaccaggacagtagatttctatattgagttctacagatcagcccatagctgtgttgaagtcagataaaatataaagactaatctctaaatttaaaacattttatttgggaagcaaagattggattcagcacatacccacagactggctggcctttagtatgtccaaagaaaaaagagaaggttggaggcttttataaaaaggacaaatgttacatattattttgaaagtaatttcattggcactagtaaggttttggatagctggcaagctctggttggtgaacgatggtggtggctgaaactagttgtagagttacagcaggctgtttctgtagctattatattaaaactggttcacgttaaaacaggcagtttcggcagccaggtttgcagagaattacattcttggagcaatatgatatgccctgagtgcattttccccctggttcctcaactctgatttagttgagtataacaagaatgacccaatttgtgtgatcaactttcacagctggttcccaatcattgagtcacaaagtaagaaataatcaagacaagatataagcaattttatgaaaattcccccacaatgtgatgaatttattgatgatcatcaacagtgaaataaccatgcttaaaactccctgttctatataaattattgaactgacagacacaggcatgtgacttatcaaagaaaaaaataagtatgctttttagctagaatgcctggggaattaatgagttcaaaacttagggagatgcattattctctcttgttaaacaaaatgagaccgtatttatgggttaatatttggcaaaggtgtacaactaccatcagagatggctttgaacagtcatggagtctgaatgctttatttagcaaaaattgtacaagaaccctattagaatactaaggctacaaaattcagagcaggtaaccttgatttatacgtgtaggaaaaataagtctttcaaatgtcagagtctggagttttctgcaattaagtcataatttttgctatttttacaggtcaacaagaaaactcaattcctcttcaggaagttaagtgacttaaagattacataagagctaagaagacaagccagctaagcatgttcaagaccgggctttttgaaactgcactaattgatcataacggtgtgagtttcaagccccttcatagctttcctatagctcactctgtgcctctcccaaatgacaaaaacaaggcaaacccatagagtatgagtttacatcatatgcaaaaaacacaagtccagagtatagaaaatggaagaagaaaaatgaaatcaatgaactttaatatcgttaaagttaacactatatccatggaactttgatctggcatagttttttgccacattttatttaaaagatttcaatttatgcatccttttccacatctaggttatggattctggcagatataagattgtctcttatttaatctctgtatccttagcaactagtgatatacctagcacagaaaaagcactcaacacatttgatgaatgaatgtgattgttctgttgacaaaaggataataatctcttgactagaaaaaaaatcattctaaaaatcatcacatcagggactaaaagaatttgggagtttatttactgttgttcctctttgtttaaacacagcaggccctcccaagtatcctattgcatctggcccacaagatctagttgcagagataaatgattcaagaaaatttccctggcttactccccatttataccagatccactacttttgcttccatcctccatttctctgaattcagggcccagtacctctgactttgatcaatgctttgggctccttcaggtttgatgactgatagaagttaccctctggttcatgaaacctctgcctcccacatgactcttgtcctagcttgcttcacaatgattatgattgtattaggctccataaataccatcatgataatcaaatcaacactcttagagggctaactgataatggcaatgaatacaccatgaattcaatggagacacctgtctgtcattacttgtgtaaacgatactcattagtggttctctgccttggctgttcatgggaaatacctggggaaatctagaaatattgatgcttacccccatagattttaacaggattggcttgggggaggcctggcattagaactttttaaaaactttcagcggattcttacataaagttttcaaatcactgctttaggctgaaaacctaactggtgcaattttttccatattgcagagaatagacattacaaaatgaaaatgaaaaaatttcctagctttgtgttctagtttcttgtctgtgtataccataacatttatctaagtattgctaggtgaatgtaggttggctgagatgacatgttaaaaatttccctggagtaaaatgagctatattgagtggataggtttgagacatgttaaaaccaaaaaatccaaaacgttaatgccataaggattgattcttctctctaaagtgagaaccaggggagaatgttctcctccacttcctatcttaactgaaggctgaaagctgtccatccccactcccaccccacaggatcaacaagaactggcattctctgactgtcccctcccacttgcaggtcatttgcccaggcattggctatttcgagagctgtctgtctggagacatagggaacttagctgttaatggagggacaaatgccagccctgggagctgactcatgcctaaaatatgcagagggagcccaagggaatgcaggcttcctttctcttcctttctatttgtctttaaacagctgatggggaagctcccttgctacaggcaactgagaaatagtgctgactcagcttctgttccaaggctcaagagataagggcatagcacagccctgggtgctggcatcttcaattttaactcctgtttgccatttgtccctctctctagaccataagtgtctgcttatatgttgtgccaaaagtaaagcttcaatttctagaagaaaaggagagtttattacatttaacaaaaatggcaaacaatactgtaaaaattgcataccatgtacagtttaaataaactacatatagtatatttggcttctttcattaggcctcattattatggttgtcttcgatttctccattgatagtgatcctccccttggatagtcctggtttgaggccagggcagagctgggaggagaggggtcactaactgttcacagcttgcaccatccctaacatgagattccaaatgaattttgccacagcccaattcttacagacccttcaggctgtagcagtgtcatttaagacacctggctcttctccagagacacattcgaacaggcattgcaatcaccttgctggcagaagaaagaggagataggacagtccattagtggctagagctgcaacttgaacagagtcagagacaggcaaaaagaagcaggtagcccacgggcaggcagcgaaagctgacattctctctggacagggctatgtcacaggagagctcacggcagggcttgtgtggattaagatgagggttagagataaacagcagactcctcagtatcttgaacagcaggcctcagcttgccttgtatgtggagacagcaatgaatgggtctccttggcaacggaggcatgcatgctcagcaggactaccgggcaggcatctgcaagcctgcgatgagtgttggtgtccctgccctcttcttcttaatgttcatgtcatctaagtataccgcccttttactcctcttcactgctgtcatctactgccttcagatcactgtccatcattgcgtagaaatcttctccaccacaaatcctgagagatttcaacctctatttagatagccactgagcaatattgctttgtaattcctgagtctcctttgctgcattgcatttcagcctcctaatccaaggagctgatctgggatcttaatatcctccaaatgccccaattcagaaatcctaactccagttgtccggtctcagattatcccctatcctttctgctgtctctaccttcaaaccatctgttcacagagactcctaattccttgacttgttctttcattaaggtctaacaggatcctcttagcctctcttcttccattacactggccagaccccttcattctaaattactacctcaccagaaagatcaaaacttatgatcaattttacaacctaccttttctgattctaaactctggtgttgctgctgcaagtgcacactggcacaaagttactatacaattcatttgtgcttttcaatctcagcctagccctgagcaatttgtcaaccttcctgtttgtctttgaccaggttcttcatcccacttctcaatggctctcagttgaccacctcatctcatactttattcacaaaattggcagtgtcagtaaaacatcctatatcatcctactcatacacattacaaagttgcctgcctcctctgcccaagtctcagagggcaagttcttcctgccctcatcaccactgggaacctactccctcctgctccctctgcaattggcttcatcaatctttttcttgttttcctttaccttcaacctcaccttcttcattgagccctcctctagtatctacagacctgctcatgttcctctcaacctaacattttatgccttgtatatttcaaaggaagctagaaatgcagatttcttgagatacctctcaattcttaactgttggcaactatttttaaaaaatattgtaaacactggtgagggaaacaaaatgaaaatttgggccaacttggtccaaaggctgtggatgagtgcccatggattccatggctgaatttgcttggttttctttgggaatctttggtttttgctgctggtggttgtttgtgagccaacctccctctgcctactcaggtgttcatccccagcccatgagtcttctcttactacacagtctttctgagtgacgtcctaagtctatatctcacactcttacctatgcttttgtttctgacttccatttccagttcctgctatagctggaaatcttacaaacacttcaaagtccacaccagccctcccatcacccccaacctctatccttcgctaagccaacacctacacataatttaagactcagcttccctgaaaccaagctgccctcctctccatttctctctcaggattgggatacccctcccatgtcttcagaacatttttataattatactttctagaaagtattataatgatctgtcttggtatctgtcttacccacctacaatgggacatgtcaatgagcaggggctgtgtctcattaatctttgtaatcccagcttcaagcatagtgctgaaatatagtagcttcctattaaatgcttggcaaattaataaacaaacaagagaaaaatgcactaaaacagaaaattgtcatatgcccacagaacacatttcctatgttatttttatttatggtctctgttacataattcgtgttatagttaacgtaaaattttggtattttatcagaaaaaaatattttcccttgttactttttaaattaagaaaaaacttagactagtcaagtgcagtagagagaaggcagggaagagtggaacaacaagttcaatctgtaactatgaacaatcaattgagataactcactgccttcagaccagccttaattgttattttgtaaagcatttatttgcatgataaaataaaactttattacattcagcaataaaaaatataaaactgaatgatggaagtcaattaataaggtaggatttgccaaataaacatacaaaacataatgatacacatttcttttattaagtgagagatttactaggacaattttctaccataaaaatggaaaaattagggttttttgtttttgaaattatttatttatttatatgtattattattattattaccttttttttttttgagacaaggtcttgctttgtagctcaggctggaatgcagtggcacaatcatggctcagtgcagcccccgggttcaagcgatcctcccgcctctgcctccatgagtagctgggaccacaggcgggcaccaccacgccctgctaatttttcttttgtgttgtttgtagagacggggtttcaccatgttgcccaggctggtctagaagtcctgggctgaagcgatccgaccgcctcccaaagtgctgggattacaggagtgagccatctcgcccagccgaaaaagtgttttttgatcttaaaatcttacgtggaatgaaagtgaacaatgaggcaatgaaagtggaagtttctcttaagcaaacacagaagtcaaccattccagctttctaaggtactggtaatactctttcgtctattttattttatggcataattttaagactcctgtgagctatgtctttaggggaagtttgggaaggacaggcagagtgtcaatactaaattaacatcagtttaatttccgcccatggttatctgggcctcattccagcattaagactttcagaaaaaacattgagataaagctgtctttttataccaacaggtggcagtattgctttgaaacaaacgacagcaacgacaccgtactgtcccattttaagaaacttctagatccattgcatttctaaaatcttacacttttattagacttcgcctttttaatttaattttatttgtatttatttatttatttatttatttatttggagacagggtctcgctctgtcccccaggctggagtgcagcggcgcgatctctgctcactgcaacctctgcctcccgggttcaagcaattctcctacctcagcctcccgagaagctgggattacaggcatgcaccaccacactcggctaactttttgtattttagtagagatggggtttcaccgtattgcccaggctagtctagaagtcctgagctcaggcaattcgtccacctcgacctcccaaaggctaggattacagcgtgagccaccgcgcccggccttttttttgaccgtctggtggctttgtctcccaggttggagtgcagtggcgcgatcacagctccctgcagctttgacctcccgggctcaagcgatcctcccacctcagcctcccgagtagctgggaccacaggccaccatgcccagcttctaggcttcaacatgccccccaaaatgacagtggaatagccagatgcggtggtgccagcctgtagtcccagctacttgggggactgaggtgagaagatcgctcaccaggaggtcgaggctccagttggctgattgtgccactgggtgacagagccagaacttgtctcaaaaaacaaaacgaaacaaaagtggattaaataaagcacaaacgtggtatttgaagaaaattaaaaaggactcaccaatatcgcccgttcattcagagccttgcctttggaagaaacacacactcatttatcttcccccaggaaggcctctttcctatcaagtaaacctagagtgatgattaatgcagaaaaacaggccccgtgttgcaaatgataagtttgcttctctgagaacctccagattaggttacattcaattcactaatctagtctccagcctggcaaaaatttactgtgaaaacgtcttcaagtaagtttcttttttacactgactgttgggataggactggaatcagcgatcacaatttgatcctaatttgttgatgttcccttaatttttaaaattttttgcatgtacatgcactcatgtaaccatcacactgattaaaatatagaatatttctagtacctaagaaggtttcctatgctcgctcaaactttaaaatcagaaaaaaatatatttctcaatttgtgtgtttaaaaccaaaacaaacaaatacaaaacatgaagtagaagggttggggatgtgaaaggaaaataaaagttggggtccccaaatcactaagctaaaggcaaaagtcaagctgggaactgcttagggcaaacttgccttccattctgttcaaagtcactcctctgctcactgagatagatgcatatctgattgcctcctttggaaagactcaaaagaaactcaaaagagtgtaaccctccctccgtcacctatctgcgacctgggagccccctccctgcttcaagtcttcctaccttcacttcaagttgtcccgcctttccagaccgaaccaatgtacttcttacatatattgactgaagcctcatgtctcctaaaatgtataaaactaagctgtgctacatcaccttaggcacaaggtcaggactttctgaggctgcgttacaggcacatcctcaaccttggcaaaataagctttctactcaaattttcagggttcacattttggtaaccatggagggattcttagtggagatggccctgacctttgacaagtctcctattggtgcttgataccagcaggagctaactttatggctcaaaccgaaagaacaatttgctaaggtctgagggcacccactccagagaatccctgatttccccaaattcagtcatgaccccaactttattttgctgtacaactcctctttttcttttgagttttacttgctcccaacacaaggaaggcaagttttcttgcttccatgacgttgaaaggcaggtaactccttcaaggagtttgagctcgcttgcaacagagaaaatgagcttggttttttgttgtggttgttttttcctgcttctagggtggtagagagcagtctacagcctgagacccatcactaggtaggaaactggtttgggattctatcttgcaaactccttttaaatgactaaagttagcatttaacaaccagctggtgttaatttcttcttaatacttagagcgctcagaaatagtatatttttgtgtgatcattgttagtttagcagcattttgtcctagttgaaatatggtaataagatttaaaaaacatttttaaaggagctcaatgttaaaaatcaacttaattaaaaggccatccaagatgtgtgtatgtatgtgtgcatgtatgcatctttgtatttgaaaggtcttcaagtttttgctttttgtttgtttttctctcctaagaccttgtctttttttttttttgagcaaaagtttttttttctttttcttctcagttgactgaattctgttttcacctgattttttttttcttttttactaaaatagttattgcaacagaggctactgttaagtttttaagaaagagtgtagtttaattttatgtttcatttggctcaaaataaaataaaaaacatctccctctaggaccaccagactctttctctctgtaccttatgatgtaaattttgctatttgattttcacctgagttgtttcctttagtgtgcaaatttaaggctatttagctgacaactgcctagggttgtgaaacaggctatcaagaatctgaaagtctaagataggaaaaaaaaagagcggggtctttataaatctataaaatgtacttccatcggcatgcctaatacatctttgtatgtatttatgcgctgtgtacaaaatgtttcactactaaaaatatataaaagagctctaatcaattggcttaaaggaaaataaaagctcttaaatcagatactaaaaaatagactagtcaaatgctttttcaagtttatgtaacttaaataaaatctttaacaaataagctagctttaaaattattggtaaagtaatattagaaatgtcttaagaattgccagcatacagtttttgttttgcatttattaatcaagcaattccatacttatccctgccaaatgctataaggtgtcaaaatttggcatgggattacgaaactataaaaccagtccaaaacagaatgatttttgtttgtgtaatttttaataagtaagacattgatatgggtttaatgaaaatagctgcatcttgaatttagtaagattaccataatttctaatcctgtggctttaggcagtctagtccacaggcaataaggaagtttgttttgggaaaggactgttatcatttttgtttcaaagctaaactatagactaagttgctcccgaagttagtttggcctatgcctaggcatgaacaaggatagcttggaggttaagagcaggttggagtcaattaggtcaaatcttattttcactgtctcagttatacataattttgcaatggcagtttcataactttaaattcatgactatcacagttttcataaataatctaggtagacaattaaaataaaatagataaatgtaatgggataaatacttgtagaaaactggtcataatttcataatttagaatataaagttatattaaattaaataatatatatttcattatttgggtattttccaataaatatatattgtaggaaaatattcttgcaaaaaaaagtgtgactttttaaaaaaaaaaaggtgaaaaatttttgtctaattcgaagcttatttaaaggttatatataaaacaaggtaaaaggaaccatgaaataaaaagagatgtaaagttataaaaataaagaggtatttttgtgtgtgtgtggtaagaaagcttaaagagaaataattttatatgagaaagaatcttacatggtaaacttcagtcctaaaataaaatgactggttgtttaaaaaggaggcatattcaggacaaatcagaaagtccaaatattaagttctggtttgcttagggaaaaaaacctgagattaaaaaaaaaaatttttttaaggttattatatccatgtattttcctgtatgttcttttaaagtccttgtgacattgagttacagggttttgactcctggatctaaaaaggacacaaagtcttgctaaatcttaaacaccaacagcaattaaagcctcatcttcaggccctgtagaagatgccagtcaaaataaactgcatttctgcgacacagggcaagaaattaaagctatttcaactcctcaaggcccagggactatcacagaagagatgggcacacacgcaatattgtaagggccaattttgaaagataaaataagttaagcttctttatagatgaatcattaatgtcaaaggcacactgatggaagaccagcatatgggcccctgtgtcagattaacaaagttttctcaaagcattaaccaactccttagtgaaggtcataaagattataaagtgctatggaagctatatcttatgttcaagattaaaaattttatagattgtttataaaattttgaaaaacaaatttaattggattcatgctgtttttattagggcttattgtttggaaaattaagtctcttctcaaagaataaaggttcttgccttttttttaaagtccagaagttatcactttggttaaatgaatgacttattttacaatgacctgtgatcctattttatgatatcaaatgtttaaaacctttgatatttgacaaactttccaaaatcaaattataaattatgtctttttctgacctaattaaagctttaacatattaggttccctaaagttcagaaaataacataatttggcttatttggtacaaaaatcatataggaagcattgtcaaatatgaaatggtgttgggtttttgagggctgcatttttaaaatatgttattagtatgtgttccaaaattatgggaaattcctataattctatataactcagtgtacattatcagtaataatcataattgttatgttaaaattattgtgtgccgcagaggtaacaaatgtccttttcaactgtgtttttgactatggctgtcctaaaactttttgtcatccatggacaatttttgtcttgttttggtcctctttagaaggtggctttataatcagctacaaaactctaacaggtgctcttgaatgcaggtttctgataactttggagattgtgacatcagaatagaggaaaaactttcaggactcatggagagctataaaatattcatgagtatcaagcagaacaggaattaactgcatggactgaactgatctttttgactttttgcttaaaatgttgctgatcttttgttttgcttttcagagtcttaaaacttttcttttgagctattggcagcttttaacaatttagtatactcccataaacaaagtttggagcatatttgtttctctttagctgatttctccagaatttggaaactatttgtaagtattcttaactcatggcaatacagttatttgcataagtgcaataagaatctgttttcattaataacagaccacaattggagaaactgcttattttaccaaggctttgactggaatggtgtgctttcgtttaaggaatcaaacttgacttatggagccaataaagcccttgaaaaaattggcctcatattttgtgtacacagtccctgtacagggtttctgacctgtggtaagtaaagaatgtcacttctaacaggcgtagaggcccccggtttatcttggaacctcaagaggagagaaaattcacccaactcacaggtatttgatggcacaaatccatggctgggctctgctttaaaaacatcttatctggtattccttctatggaacaaggttccatcaaagccaatataaagcctatgtaaaaaataattttttttgcactgtatataagtaattaggccaagtataataaagcaaaccaatcctaccatgatttgtctttagcaaaaatgggaaactggagagagaaaaattatgtttcaaaaacaattgtacacctgttgttagattctagtcttgtctaatgtttttcaatttttattatttctacagtttgggctaaattctaattttctcttgactacaagtcttcaaaataatgttttcaattttttttttcttttttttccttctttttttttttttttttcaatttttcctaactgggagtcactgaaaaccaagctgtgctttcttaaagccctgcaaactgaaactagacaacttaaagttcagaagaaaataacagccacctatttacatgcataagccactttcatacctgctactgatttatagacttcagagtagtggggcctatattgattttccaggagtgttcttttgtttgttgtttttctcccttcttcttccactatttgctcttctaggaataaaccatcctagccatgaaagatcaggtgaaacctgagaccagagactaattttctagttaaatgccatctccaaaatatttttaaaaagaaaagagggtaaatgtgaaaggaaaacaaatcttgaggcccccaaatcactaagctaaagggaaaaagttatgctgggaactgcttagggcaaatctgcctcccattctattcaaagtcacccctctgctcactgagatgcatagctgattgcctcttttggaaggactaagcagaagctcaaaataatgcaacccttcctgtctcacctgtctttttacatatattgactgtacttcttatatatattgattgatgtctcgtgtctccctaaaatgtataaaactaagctgtaccccagccaccttgagcacatgttgtcaggacctcctgaggctgtgtcatggggacatcctcaatcttggcaaaataaacttttaaattaactgagacctgtgccaaattttcagagttcacaggaagaaagacaaccctcctttatacgttgctctgggcctctgcattgcctggatgggaactctgggatagatgcttttagaagggtctactgaacccatgagccattcccttctctggaaatggctccccaagtaatagcttgggcttctaggaatcctgttggtagtctgtaactccctactcatctggatatagttaattggaaaatttgacctagtttgagctaatcatttttcttctcaggaatgtggaatccagaccaaaggaaagccagccagtctattttcatggctgttaggtacaatttgtatgcttgggagctgtggagttgctgtattctgtcataagggcagatcagcagagaaagctaaagcaagaggagaatagtaacatggacacaaggcagaaatgcagagatcaaagatggaaagagaatatatcccagattcctaatggctttccaaaactgatccccttctttcttgttccccaaatactgccctcttcatatggcccttaaattcttgtaataaattctcccttctttgtttaggccatttcaaattggtttctgtttcttgcaaccagacaccttaaaaaaaataaactcaaattttctttcatgctccctttttgcatggtaattaagagcatagaatgtggagtaaaagagataaaactttaaatttcagctccttcattcactagttgaaaacctagtagaaaaacttaatcacttaaactctctgagctttaatttccatatctggaaaaggggaatacttttagctatctaaaagcatatgggtgtcaaacaaatataacgacgtatataaaatgctaattatagtacctggcacaaaagaaatacttaattagtggtaataatgattacatatttattcaataaatacttatcgattactaactatacaaaagttagatgacctgaagtgtacaaatatattcaagatttaatctctgctctcagacatgtacataaatatccataatagaagacattatagaataataaagggtacatgaatgtttttaaaaaacaaggactctaggtcataatcaaagaaatgcaaattaaaaccacagtgcaatgccatcagaatcagaaaaataaaatagattaaaggccgggcatggtggctcacgcctgtaatcccagcactttgggaggccaaggcggacggatcacgaggtcaggagatcgagaccatcctggctaacatggtgaaaccccgtctctactaaaagtacaaaaaattagctgggtgtggtggtgggcacctgtagtcccagctactcgggaggctgaggcaggagaatggcatgagcccgggaggcggagcttgcagtgagccgagatcacgccactgcactccagcctgggtgacagagtaagactccgtattaaaaaaaaaaaaaaaaatagattaaagatttttctaatttttaaattctttttctttttaaacatttttaatgtagaaacagggtctcactatgttgcccaggatggtctcgaactcgtggcctcaagcaattctcccaccgcagcctcccaaagtgctagaattataggtgtaagccaccacatccagccagtttagagatttcaagtaatagtgaggatgttgaacaactggaattcttgtacattaatggtgggtatgtaaattgatataatcacttgggaaaactgtgtggcagtatctacatatgcataccctatgacccaacaactctactcttacctctatacacaacaaaagtgcatacatactttcaccaaaagaaatacatcagaatgttaaatgtagcaaaaagccaatcgacagatgcataactagattgtgatagtatgcacacaatggaatactgtaccaccacaagaatgaagcattcacaaataactataacaatatgaatttcattaacataatgttaggagaaagaagctaacataatgttaggagaaagatccaagagagtacacatgttataattccacttttataaagttcaaaattaatctataccctaaagtgtgagttgtagttacccttaggtgggagtagtgactggagaaagggtttctggggtgctagtagtgttctgattcttgattattccagtgtgttcagtttgtgaaacttcttcaacctgtatgcttacatttaggtaagtatgtaaggaagtacatgtaaattatacttaaagtttttaaaaattaagcttagccaagtatagataaaagtcacttctacctggaatgacagtacaactggatgaaggaaatcacatttcttttcttttttttactttttttttttttttctttgagacagggatctggctctgttgcccaggctggagtgcagtggtatattcatagctcactggaacatcgaactcctgggctccagtgatcctccccaaagcacagggattaaaggcaggacccacctcaccctcagatctcacccagtaagaaatcacatttgcattaggccctcaaaggtgggcaagtcttcctaggtagagacagggaatgagcattctagaaaaaaaggaatggcagaatggcacaaaagcaaaagcacagaggtttgaaaaagtaaggagcatttggaaaatgactaaattagccaaagaataagattggtagaagaaagtaggaaaaaagtttcaaaacttatctaaagaatttgttccttattcattgggcaacaaggagctagtgaagtgttatgttctattttgtttgaagtggaaaacaacatgatcagatctatactctgagaagatcaatatacaggagatagtggaggaagaagagcctagaggttgggtagggtagcatacaaggagaacataggaccctttgtgatccgccccaaactgtcactgaatactcccatttttctaagagatagtttaattattttttctgtctcttctctttttcctttttccaacttcctacttagctctttagaaatgcaattatagcctttaccacctcttcagcagatattcctcacagggcaaattcatctaactgtgtgcttagaagctccagaatggaactcttacccaccaggaggttgccccgagagataacagtcaatttacaatccaaagtatgcccgctagagtttttggccaccattacaactcatttctgcccatgaagacaccagcttgacagcctgatagataaggcaccaagctagcacaaaacccctcacctgcttgtgtcctcctttgccttttaaaagtgcccactttctgctccaaaggtgaagcagtatacttaaggacggaagcctgtacttcttcccctaagctagttttggaataaaaaggcactttctttataccagaccttgttcttattaattggactctgcaagcggcgaatgattgaacctgcacttcggttgcatgactaccaacccatctcttcagcctcatccctcacccaaccccacccagctgcaagccagtcatccaatcacttgccgttccttgaacaaaccaagccctgctggctttgcacaagggctcatccctgcagaagacccttcctctgctccttcattacgcttaagctggaagagagacaacttccttccctccagcacgccagagagcttttccataacatgaagcaaagcctgcaggtgcaaaacttgtctttaggattcttaggaccaaagagtgaatatataaaccacataaggaaacacaagctacagttagcttttttccttaaattgtgtgaaaactgtgaaggaaaacaaatctgctactaatttttaacatattaattcacaaacaataaaattgcatattgtagttactcctgagcctctcatcactttgagtagtctaaccaggatctctgtaaccacagaaacatgtagctgtttctataattaaaaaacaccagaggtcacctcaaaagacaaccccagacccaattttattttggtgcacaacatgctatgcctccccctttccacactaacaatcagaaagattctccttggttattgccaagaaattagaaatgagatattgcatcatttgagttatttttacagactcaagttgttcagtgcatgaagaaaatgtataagaacagaagagaattatctcgatgttttctaagattcaaaaggaaacaggaaaactcaggtaatccacaatctttcaggccatctacacaatacacaccattaagcattgttaagtgcagtcttctacaaaagcaaatattagcccaagtaacacacatgcacggcagtggcaaaggagaagaacaaatatttgtagtgaggtttcaatgccagaaccagcccagagaaagaggaagaatggaagccagctaatgccttttgccctgccgggaatgcctgtttttcctaggtcctccatccagcttattactagtcgtctttcagaatacatctgtcgtaggtcatctcttatgagaaaccacactggaccctgcctagtttgaggagggctctgctggagtaccagggcactccatgtgttacactaagcacagccgttgctactgtgaagtgactgaagatttcctggttagctcccattctgacttggagtatcttcaggataggcactgtatcttgttcctccctcagtctcccatgcctagcaagttcttcccacattagggcccagcaaatttgaatgtctgcctcaggttccttttaaagcttttggcctcttaagctggtcctgcaagatcttaaaagaatatagcgtgatctgctcattaagtactacagtcaggacttgaaggcatcttctatctctgaagtccatggttccccgccataataatatcactattttctttacactgttttaaaagacaatgacacaatctagattgcaaataataaaatataggattactttcaaaaacttagaaaatacagataaacagaaagaaaaaaatcactcagaatcccatctctaactacaatcactattaacatcacagtacacacccttcaagatctttcctcacattaagtcattacatatagacatgtccaggttgggaccgggcttatgtgcaggaattgttctttacagggtcagtgccatgactgcagtattgctcaaaagagactattccttgttccagctaaaaaatttcaaaaatttgtgggttttttctttgttttacccctcaccaattgctttaaacaggacatgacttttcattttgtaccatgtattccgtacctttcttatatcctaaagtttttcaagctctcgatgataaaccaggccaatccacctcagtcttcacccaaacagctcccatctggagtcctcaatcctcctgctccaatgtaggctattgctcttcctgctgctgccagcaaatgtcctgaggcctcaacgccctgctctcctgggttggagcgactgctccagcgtcccctacctttctctttcttaaattattctgtcattgctgaaatccatcctcaaggaacattttttaaaagggtatattggagataaaatttctaatacttaaatatttgaaatgcctttttcctcctattgattgtttggttggccaaacaatagcatagcatagcaacctgtattttaaattactatataaattactatttaaaacaatagcatcgcaacctgtattttaaattatttttcccagaactttgaaagcgttgctccatatttttcttagcatttcatgatgctgataagaagtgtgatgctggtaattaagtcttctgttcccctctctctcatctcaggttttagagtgagttgggtttatgtgtgtaattgctagataaaagggaatgtgtatatttcactgtagtgggccgaataatgcgcctcctcctcacacccctcaaagatgtccatgtcctaattcccagcacctgtgagtttgctatcttacacagcaaaagagatttgaccggcataattaaggttaccgaccttgagatggcgagattagtttggattgcctgagtgcactcaatttaatcacacaaatccttgaaagtagacaactttcctgtctggatcaaacttgaaacagaaggaggagatttgaatcgtgagagggactggagctgtcactgccggctttgaagagaaaagactataaccatgagccaaaagtacaggcagtttctaaatgatagaattgccctcagctgatagtcagcaggaccacaggcaatttggatttacatattatctgcaagcaactgaattctgctagcaaccagaataagctggaaacggattctagagcctagaaaccctagatcctaggactagatcatagagtttccagaaaagaacacagtcctgatgaccctttgattttaatccagtgagactcgtaccagacttctcacctacagatcttaaattaataaatttgtgtgtgtctttaaatatgtgttgtttgaagccaccatgttcgtggtaatttgttacagcagcaatagaaaaccactttttaaaataaatgctgccaaaatttcatcccccaaagctaaatttatttatacttataccaacaggtgatgagaaaactcttcctcaaaaccttcactgacaagggatattttcaatatcttgatttttccaagctgatcctgagaaatatttcacttttgttttcatttgcaggccaggcctctaatttttttaacaaggttgagcatcctttatatatttgtttaacacattctgttttatttggaattacaccattttgtaaaagtcctatcctggctaacaaggtgaaaccccgtctctactaaaaatacaaaaaattagccgggcgcggtggcgggcgcctgtagtcccagctactggggaggctgaggcaggagaatgccgtgaacccgggaagcggagcttgcagtgagccgagattgcgccactgcagtccgcagtccggcctgggcgacagagggagactccgtctcaaaaaaaaaaaaaaaaagtccttagatttctaaaatttcaaactattaatagttatactatgactatgcatataaaaatatgtcctgtttggtatttgttaaacacttttaatttaatgatttatatctcccacactggaaattattttgcatagtaaacactgtggcagaatctgctagctgcctagctgaatatcaacactcccctccttaataagcacatcttgatctttttaacatcatattgctgcccagaataaaggactacatttcccaactttccttgcagctaggtttggccagtgagatataaacggaattaatgaaaagcttcttaaagttagctcccacagcttagaagggcctttccccacgtcaccctgacttcgcttctttttctcgtctggatttaggcttaaaggatgcagttacagcagccatctcgaaccatgaggttgccgtgcacatggaaaccttttagcggggggagtggtagctcagcctgttttcccagcactcttgagaggccaaggtgggaggatcgcttgagcccaggagtttgagatcagcctgggtaacatagtgagaccctctctacaaaaaataaaaatattacctggacgtggtgacttgtgcctgtagtcccagctacttaggagggggaggtgggaggatcgcttgagccaaggaggtcaagactacagtgagctatggtcacactactgcattccagcctaggcaagaaagcaaaaccctgtcttaaaaacaagaatgaaacaaaccatttggtagatgatagaatgggaaggtaagggcctggtgatcctaatgcctcactgaagtcaccaatccacctcaaaattttcttttatgtgagtgaaaaacttatgtcttttcaatcttctatcattttgtgatttttctattgtatgcagtcaaatccattcctaatacagaattctcacagtgatctgttatgtattttatctgctatcttttgatccctctctctttttattttccaggtgagtgccttgatttcatctttaaaactttttttaaaaaagttctgcaattataatttcattttctaagagttatttctttttcatagcatgtattttcttgttttgtgtatgcaatagcttttcaaatctcagaagtcactagttggaaagtctgtcctattttgaagtatacttctgttctctgaattctttcctttgatgtcacatttttcccgttggtttatcttgggttttccttttcatgttagagactttcatctgatgtttattgatccttggttactgctcacactaagaatgagacaataatggggtaaatttacattacatgccttatcacaagatacgcactgaggaaaacactgacttcagtggtcttcctgccaaaagtgcatgacctgaatttaatcatgaggaaacattagacaaactcaaactaagggacattctacaaaataattgacttgtcatctcaaatattaataccatgaagcacaaagactaggagattgggccccattaaaggagattaaagacataagacaactgaatgcaacatgatctagaaatttcctttcctaaaaaggactttttaaataatcagcaaaatctgaataaggtctatatttagataatagtattatatcagtattaatttcctgcatttgatattcttcctctaattatgcaagagaatgtttttaagaaataagcactggaatatctaagtataaaggggcatcatgtctacaactctgaaatggttccacaaaaataaattgcatatctatctattcatccatctatctctctatatatctatggagagaaaaggataaagtacatatgttaaaatgtcaatatttcagaaacttaggtatactatatatgggaattctttgtacttttcttccaacttttctgtaaatctaaaattatgccaaaatgaagccttttaaaaagaatatggcccatataaagattttctgggagctttgtgggcatagtcaggactggttaatgacaggcttcaatagtgtgtgtgtgtgtgtgtgtgtgtgtgtgtgtgcaggcatgaagccagctgtaactctgggaacctttaaatgccagacttaagaggtatttactctaagagtgctttcccttgccatctgcccaattttttcctgggcaatgtcttaagattatttaaaccctctaatttttggcttggggcaaatggctgcctgcaaatcctttcagtccaatttctcaaacccatttcccactctatctactacagcctttctgggtgtctgccaggacagtcagcttcatggtgctcccttggctatggctgtctctactcagcttcatcaattttaagaaaacttccagaaatgtattgcaatctcttgtctaccaattattccctcattctttttattgtgctgtttttgttttttttctttatatactttatttttattatttatataattttatttttgtttttattctttatatattttatttttgttcttattctttatataattttattcctaagcatgtgtttcatcagccatcttgaatcagaattctttagataatttaatgttaatttttatctgtaactggttattcattatttatgaacgcatacttttttttcttttttggtgtatctgataatccttcagcttttcaacattccatattgtcataatatggtatcactacggatcatattggattctcacccttggtactttttgtcatattattattcattgggccatttagtcaacatatataattctttcatgtgcattgtcttctttagcttcacctcatagatattaagtttgctaagcccaacgtcaagtacattatttattcctttcttttacctaaagtaaatatatacccagaagaataagcagtccaacacattacgtgctacctcttcttccccgagccatggatgattaggtcaggtatctgctccaaatgggcagccaatctgttggtttatcagagacctctgattggtatggcttgactagaacagatgatctgcattaatcagattccctccatcattattttaaactataaaatacagagattgttacgagtcagggttggacactggagtggcaaagtcagcttagtggtggaggaagccatttgcaagctgatgagtaagcaaatgaaattgatttttagagagatgaaagtggtatagttgtggaaaaagaagctgagattaagtgagagacaattaatattggttctaaacagctttctactttgtatgaggcccagtttcacacagttctgtgatatatctgtaacactgaaattaatcatcttttctaagctagtttgagtgagtttctaattctttccaaccaataaaaaaacctttcaacttttaattttatgattttaatttcctgtttttgtttttcaaaagggaaagaattctttattaacaaaactgtgcataaaaattaacatctatactaattattccacagtttttggttttttttttttttgagacagtcttgctctctcaccgaggctggagtgcagtggcacaatcttggctcactgcaacctccacttcccggattcaagtgcttttcctgcctcagcctccctgagtagctgggattacaggtgcatgccaccacacccagctaacttttgtatttttaggagagacaaggtttcaccatgttggccaggctggtctcaaactcctgacctcaggtgatccacccacctctttctcccaaagtgctaggattacaggtgtgagccaccacacctggcccattccacaaattaaagtgtcaaagaattagaattttttacaaatcctctgatagaatatggagtcttcttcactaatccttgactgtttttactgagtttaatcccatcactaaagtaaaagtttattttggggaaatttgtttcaagaatcaaggatcaggcacaattttccattgcaagctcgcctgtcagagttgctacaaaaaatggattagggaaatgccatgcgtcctccgtttccttcatttatccttcttcttctttctccagaagcaacaggagaaagacccaatgccttcaatgtgtttctgtagttgctattgtgaaattatgacctttatatgcattttggcctttgaagctagaatttcttcttgtttttacatcagatcaatcagatatattataggtttttaaaagaatatatagaattataaaaatatccaaccaggataaaattatttaaacacacttaaacaaatcttaattttgaaagagggttacacaataattttacaaaagtcctccaaagtgagttcccaaatgtagggaccatgtcttttaattcctttgtatgttccctccaaaatgaaaaaacaaaaaaagattcagagttatgcaactttcagctgtccaataaatgtggttgaatcgaatcacttcaattaccagaagaaaattatattaaacttccgtgccaagtttcaatttgaaaatacttttaaagcaatgtttggaaatgacattaaaatttttgagttgcaaaagtcggcaattaagaaaagtgctccaaaataagcacgtctcatctcctgtgaataagcagtttactttggcaatggcagcagcttgtcttgggtggattcataatatcccactccatagctgttaacttccaaaccagtgagagatttattttttattcaactatctaactgattgctaaagctaaaacaaatgtgttttcataacaacaattttttccactttaaaatagtttatgttcataaaagaaatttttgaaaagtatgacaaagttggaaaaagaaattatctagagttttattctccagctagatccacttttaatatattctttttattatttccttattgcagtccaaaaaatacacgaattgcttttttcataagataatctaatctgcatgaaatgttgagtaactgattatctaaattacaatgtaccacttgttcgtggattctcccagacttacttctgtgttctagattacagttgccctgctgagggaaacgctttggcctcaaccacaggatgttcaagtatatatatgttgaggaaagagagggaagcatccaaaaacagtgcttctcaaatttttctgcacttagtaatcatctggcaatcttgttaaaatgcagagttggcattttaacctagagtgtaggataattgatggaaatttttgccttaatacatctatctaccattaagcaattaccccaactctaacccatttctgggaatacataagagtatttttcatacctggaaagtttcccatagtctgagggtggagtaggatttatttattgcaatgcaagtgaaagtgttgagcaactatggtgagtccctctgcacaggaaaccttccaaggttcgcaaaatacttgttcatttcttctcccttggtagtaatacatatcatctctgggcacgtagcttcctagaataaagttggcatttcccagcttcctttgaagctggatgtggccatgttaccaagttgctgccaatgggatctaagcagaagcatgtgtacaagccatgttttaggatggcaattatatttaattaagatattttgtttgtccaattcaggttaagttacaacccaagagcagtcagctaaaatttcagttgaaagtttgcactccagaggtggcattaatgttctaattaaaaagcctatatcatagaagtgattgtttctgtcattcatatctgggtctttgctaacattctcagtgaatttcagaaatgggcttttaagggtgaataaaattaacaatctactaatgaatgctagataggaattgtcattggctaaattaatgatatttaaggtataaggttagtgaaaatattttagagacactctccacctttgcaggagtagaataaaagaatccagtgtgacctgtggcctatggtttgtacctttaggaaaaatgcccgtggcttaatctctaaatgatcctgggttcggtatttggttttaagggctttttagctccctgatgctgactacacagataagagattcctgcttctggaacgttgtcataactgccttggttcaatttttcatgtcaggtgagattagagattggaggaaggagagccaaggctaccttcaactgaaagaaaagactaaactattcttatgctttcttataattaaatgttttgttataaatgattgcttttgtggcagaatttgttctgtgacttgctttccatacagcctgatagcaaggttgaagaagcagctgatactttcatctcaaatctagtatattctgccaaagacaccctaagagttgtatgggaccaaatgggcttgtgtcagtccacagtacagaacaatggggtagaaaaagataggtctcctaaaatgctctggactgctctcctccagacaggttgttgtgtccatgttgtgtccaaattgaaaaataaatttccaatgtgtgccaacctttatcatcctatgttttctgttattcatagcagaacctatctgatagtcctgttggccccagtcaccatcacagggaaaacttcccatggaaaactttcatgatttaacctcccccttcctcaagcttgtcttgtcctcctctttagtttagggttctctcttgcccctccctccctctacttttcagatactctacattccccttcaatgtttccaatcagaaatatctactctcccagggaaggatcttctgtaacattgctgccttggtggggacttaatcacttaccattactatttcaaagaaaagagttttgttgttgttgttgttgttgttgttattgttgttgttcgtctttttgagatggagtctagcttcgtcacccaggctggagtgcagtggcgccatctcagctcactgcaacctccgcctcccgggttcaagcgatttttctgcctcagccacctgagtagctgggattacagatgcccgccaccacacaggctaatttttgtatttttattagagacagtgtttcaccatgttggtcaggcggtctcaaactcctgacctcaagtgatccacctgcctcagcctcccaaagtgctgggattacagacatgagccaccacgcctggccatcaaagaaaaaagtttctaatcctaattatttttccaatgacagatatatcagaagtcagatatttaaaccttagactctatatcttaccacatataactttaaaaataaaaatgatcagttgttcaggatcagatataatccaaagcccatataacacgatatagtatttccttattttttcaggtactttttaaaaaactcatcttttcacatgaaaaaatgctcatcatcactggtcatcagagaaatgcaaatcaaaaccacaatgagataccatctcacaccagttagaatggtgatcattaaaaagtcaggaaacaacaggtgctggagaggatgtggagaaatacgaacacttttacactgttggtgggactgtaaactagtttaaccattgtggaagtcagtgtggcgattcctcagggatctagaactagaaataccatttgacccagcaatccctttactgggtatatacccaaaggattataaatcatgctgctataaagacacatgcacacgtatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcaaactatcccaaggacaaaaaaacaaacactgcatgttctcactcataggtgggaattgaacaatgagaacacatggacacaggaaggggaacatcacacagcggggtctgttgtggggtggggggaggggggaggggggaggatagcattaggagatatacctaatgttaaatgacgagttaaagggtgcagcacaccaacatggcacatgtatacatatgtaactaacctgcacgttgtgcacatgtaccctaaaacttaaagtataataaaaaagaaaaaagagaaaagaaaaaaaatctcatcttttgtgttcatttcacaatttaaaaaaaaaaaaacagtttttcaagattacaaatgcctcaaaattacataatatttgagattacataacatggctttacccattagaatgccttttaggtctattaccattctttgtcattctcttcatacttacactccacttctccaaaaagtaaatagaaaaaggaactaaataaactaaataaaggatctaagacctctccaatatttgcatagatcagtaccataatttgaattcttcgcggatttctctttgtgtaaagttcagcctgtgatgaaagcaggagagtctgatgatttagcttatgctctagaggcagtctgagttcaaatcctgacactacccatgtgccctcaggcaaataacttaaccactttgtgcctcagtttctcacatgaaaatgggaataataacaatacctacctctcaaggttgtaagggttaaagaagatattaaagagcttagtatagtgcttggcatgaagtagcatttaataatattcagttattcaacaaataattattcaacgtgtgctttgagcgaactactgttaaacactgtagggaaatgaacactgaggcagactggcttcttagtcttaaggaatgtacaatccagtaagagaaataaaacatgcaaagtacataactagaataatagaaatggatatatgtgaagctattcagatacattatttattgcaatatattacagatggttgcaaatcatttgctattcctgctattgagtttaattctcctcactttgaatctggagcgagtcttagtactttgctttactaatagaatgtgacaagtgatcctctaggacttccagtgtgtctcttagaatgcttgctctaggggaaactaaccattatgtaagaactccaggtatctgggaccaccatgtatagggaagcccaagatatccccctgataaatctgcatagacatggcactaggcctagctattccagccgtcccaaccaagacatcagacatgtgagaagaagttgtctggcagcatcttggctacctctgtgaacatgaagtagagaagaagcaaggaatccaactaacagccagaaccaagggttcacacctatggtcccaggtgaactatcctagccaactaactagatatgacttaaaacaaggtagtcagcctgtctgtgctacagatgagttatcttaaatgagattatgtcagttgtcattcttatgtctctctgaatgctggaatgaagaaaatagtgtgagcagaatagttaacatagcaggcctgagcctgctatccttagaaaggcccacttacaagatcagcccttagctggcatctgggaacttggctggtaaaaagtttcctgcacacctttaaaaatttgcctaaataacaaaggtgactcactatggctatactgtttgtgtaaacagcatgtttatggtgaacacctccctgggaggggagcctggaattttggtatatggtaggaagagggttcctatttgacaagccttcaataaaagaaaccttggacaccaagtctcttctgagctggcccagtagaaagcactttgcatgtgttgccacaactcattgctgaaggaattaagccactccactatgaaagaacccttggaagcttgtgcctggttttctcctggttttgcctcatgtgccttttcccttttttgatttggctttctatcttttcatggtaataatatcagccataagtacaaatacatgctaaattatttgaatccttttaccaaatcattggaaatgaggggtggtcttgggaacccctgacacacagcattctaaaaattgtgagagaaaagttgggagaaatgagattgctcttctactttctttttacagaaggagatttctctcctacctttcccatgttcttcctcttttcttcttctttcccagaatatgcatgctggacttccttatttattccccaccaaagtccacagtggcctgtggacataaacataactctcagagacaacactcagttcctcagccctggaaaagctatgtaactgctatcttgcatacaaatacaagattggtttcgcctgtattttactttttatctagttgtgtttactttgtaggggtatagtatacagacctttatcttattgggctaaagatattgaaatttatttttaaagcatttacctaaagactaaactaatgataaaaagtgttttccttgcaattacatagcagccttcttatatttttggctaatctctaaaagaactgacactacagcaggaatgtatgtctaccgcataaaatctatgcagcatctcctgctatgtagtatatccttctcatatcatacaatatgcatgacttattttcagatgattttcctgataagctttgtgattatattttgacaggtctgagtatcgtttctttaatcttggagaatgacaagagcttaggcactatgacaagcaaagttcttggatttggctctaaaaattactgactgagcacagtatattttaagaattcatgcaagaagccagtaaactactgagaattgtgtgcaggaattctgttaagtacttaaaatcacgttgtagacatagagactgagagttaggagaccaagttgtgacctggtctatgttttaaagatatggccttgggaaataatttatcctaatgggacctctgttacaccagctgtaaaatgacaggtttgagtgaatcatttttttccatctcaaacattctatggttcaatgataatagaaagtgtgggataagtgtcaaatgagaggatacaagtgtatttcataggaggaagaagtccccagaggctgaaatgagagactttagttggccaaacagagagagatacttctggggaaaggagcttgagtgaaggtaaagagacacagtgcactttgtgggatcttagtgaaatgtcaatgtgcaataataatgatattaataatagttaacctttatggagcactcactaaggtaatatgtgttatctcatttaatttccacaccaatcctaggtattattattattcccattttacagaagagaaaacaggcacagaaagattcagaatttgcatgaggtcaaatagcaagtggtagaatccacatgtgaacctaggcaatctgatactccagagagtaacttctaattactgctgtggcagcaatgcatgtaagtcagaaataaaatgctccatagaagcactatagttttcgtgaatttgactggaaaactagcagttttgataggctgtcatcaagaagaataatgatagttactatttatgtagtgccaattgtgtgcttttcatacattagttctaaacctcacagatgtttttgctttaaatgaccattttacggataagaaatctgggctcagcacatgcaacttgtacaaggtcaaagtttgtaggtagaaagctgggattcagctctgagtttgccttatttcaaagaccttccttaacccactgtgccacgctagattcttggctagagagaagaaactattttcaaatattaaaaacagctgtatattactgtaggctttcatttatatgaaattctagaacagaaaaaactagtcaatagtgacatgaatcagatctctggtttcttggagtgggagaaatgaggggattgcctgcaaaggaacacaaaggaactttttggaatgacggaaagatttcatatcttgattatggtggtgattacatttacatcatatctgtcaaactcactgaattgtacacttaagataggtgcattttatcatatgcatattgtatctccatatagttgatttttgagaagcccagctgaatctagtgtttggtctttgacagaggctggggccactggcataatgtgtctttttatatgcatgggaccatagtgatggatataaaaccctagcttttagcaaccattccaaacaccttctatactactttcctgtattgcagaggctgaaaagctcaaaattagatttctctgactccttcgtagctaactttctgattgtaagtgacatacttccaattaaatagctttgagtgagactagggccacctgcctgctatgatgtttgtcgctgcttggtaagcaggaccatgcaggcgataggtttttctgcaatagcattccaatatccaatgcccagctttatgagtgttatgagttagtagccgcaaggatgacagtggcttctccatcctcagattgcaactatagcagtgtgttcaagaatccaaaagtttccatggcatactcctgatttcacacatttaggactgggacagaagatacagctcccctagcaaatcagcttgatggttatctcctgggagttatttctggaggctcagtttagagactgctcttccagctctccaatgatttgacaagcacatagttacccttattacatctctttctatatgaaattgctggagtgatttctgtttctctggaactatacactgacatcaccatgaaaattggtatgtttttcttcagtcaaaattataactaaaatgattactagcatcatcagattaacagcaatgttttcagggtactgactttctgctaggataaatgcagtaagatgcaaacagagcacacctttattctttctcccatgctacttaaactgtatgggtagattgtcccctactgcatgaatgaaatgaggcagctctcagatcataaaatcagtcactctcagatcatcaaaagttctccaattcatgtcagtccccaaaatgatctcattttagttagtaaaatgtccgatctggggttaatattacataacccaatgcgcttcttgtccacttacatacacccccagcttgagattccttggggctggaggaggacatggttggcttttgctcaatttctctgtaagatgcctctccatttcccttctctttcctcttccccttctatttctcatatttttctctcccgcttgggatcctctcatgtgggaatacaactgggaagaggtaaaactgggaaaggggaagagcctctaaactggtctggatgtcatctggcatcgagccctcttagtatggcagattctcagtgctgactcttgctctgctggggtgctggcggagcttcctcagagaaccttcattgcagcctttccaccgcagcttcttactaagctggccagtgttgaatctctctcagtttctgtatctgacggtatactccaacttcttttagccaagatccagtgtggcaggaagacccctcacacaagtccttttgaaatgactccaggctagcttcatccctccagcccactgggcacacaggaaattcctcacttcattgttctgctgtcagtggcagagcatctggacccctgcggccatcaggcaggcaactccaaacatagcctcccacatttaatcttcacaggtgtgagtcaaacatcaggtcctacttcccctcaagccctcagaagggttcctgtcacctgacctgaggtgaggaggaagcattggagcaggaagaaaaattctctctaagaaacaatttccctctactggccttatcagccttgattcctttttcagtagagctgggtggttgcatataccagcccaaatagttttatactctctaagcatgtcttgcatagttagtctagcaactcactttagaatgtgaatattttggaattaattattttgtttttgttctttgaggccatggccaaaattgaaacagaaggagctctactctaatatcatgttactcatatattatgtaatgatctcaacaaccctataaaataaaaatcaatgaccctattttagaaacaaaggttcagatggcagcaaatgggattccaacacagatgagtcggccgctaagtcctttgccgttaaccatcatgtttatacgattgatatcacaaatactgatgattgtcgtgggttgaattatgtaccccaaaatttatacattgaagtcctgacccctaatacttcagaatgtgaccttacttggaaatagggttattgcagatgtaatttgctaagttacaatgatgttgtaatggagtagggtgggcccctaatccaatgtgaccagtgtccttacaaaaaggaaaatatctggacacagacacacagggagaaagccacgtgaagactgagttatgctgccacaaaccaaggaacgaccagaagctaggagagaggctcagggtagatcctttccttgtgccttctgagggataatggccctgcagacaccttgatctcatacttcaagcctccagcttgggagacaatacatttctgctttacaagccactttctgttggtactttgttaaggcagccctagaaaaccaataaaactactctgtgacagccatagaaatatgatggagatttcatggttgaaatctgcctgtgtgagggagcacctgagctctgagggaagaaaaggtactggagcagccgaagtagggcctgctattgtccatgttcaatgacaacactgggttggtcactaaaaactttggataggctgtgaagtagaaagcttctaaattaattctacttcctttataacagagaaagattacttggaaaaacttgagaaagtttgccttgaaaaacttttaagaaaagaaatctcaaactagaattttgcataattgtttctgagaaggcctaaagaaatttgaaagtggcccaaacaggatattatacctgtatctgaatgtacagaactaggggtaaatgaaaggacaatacagtacaagcttatatttaatatttaatgtcttgctggctttgagaacaggagcgctgagatattggaataagtgtaacggaattctcttatacatccatgggacgtccaaatgcataaataattataaagattttcaaattgtaattcatgcagaatgtgaagacacatctgcatgttctgatcaagatatgcacacacacgttattgttttagagattttagattcaatcaatttccaaaaatattggctcaagtaacacagatatgcaattaaatattaatgcaaatatccaaaacatctcagttgcttatcacaataaatatttattttttgctcacatcacaatccagggtgggtcagatggcccttctatagtttgtaactatgccatctagaacatttgacctccaccgcaggggaagaaagggatagaataaggcactctggctctcaatcgcctcagtccagaagagacataacactacttctgttcatagttcactggccagaacaagtcacatggcccccaacctaactgcaactgagtaatatagaaaaacagctggaaaattttggaaatgctaattgtcttttccataaaaacaatacagtaatgcaaagggaataagtgtgtaaaacacattaactcaaataataagatgtttgttagacgatactccagtgagaatctgatctcattaatcttaacaaggggacattctggtgcctttctatctatgtgaaaattattatagtatggctcaattactaaaattaaatgctgctcaagagatccctatttcttctggaaattcccaaagtagtggctcatatgtgacctccccacaaaaaagctaaactgttccacatacaaaacaaaaaggaactcaagagtttccagggcagcctggaagcaaggagatagcagtaagagaatgccaggacttggaagtgaagtaaaaagatggaggagaggttctcaccagagggcagggggcccagtcagatggcagcagggaggagcccttgagagaagggtggacagcgatacatcccccatgtcaagacagtgatgtctaatgttcaagtttaaatcattgtcaattctttcatgagctttcgtactgtctgttagtttaaacaatacaaaaagtctactatccctgagtaagagtctgaccttcagggtcagggaagtttggagtagctgcagagactttagtcctacattctcctgggtaaggccatcatctggtcccacattctacaaaaagtccacttcccagaccttgtgtcccaattttgtcttcaaaaaatattgtcgttgtgaaatcatccctgtggaaaaactggaaagaaagatttttctgtgctgcagggagggccccatagagagcagatgacagcacagatttgaaagtagaaccaggcagcatagcttttgccaacagtgttcaacagaaagaaaagaaagatctatatttttattgtattacatttgcataagtaaaccctagagggatatcaaagaagctaatcaagtaagtacttagggtggggcgaggtgggtgataaggcagatgagggcagaggtgggagtgataatttttactatgcatacttttatattatttgatttttgaactatgtgaatatattatatattcaaaacgttgaaagaaattgaaaaagaaaaaagtcttccaagcatcacagattttgttcaagctgttttgggagaacaaaggagtaggacagaatccatcaagagggaagcaacatagacagaggacagtagtcaaagaaagaattacaatgtcaagataagcaggaaatgtgaacatgagggaatcaagggaactaggagtccctgactcaaatcccccttccttgaagttccagaaatacttagggggagaggcttaggatgaggaggaggatgttgggctttccagagaatgtggaataggagctggagactttgcaactttgaatattagaagaaagggtggccccagaaggatggtgtgacttgaggacatccaggtggcagatacttagattatattagcatggcatccaacgcccttgacaatttgatctgaccccttactgaccctcacttctttcctgcagcacttttctcattaaggaccagtccaggctaagtgttggggacacaggatgaatgcaagattaaggagcacccagtctgattgataaaagctgatttaaaaacaagatgttacacatgctctactagtaaagtgtacagtttcagtagggactcaagtgcaaagtggacaattgtgtgttccagggcttcattcacttgtcaggcactctagccagggtgatgaaaatagccaggaattggctgggcttctctcttttcaccaaatctctcatcatcccataatctagccctagcttcagtacatggaggctggatcccaagagtctaaagaaatctgtaagccctcttaaggtataggccagcaagtcacattgcatcattttcaccacattctattggtgaaagcaagtcatggggctagtccaaattcagtgtagaggaaacagatactacctcttgatgggaagattagaaaagtcacatcgcaaaagggcaaattgtatgacaaggattatggaggctgtcttgagaaatgaactaccttagtggcaaagcactaatttgagatatctacaactcaattacagactctcacttaaccactcattaaagacttgttctctaaatgtagtgaacttagattgataacccaatatctggactgccattctaagtatgggtatcttccttacgatacccatacacttatggccaccactagactttaacacccgaagagtaagactctatcttaatcatcctctacattcaggattgaatgtgatacctggcacttagtaacaccataaagtattcactaattacatttgttgaattaataaataataaaattaggtatttattgggcactctcttataccagagactattctaaatacttcagatgttgtatttggctgttctcatgctgctaataaagacatacccaaggctgggtaatttatacagaaaagagctttaattgactcacagtttcacatggctggggaggcctcaggaaacttagaatcatggcagaaggggaagcaaacatgtcattcttcacatggcagcaggagagataagtgcagcaaaaggggaaaagcaccttataaaaccatcagatcttgtgagaactcactcactatcatgagaacagcagggagataaccaccctcatgattcaattacctcctaccgggtccctcccatgacacatggggattatggaaactacaattcaagatgagatttgggtagggacaaagccaaaccatatcagatgttttgacttatttaagtagtacaactctggctataatttgcctaagattatataccttgtgtgcagtggcccggcatatagatctcctttatctggctccagagcctgtgccctgaaggctttgctgccttagcaaaagagtaaacaactatagtgaagacaggattgaaaattgcagaaataatggacttggaaaaggacaattgtccaaggcatgaatcacttagaagcattttagtatactggttaagagtgtagtctcttttagtttcaatttcagcgctgccaaatactatcttgggtgggatgctgtctgagtctgttttctcatctgaaaaataagtctaagaatagtgcttatctcatagggctgtggtgaggctcaaatgagatagggcaagtaaagtgtttctcttagttcttcaaacataatgaatgctcagtgagtatttaccattaatcacacagacaagcaattaaaaaatgaaatggcaaaacagtgcttaaaagtaaaaattggagtcagatgtaagtcgtttacaccgtgcatgacaaaattcccttcagaagtgtttattttttaatacaaagaaacctaaattggaaaaagaaaaacaattaaaacccttcattagaaagtcaaaagaactctgaacattgagcaactttctctttatcaacaatgttttgctaaccttttgaagaggaagattacatcacaaaggttttaagggctactacaggaagaaaataaaggctagctataataaaatcattaagcattataaatctcaagagtcaagaagactatcccatgagcaaaacacagaaaatcactgaactctataagaaaggaaaagaaagaaaattccagcatgctaaaaagctaataccagctttcaaattaaggttcaagggcactataaagaaatcaatatgtaaacaccaagtgatgaaagtcatgaaacctatcgacacaagttttattaaaaggaaaccatgctagataagttgaataagactatgatcgatatctgatgagagaaaagtcacagatatgatcactagggttgtcaaataacgttttttggcacatacaggaaacctttattagaaaattagcaaataacttctaaagaaataaaaaatgatgcatcttaaattacatttcagtcatcatccctcaagctactgtggcttccccttctcctatgcctttcccttcgtccctccctcaggagagtaaaggaagtgggaaggagaagaatttgagtggcagcagtggtggtgaggaggagatgggtgcaaacttctgaggctattgctttcttgtttctataacatataacaacaaccaaaaaaggcttgttttccatgtagatattggacactttgttttggctttaaattataaataccaattgaagtagaagattataaaactaggtaggttttccaaaagaggacttttctaaaagaactggctttataaggctctataagactaaagactatcaggtgtttacggtgttcctttttcacttcgcatgttccttatgcagctctgtagactgtaaatgatgcagcactatgagcactttgtggaaaagaggcataagaggccatatttattttaggtataggaagcgtaagagcatgttttaaaagggaagataatatacaaggctacttgactttcattgactaaatgatgggattcatttaatcatgcattcagcaaatatttatgaaatgtaccctatgtgccaggcactattctagacactggggagacagcaataaacatgatgaagttcccactgtcttgtgccttgcattctagtggagggaaacagacaataagcaaaaagacttataaaaagttattgggccctatgaagaaagataattcagggtaaagaaaggagggaagaggttacgaatctctttaggtaagatattcagggaaggcctcctggggagcaaagacctgaatacagtgagagagtcttgcaggtatctgaggagagaacacccaggatccaggcagaggacataccaagtagaaaggtcatgaggcagggtttgtgatctgtatactcacatgggtccccattctcagaaggactctgtgctttcttcaatgctcagcagtcactgtcttaaaattcttagtaatttttgagcaagaggccccaggtcattttgcactgggtcccaaatattatgtagccagtcatgtcgtgaaatgggagtggtcttagcatgtttgaggaatagcacagaaggagcagggatggagatgagtgatcaggtgaggagtaggaacgtaggagatgcaatgagagaggtagaagaggagggagcaattaggacactgcaataatactggtaattaatgagctgttacaatctcagatggtcatcatggtgcttgataagatagtcataagatatgtttcctgataaatagatcactggtatcagatccacaaattccttgtcgttcattataaattgcagtactattggtacaacactgtatagtcatgtgctgcataacaatgtttccctcaaggatggaccacatacccttgggtggtcccagaaaatcataattgagctgcaatattcctatcacctagtcacgttgttgatgttgcagccatcataatgttatactgcaacacattacattttctgtgtttacatacgcaaatacttaacattgggctacaatggcatgcagtattcagtacagtaatatgctatacaggtttgtagcttaagagcaataagctattaccattcaccccacgtgtgtactaggctatgtcgtctagattcgtgtaagtacactccatgatgtttatacaacgatgaaatcacctaacgacgcatttctcagaatgtatccccatcattaagcaatgcatggctgtattcaggatcaaataattgaatgaagcccaagcccttcatttctaggaaacaactaatttggtatctattactagagaaactgctaaatagcagtagtgaacaaaggatttcctgggtgctgacacccagtgcctagctctctcttttaacactctttacaggtattaaataaaaatcatagcaggtcattgttttgggctaaactcctgcactagggtccaatagaccagaccaaaaatcaaaagggagtcaactgtgctaaagttgcacactaccaaaacaaaactagattgttatgtgactttgagaggaatcaggatagagagatgacagccatctgtccaaacaggtcagttttaatcttaacaggcatgatagtgacattccctctgtttttgtttgtttgtttgtttgattattgtactttaagttctagggtacatgtgtacaatatatgtataaatgtgccatgttggtatgctgcacccattaactcgtcatttatattaggtatttctcctaatgctatccctcccccatccctccaccccacaacaggcctcggtgtgtgatgttccctgccctgtgtccgagtgttctcattgttcaattcctacctatgagtgagaacatgcggtgtttggttttctgtccttgcgatagtttgctcagagtgatggtttccagctttatccatgtccctacaaaggacatgaactcatcctttttatggctgcatggtattccacggtgtatatgtgccacattttcttaatccagtctatcattgttggacatttgggttggttccaagtctttgctattgtgaatagtgctgcaataaacatacatgtgctggagtctttatagtagcatgatttataatcctttgggtatatacccagtaatgggatggctgggtcaaatggtatttccagttctagatccttgagcaattgccacactgacttccacaatggttgaactagtttacacttccaccagcagtgtaagagccttccgatttctccacatcctctccagcacctgttgtttcctgactttttaatgattgccattctaactggtgtgagatggtagcacattgtggttttgatttgcatttctctgatggccagtgatgatgagcattttttcatgtgtctgttggctgcatagatgttttcttttgaaaagtgtctgttaatatcctttgcttacttttcgatggggttgtttgatttttttcttgtacatttgtttaagttctttgtagattctggatattagccctttgtcagatgggtagattgcaaacattttctcccattctgtaggttgcctgttcactctgatggtagtttctttcactgtgcagaagctcttgagtttaattagatcccatttgtctattttgacttttgttgccattgcttttggtgttttagtcatgaagtccttgcccatgcctatggcctgaatggtattgcctaggttttcttctagggtttttctggttttaggtctaacatttaagtccttaatccatcttgaattaatttttgtataaggtgtaaggaagggatccagtttcagctttctacatatggctagccagttttcccagcatcatttattaaatagagaatcctttccccatttcttgtttttgtcaggtttgtcaaagatcagatagttgtagatgtgtgatgttatttctgaggcctctgttctgttcccttggtctatatctctgttgtggtaccagtaccatgatgttttcgttaatgtagccttgcagtatagtttgaagtcaggtagtgtgatgcctctagctttgttcttttggcttaggattgtcttggcgatgcgggctcttttttggttccatatgaactttaaagttttttccaattctgtgaagaaagtcattggtaggcttgatggggatggcattgaatctataaattacattggacagcacatccattttcacgatattgattcttcctatccatgagcatggaatgttcttccatttgtttgtgtcttcttttatattgctgaggagtggtttctagttctccttgaagaggtccttcacatcccttgtaagttggattcctaggtattttattctctttgaagcaattgtgaatgggagttcactcatgatttagctctctgtttgtctgttattggtgtataggaatgcttgtgatttttgcacattgattttgtatcctgagactttgctgaagttgcttatcagcttaaggagattttgggctgagagaatgggggtttctaaatatacaatcatgtcatttgcaaacagggacaatttgacttcctcttttcctaattgaataccctttttttctttctcttgcctgattgccctggccagaacttccaacactatgttgaataggagtggtgagagaggacatccctgtcttgtgccaattttcaaagggaatgcttccagtttttgcccattcagtgtgatattggctgtgggtttgtcataaatatctcttattattttgagatatgttccatcaatacctagtttattgagagtttttttagcatgaagggctgttgaattttgtcgaaggccttttctgcatctattgagataatcatgtggtttttgtctttggttctgtttatgtgatggattacgtttattaatttgcatatgttgaaccaggcttgcatcccagggatgaagccaacttgatcttggtggataagctttttgatgtgctgctggattcagtttgtcagtattttattgaggattttcacatcgatgttcatcagggatattggtctaaaattctctttctttgttgtgtctctgccaggctttggtatcaggatgatgctggcctcataaaatgagttagggaggattccctctgtttctattgattggaatagtttcagctcctttttgtacctctggtagaattcggcagtgaatccatctggtcctggacttgttttggttcataggctattaattattgcctcaatttcagagcctgttattggtctattcagagattcaacttcttcctggtttagtcttgggagggtgtatgtgtccaggaatttatccatttcttctagattttctagtttatttgtgtagaggtgtttataatattctctgatggtagtttctatttctgtgagatcagtggtgatatccccattatcactttttattgcctctatttgattcttctctcttctttattagtcttgctagtggtctattaattttgttgatcttttcaaaaaaccagctcctggattgattgatttttttgaggagttttttctctctctatctccttcagttctgctctgatcttacctattttttgacttctgctagcttttgaatttgtttgctcttgcttctctagttcttttaactgtgatgttagggtgtcaattttagatctttcctgctttctcttatgggcatttagtcctataaatttccctctacacactgctttaaatgtgtcccagacattctggtacgttgtgtcttttttctcattggtttcaaagaacatctttatctctgccttcatttcattatttacccagtagtcattcaggagcaggttgttcagtttccatgtagttgtgcggttttgagtgagtttcttaatcctgagttctaatttcattgcactgtggtctgagagacagtttgttgtgacttctgttcttttacatttgctgaggagtgctttacttccaactatgtggtaagttttggaataagtgtgatgtggtgctgagaagaatgtatattctgttgatttggggtggagagttctgtagatgtctattaggtccacttggtgcagagctgagttcaagtcctggatatccctgttaaccttctgtctcattgatctgtctaatattaacagtggggtgttaaagtctgctattattattgtgtgggcatctaagtctctttgtaggtctctaaggacttgctttatgaatctgggtgctcctgtattgggtgcatatatatttaggatagttagctcttcttgttgaattgatccctttaccattatgtaatggccttctttgtctctttggatctttgttggtttaaagtctgttttatcggaaactaggattgcaacccctgcttttttttttttttttttttttttgctttctttttgcttggtagatctttctccatccctttattttcagcctatgtgtgtctctgcatgtgagatgggtctccagaatacagcacgctgatgggtcttgactctttatctaatttgtcagtctgtgtcttttaattggagaatttagcccatttacatttaaggttaatattgttatgtgtgaatttgatcctgtcattatgatgttagctggttattttacccattagttgatgcagtttcttcctagcattgatggtctttacaactgggcttttttgcagtggctggtactggttgttcctttccatgtttagtgcttccttcaggagctcttgtaaggaggcctagtgatgacaaaatctctcagcatttgcttgtgtgtaaaggattttatttctccttcacttatgaagcttagtttggctggatatgaaattctggattgaaaatagttttctttaagaatgtagaatattgtcccccactctcttttggcttgtagggttgctgccaagagatctgctgttagtctgatgggcttccctttgtgggtaacctgacctttctctctggctgtctttaacattttttccttcatttcaaccttggtgaatctgacaattatgtgtcttggggttgctcttctcaagaagtatctttgtgatgttctctgtatttcctgtatttgaatattggcctgccttgctaggttggagaagttctcctggataatatcctgaaaagtgttttccagcatggttccattctccctgtcactttcaggtacaccaatcaaacatagatttggtcttttcacatagtcccatatttcttggaggcttttttcatttctttttacttgtttttctctaaacttctcttctcacttcatttcattaatttgatctcaatcactgataccctttcatccacttgatcaaatcaactactgaagcttatgcctacatcacatagttctcgtgccattgttttcagctccatcaggtcatttaaggacttctccatactgtttattctagttagccatttgtctaatcttttttcaaggtttttagcttccttgcaatgggttcaagcatcctcctttagcttggagaagtttgttattaccgaccttctgaagcttaattctgtaaattcgtcaaagtcattctccatccagctttgttccattgctggtgaggagctgcgatcctttggaggaaaagaggtgctctggtttttagaattttcagcttttctgctctggattctccccatctttgtggttttatctacctttggtctttgatgatggtgacctacaaatggggtttcggtgcagatgtcctttttgttgatgttgatgctattcctttctgtttgttagttttccttctaacagtcacgtccctcagctgcacgtctgttggagtatgctggaggtccactccagaccctgtttgcctgggtatcatcagcagaggccacagaacagcaatattgcaggacagcaaatattgctgcctgatccttcctctggaagctttgtctgtgaggggcacttggctgtatgaggtgtcagtcagcccttactgggaggtgtctcccagttaggctatacagggttcagggacccacttgaggatgcagtctgtccattctcagagctcaaacactgtgctgagagaagcactgctctcttcagagctgtcagacagggacgtttaagtctgcagaagtttctgctgtctttttttcagctatgccctgccccagaggtggagtctacagaggcaggtaggccttgttgagctgcagtgggctccacccagttcgagctttccagctgctttgtttacctattcaatcctcagcaatggtggctgcccctcccccagccaggctgcctccttgcagtttcatctcagactgctgtgctagcagtgagcaaggctctgtgggtgtgggacccactgaaccaggcacaggatataatctcctggtgtgccatttgctaagaccattggaaaagtgcagtatttgggtggcagtgtccaattttcccggtagagtctgtcacggcttcccttggctaggaaagggaaatcccccaaccccttgtgcttcccaggtgaggtgatgccccgctctgcttcggctcgcctctgtgggctgcacccactgtccaaccagtcccagtgagatgaaccaggtacctcagttggaaatgcagaaatcacccatcttctgcaacaatcatgccgggagttgcagactggagctgttcctattcagccatcttcaatgttttcctgacgttccctctgttttaatcttcacaacaaaaagtcacctgcagccaggtgcggtggctcacacctgtaatcccagcactttggcaggctgaggcaggtggatcacgaggtcaggagatcgagaccatcctggctaacacggtgaaactccatctctactaaaaatacaaaaaaaattagctaggcgtgctggcaggcgcctgtagtcccagctacttgggaggctgaggcagcagaatggcgtgaacccaggaggcagagcttgcagtgagccaagatcgtgccactgctctccagcctgggtgacaaagccttggtctcaaaaaaaaaaaaagtcgcctgcagtaagctgatgtcagtcagttatatttctatttttctgtctccctattcctgtcttataataaaagtaactttaaaatgactgcattttgttctttgtttctgttttcttcatccctttctgtgtgtaaaaccaaacccttctgcacatctcagtggaacacttattttatggaacgaagtgtcgtcctattctagaattgcaaatgaagccagttaaaccaataaatatctcagttaagatctttatctaaattgattgtacttttttcttttgacatgagctaattgttttctgctgagaaggttttgcagtttgcattgtgggccattaaagatgctgcctatctgagctgctttacctgcctgaatggtaggctcaatggcaacaatgacaaatcatacacatttttatctttctttatcaaaagtctttcatttttcttttgtatcaactacattatcaactcttataggaaatgttttagctacatatatgaaagcaatcagtgactctgaacccaggacgtattaccattatccaaaagaaggctgtttgcttaaaaagttcctttgattaaaaatgtcttgtagcttgataacataagcccaaatcaccttaataaaattacattgctctcttactgatgcaggtagggtacctcaatgactttcctcattggcctggcctgtagctagtttacaattttacaaatgcttttctaagaacaactgacaggcaaaccacacatttaagtccatgctaataaccaattgtaagcatcttcctcaaccttatggtcaaatttacaaagcaatcgtattcttggcatcagtgggaaccagttggaaagatctttttgaggtacatcatgctggttcttttgagtaggaagaggctgggttgaccacatatatcatagaccaccacttccctcttctttggacctggagattggctgtggcagtgagtattctgagaactgttcctcatgggttctatgtcgtggataattactattgcgggcagcagtttacaccctcattctggttcacatggggcccacagaacctactggattctccatcaagcctgcactgagattctgcacaaactcctgttatcattgcaaagagtttatctcctctcctttaatcatattcagtattattttttagtccccttgggcatttggatcatccctggtgaaaactgagattctaatgagtagtacaattgtcattaagaatttcttataggaagtattcgaatttcattacagtatttggactgaagcagcattaatgtcagatgagtgccctcaccctgttatcctcagtctgatatgtaccagtgtgctctactctgccccaaagtcccatatgtggatttagtactacatatggctttaaataccatctattcactgatgactcctcagtttatgtttctagcataggcttctcttgtgaaccccatatttacaaattcatctacccacttgacatcttcaactgcatgtctaataggcatctcaacttaatgtgcctaaaacaaatttgtaatctttcctgaaatatgttcctttctaagttcccccatctcagtaataaataaaatctctccagttgtgtaggtcaaaagcttggaatcatctttgacgcctcctgctctcatataccccacatttgatctatcagcaaatgctgatgactgtgccctcaaaatatatccagaagtcaatgacttctcatcccttcctttggagccaacctagtccaagttatattaccttttgcgatagcctcccaattgatatcattgcttctgattttgccccaccacaaagagagtcagatcatgtcacccctcagctcaaaaccctccaatgtctcctcatctcactcagtgcaaagttgaagtcctttcacaggcctacaaggccctacatgattctcaggtacttcacctatttcaaatctcttcttccttcatgcatcttcagcctcacttatctcactgttctcccaaaatacaggatataggcccctctgggcctttgaacttgttactccctctgctataaatgcttgtccctgagatggtcacatgtttttctttgtaacctcttttaggtttttcttcaaatgtgcatttctcagtgaccaccctatttaacattacagctcctgcttgcagcactctctgcttttttttttttctccattgcacttatcactatctgacctcgtgattgtttatggtgttactctccccacccaccaaaatttaagctttataaaggaaggaatttttgttctcctgcttcaaaggtctaaccccagatcaaaagcctggcctatacagctaatcttctgtatctgtgggttccacatccatgaattctaccaaccatgattaaaaatattaaggaaaaagttcaaaataacagtacaataaaaataatgtaaatatagtattataattatttacatagcatttacattgcactaggtattacaagtaatatagagattatttaaaatatacaggaggatgtatgagggttacatgcaaatactatgccattttatataagggtcttgagcatctagaaattttggtatcctgcagtggttctagaaccaatccccctcaaatactgagaaaagactgtattaagtactcaagagatctgcattgcatgattaccacagctgtcagtagtctctggtgagcatgagtctccagtgtgtttgctggtgagtaggctagggtgtgacaggtccttaagacaagtggaattaaagaacctgacaagaaaacatacaactgctcagaattctcctcctggaatgcctgggaggtgaaggagaccagaatggcagcctgcctgatggggtgacatctctccactcccacaagcagcctcaggaacacagggctgggtaggcctccttatctggccatcacatggggtatgaagtaatactcactcacaagagttcttttcattgtacccagatcctgacacttcctgggcctcatgcgaatccccaggaccccaccccctctcctttagacccttgggcacaaaaagttctcccgtttctccgaaaacagaattccactacctttgagaaagctcccagaacttagaaaagccagtttatcctacatggagggtaaaaggctctggaattaagaaactctaaagaacaaagaccttcttttatcctatctcaatacctgtactgtgtgtgtgtgtgcgtgcgtgtatgtgcgcacatgggcgcaaatgcctaccattagtctcttacagtcaccagcccctcccttctgtagcaggtcaccaccttgctaatcctgttatttgaatactggaggaaattgaaacagtgctagaagtcaaaataaaatcattgaatccagtttttaaataaataataatgagggaagatttgtttttgaccaagggcctatgagatgatcaggaagccatgtttaatcaatcaaattatatagctatatcacaggagtatatggaggcttatgtgacaaatctagcaggttggcttcttttttaaatattttaaaattattttaactggcattttaaattttaaattggcattgtaaatttaaattttaaattttaaaataaaaattttaattttttcttagcagggatggggccttactttgttacccaggctggtcttgaactcctgggctcaagtgatcctcctgcctcagcctcccaaaggactggggttactggtatgagccactccttccagcctacatgttggtttcttaaacacaaaagttagttgaaggctacaagataaatgagctttttactaactaaagaatcaataatttctacttttattttttgagacagagtcttgctctgtcacccaagctggaatacagtggcacgatctctgctcactgcaacctctgcctcccgggttcaagtgattcttctgcctcagcctcctgagtagctgcaattacaggcgcatgccaccatgctgggctaatttttgtatttttagtagagatggggtttcaccatgttggtcaggctggtctcgaactcctgacctcatgatccacccaccttggcctcccaaagtgctgggattacaggtgtgagctaccatgcccagccaataatttctactttaaaaatatatatgctaattaaaatgctcattttactaaaatatatttttaattggcatttcttctgagagaaatatggagacagaagtgccataaagggcaaaatgaatggactgaattgcctcaatcagtaaaggtgaaacttggcccaccaaaaaacaaggtcatcaccatttacaggtgcctaatacaacttaattaaaggtaataaaacaaactaatagttacgataagtaataaagccggaaagtaagccaaggtcaagtacatggaaacaaatggttccaagaaaagcaattgcctgaggagtggtaaaaaacaaggtaacagagactcacctacataatggtgatatattagctagaaaatgataatctttgctattcaaatgtggctggaaaagaaatttgaaatcactgtcatgcatatttctgttgcaatctttgatctgcaataattcaaaggaaggaaagaaaggtataaacccatacaaatttaaatatagttttttaaggaactgtatttcctttgaattatatttaatagttcctgaaggaaggaaaggtgtaaatttaagcatattcaaatttaaatacataaaacataagttaaaactaacattgaggggtatttatgccacacatatccattatgctattaatatttcatcatcaacaaaccctgctgagatgggcattatcttatccattttactactaataaaattgcctcacagagagatcttgtaacagattcaagttacaaaaccagcaatcactagtatgggatttgaacccaggtctgtataactccaaaacccttgtttattctacttaatgacccagcctcttttctgatcctaattaaacaagtcctgataagtgaaatgcaggcaatgattgtggaagccagaatgcagggtagaacaggactgaactttgggctgcagagccaaaagccaaagatatttaatgacaaaaacaacaataattatatatatatacatatatacacatatatatacatgtatatatacatattttatatatgtatatatatgtgtgtgtgtgtatatatatatacacacatacagcatatgtatatacatacagtggctggtagccactgaaccagaatacaaagccaagaagacagtccaaaaatctgtcaaaaagatgttaaccagtgttccaagaggaagtgggccgtcactggacactctccctttcaaaaaaaaacccctgaaaaaaagggtggggtttttaacaccaagagaaatagagtggtataaacggaaaagccaatcacctgtaagtgggtgaaatttgacagtgacgaaagctattatataaatacccaagggaagtcaggatatgggataaatggggcatttatatctctttcatgagataatagtaatgataataatatcaacaaccataggagcaacagagctaacacttattgaaacttctcaacaactatgttaagcactttgcaaacattacataatttgatcacaatatccccccaaggtatatgttcttaaggaggcctgcagaggaatttggccccagaactctcaactgctacattatagattccaatttcctaaagaaataacctaccctcattagggaaattttctgcttttaacataatttttgtctcctcccctcccctcccccactacccccctcacttcctctcccctcccctacacttcccttcccatctttttaaagagacggtctcactctgttgcccaggctggagtgcagtggtgtggtctggctaattttttgatttttaacttttttatagagaaagacctcactatgttacccagactggtctcaaactcctggccccaaacagtcctctcaccttggcctcccaaagggatggggttacaggtatgagccactgtacactatacctggcctgtatttcttttcttttctttctttttgagacagtcttgctgtgtcacccaggctggcgtgcaatggcatgatctcggctcactgcaacctccgcctcccgggttcaagcgactctcctgcctcagcctatcaagtagctgggattacaggcacctgccaccatgcctggctaatttttgtattttttagtaaagatggggtttcaccttgttggtcaggctcgtctcgcatgcctgaactcaggtgatccacccgcctaggcctcccaaagtgctgggattatacgcgtgagccaccgcgcctggccacctggcctctataatactctagtcttattatgcaaagatttattatttcaaaattcttttctttccctcaactatttaaaagtataagaactggctggacatggtgactctctcctcctctctcatattttcccacttcttcccccacaaagggaaaaccctatcagataacactgcctccaggtttaaacaggtaccaaggagatacaagtgatcatcttggcaagcttaaaatttatgtcaaccaaatataatgggaaaacataaattaaggacacataaaagctaaactatttataaatgacattgaatgaattgaaatcatgaaatgctcaggaaaataaaatataaggtaatattaaaatttacattttcattgatataaaattcattttaaagtttgtgtgtatgtgatttagttctatatttattgaaaatgaaggatgattatgatatatttagagaaaaagactgcaaaagaatatgaccatatgattctatttttgttttaaacatgagtgtgcatttgttcaaagaataaaaatgtcttaaaaggtaacaacaaaaatatgtataacatagtagttatctctgagcgacaggattataaataaagatttttttctaacttttccagagtaaacataaattgtttttgtaaattttaatacttaatgaaacaaatcatggcctggcactcaagaaacattttactctgagatagggagcaggatttatttattcgggggccagagaggggagtgagtaacaatacttaacggttatattttgctggttaccaagttttgtttttctgtttgtttgtttttgcgatctttttgaaatggagtctcgctctgttgtccaggctggagtgcagtggcacgacctcagctcactgcaatatctgcctcccaggttcaagcaattctcatgcctcagcctcccaagtaggtggaattacaggtgtgtgccaccatgcctggctaatttttgtatttctagtagagatggagtttcaccatgttagccaggctgcttttgaactcctgacctcaagtgacccacctatcttggcctcccaaagtgctaggattacaggtgtgagccaccgagctcagtcagccagtgaccaaatttttaaagagatcctcactaagcatcagaaaattctggatccattttctggctctgccatgggccatctgggcatgttggacaagtcacgctgagacacagtttacctatctaaaatgtgaaggtgtaaatgtacttaatctagaatttctttcccagaactaatattcattgacttcacattcctagttctgtggtaaccagtaacatggtgatatggtttggctgtgtctcagatggagataaggaacttgtgaacctctgcctagatttcagaagatatatggaaatgcctggatgcccaggcaaaagttttctgcaaaggcggggccctcatggagaacctctgctagggcagtgcagaagagaaatgtggggttggagcccccacacagagtccctactggggaactgcctagtggagcaatgagaagaggaccattgtcttccagaccccagaatggtagatctacccaacagcttgcactgtgcacctggaaaagccacagaaactcaatgccagaccgtgaaagcagccaggagggaggctgtaccctgcaaagccacaggagtggagctgcccaagaccatgggaacctaccttttgcatcagcatgacctggatgtgagagatgaagtcaaaggagatcattttggggctttaaaatttgactgccctactggatttcagacttgcgtgggccctgtaaccactttgttttggccaatatctcccagttggaatggctgtatttactcaatacctgtacctccactgcatctaggaagtaactagtttgcttttgattttacaggcttacaagcagaagggacttgccttatctcagatgagactttggactgtggacttttgggtcaatgctgaaacaagctaagactttgggggactgttggaaggcatgattggtgttgaaatgtgaggacatgagatttggaggggccaggggcagaatgacatggtttggctgtgtccccacccaaatctcaacttgaattgtacctcccagaattcctgtgtgttgtgggagggacccaaaaggaggtagttgaatcacagaggccagtctttcccgtgctattctcgtgatactgaataagtctcatgagatctaatgggtttatcagaggcttccgcttttgactcttcctcattttctcttgctgctgccatgtaagaagtgccttcctcctcccgccatgattttgaggcctccctagccatgtggaactgtaagtccacctaaatttctttttcttcccagtctcagggaagcagtgtgaaaatggactaatacacatgggtagatcttttcttttccttcccaggtattaattaatttattaattagtttattcctccatccatgcattcatacatctatctctttgatcgaataatatttattggcaagctattacgtgtctagaacttagctgaagcatttcctgtgattttttggttgaagcttgttttctctgtatatttcttagggaataatattcattcagttcttgtatgctcacaattgctttatttttccgtagcttttatattttaacgtaagtttgggtatgcataaaaatttctttttttttttttttttgagacagagtctcgcactgttgcctggtctggagtgcaatggcacgatctcagcttactgcaacctccgcctcccgggttcatgctattctcctgcctcagcctccctagtagctgggattacaggcacgcaccaccacacctggctaatttttgtatttttagtagagatgggttttcactatgttggccagactgatctcaaactcctgacctcgtgatctgccctcccttggcctcccaaagtgttgggattacaggcatgagccactgcacccagcctacttttttctttttaataaatatattgctccatggacttatgaaatctgatgtaaatatgattttatttatgattttatttttgatgacttggtctttatgcctgaatgttcaaagagtttttttattttccagttatactggaatatgtcttggtattggccattctggctccacttttccaaggttaatggtgtgctctttcaaaataggtgttcagtttttttataattttaagaacgtcttgttgtattatggatttttgtatttcctttgttccgttgctttcattttccttccaacataagttacacttatgttggattttcgtttcctgtcttctatatttatcatttttctctcggatcctttctatttctttctttctgttttcttttcctcctttgtaaattgtatttcccaagtcttgtttctgaaaatagtgaactaggttgttttagaacaatttgaaggtattgaaaaaccactcatgtagtgaggacttatggggccaggatccagaagaaaagggaaccccagagagctgagcctgacatgtgccattgcttttagtcttgaggcatttgcctatttgagaacaatggctgaaaggatgagaatttgaacaaaactttcaatagactcaaggagttgaggggaaaattggagttctgagctgcacaaggaggatgagatctaaaataaaacaaaaaccgaaacacgaaaacactaggctttcaattgggaccacaagagaccacattttatgaaaaaggataaattggaaatggaccagtgactcaactccagttctgaattatatcagtccccaattcatgtttagccatctcgtctctgagtttcctggttctaatatatgctgttactttatagtttccattattttcttaatttgcttccattaattttgttatattatttagttttcatttttttaaattatgtcttttctggtacatattaactacccattttttcattatttagtttattttctttataatagtgtacttgttttgtgttcgaccatctcctttctgttgcttttgtataaacaaaatcaggtgttctgtacttttaggaaatgcctcccttgaagggaaatgggatatgctatgatagcctttatagtttcagtgcttaagagattcctcccctattattatcacatagcagacagattaagatacacatgtagacgtggatggcctttgtgtcgtcacacccacttccagagatgtgccttctctggagacccacctgacctcccagtgtttgatctttttctctcaacaaacaacaaaggcattgtaaggtcgtcaaaatattggatttactctcagagtttctatcctgctcaatttgaattttcttcacggaagtgttttcctcaggaaagatattttattggctatttctgagttatttgagtacataagccacccagtaccttctgatcttcccattttctcttagtgtgtggctgagatatttttattctactcagccataaattggagtcagaagccttctcctttttactgttattttcacaatatttacttgctgagaatcccactcaaggtaagaccttctctttttgagtatttgtggacaatttctgtattgcagtgttcgcagaaccttctaaactcttgttctctcctgtccactgcctctgcacagctgctaaaactaggcatgctctgtatgagttctactgctgttgtctgtggtttgggtggggcaaaacccactggcattctgaggctcatggggatgttttttcagttggctttctggaggatgtggtgagtagaacttatcttttgctattctagttggttcagtatgcttttaggaatggatttggggaaattaagaaactgtacaccataaccttgccctgacttgaagtcaagatgggtttatttttaaatcatgaatctatcaatcaaggcactgattccgtgttgctctactgtcttgactggcttctaagattatatttatttcaatatagtttctgttcaacttagttaggtgtctattagcttccctaaagatactcttttgaagtataatcaacctctatctcacagttgccaacattcttatattgctttcattttctttaccaccaaacttcaaatttcagtttcttcattagctagcctcagtaagggtatgtacatgtacattctgaacaattccttcaatcaatgagatctcttttcctttaaaatcagactttatttgagaactgtctttttgctaaaattgctgtattttcctcccaggcatgtttcaaattgttctttatatttcaggaacctcagtcagaatgcctcctttaatgttcagataacttgctaaatcaaaagtagtttcctcaagttgctgttgcattaacttagcagtacattcctttcacatgaaaattggtgtattcaagcctgttaccctcacatgaccacagctgaaatatttctctgatgaatacagtaaaattactatatccctctgaagttttgtagagtccactctagtctttagaacctgttagaatgtcccttcctttctgctaaagaaaagaaattaaatgggaggttagggtggggttaggaagagtggtctctagtctccagtgatctactgcagggctctatacctgactctgttctgtctaattcaatcagcattccagtattccattaacacctcctatgtgctgagttttatgttgaatagaaaggaaaaataagtctccaagaaggcattggagtttgatgtggactcaaattctgattctactgttcactagcacgtggcccgagtcagctgtttgatctctctgagtcttaatttccatatctgagtataacgattcctatataacatagctattgtaaacacttagtatgttttttcattatattttacatattatatacacatacatttttatatatttatatattatataaacatttgtataaatgtacaggtatatacacatgtatctatttatatatgtatgcatgtatatgtatatatacatatatatttcatctataattttataaaagctgtatcatgtaggactcatatacgcatatatgacatgtaataggtggtcaaataagtgtttgttccttttggataatgttatgacctacttgtaattagataacatttctttccctttttgcctacccaaacacacaaaatggctgttagacggcctattgattttcttaatgaattaaaattaactgtgttttaaggcattctatctcaaactgtgtgacatttgtgaaatatattgagacaacgagcagggttcttgatctgagggcggtcataaactattaaggggttcagggagtttttgaatcttctgaaattatatgcaaatagggcatgtttgtgacttatgcatttttggagtgaagcaattcattgctatcaccagatttttaatgggacttagaaacaggaaaaaaaagtcaagaatcatgaaggtgttataaaatcacagctgggactcaaatgattgtatgcttttggaggtcagaaactgtctatgtaattttctttttacaatgcttggcacagagccagaaagagttaagtacttaatttttatttttgaacgactgtaatattgaccaccttttctctactaggagggtcagatataaaaagtagaactaaaaaataaaaaggaagagattggaaagacgcgggacaaataccaagagcagtaaaagactaggaagcaaagaaaaagaaggaaagaaagaaaacaggaagaggagggggaggaggaaatagagtggaacagaaatagaaatgcaaagcggaagagaaagagaaaggaaagaaagtggtgtgttggactgcgctgatttgtttccttccttcttgtcccctttccccaataatctcttcaaggcaaaaggttccccagaggctcaatagaaacaggactcttacagactaaatgaaggtgtatgaattctaattttcgcttaatttgatagtaatgcctttggaaagtcactatttttacacgtagattttctttatctgcaatctttagataatgttagcaaagttaaaaaaattctctgtctccatgtaagctatattcaaaaaattcattttaatgtgattcaattcaaagagggcattttcctatagaaacactgttacacagagtatcactacagttcataaaaacatacttaacatgtaatggaagaaaagggaactggcctttcagctatcagctccgagcttggtaaactggagcacagcatctcttttcatttcctttctcacatcctagggagctttgcaccaatccatgttcataaattgagggatatgtctgcacttcaaagatcaatggcagcaacactgtgaacggctgttcatacataagtaaaactagttaaatttcctgattcttactctttccctcagctctttcctgccccacatgtgtgtccttcttgtccctagtacctttccacattttatattgggtacacgttccaatagcctcatggaactagagatctgtttcttctcaactctggaaaattctttctattccatttctgcatatgacctttaccttccatctagatctttttggtcttcaactgtatagagtgttatttctctcttgaacctccaccttctacctccaacccctaatccctgccatttgactaatcaggtatatccttgacaaaagtctgatgtacaaggggacagataatgttaccttgattgacagtgttctaatacatatattaagcagttgatgtagaacaggcgggaagacaaaatgttaccctgtttctcatgagaaaggaggctacactgctcttcttaggaagtaggaagatagatgcagagacagatatttagaaggggaggaaaataaaaattgtctatgtgtctgctaacctaaatccattcagtaaaagagaagtcaagttcagttcaagacagaagtaaggttggttccaaaggatggacacatacatgcaactcattcctgggtacacaaaagatgaaatagagggcgtgtgtcgaagtacatgtccaaaggtatgaagtagctgcaggaattttatcagagaaaccagtccccaggactaatgttaacagatgacagagggaaagctgtctgaattatttgccagtagactactggtcaagaggacttggaactatagctgaaaaaaaccttagaactatacacacaaacacagtactaatcagcagaagtaatgagtattgagagaaaacaatgagccataatttacaatcaacttaaatagaatttatgcaactgaaatctaagacagaataataggcagtaacttccagtttataataatgactacttgtgtagtcattactacacaaaattactgactacttgtgtactgacatgtattttgcacaatgatatgacagactaagacaaactgaatagtttgcaagtaaactacttgtcaagaggacttggaaccatagctctattgacatgtaaccatccttaccaaagacagactcaaattctcagaaacgtttgcttctattttggggagatcatccaaatctataaacttgtgaggctttaacagtgggaaaaaaaaccttacaactcacttagtctaacttctttactttaaaggtaattgccccttggatgaaaatcactaacattttagtataaacatatttacagtgaataactttacatttgctagccaaaatttgttgccaagggactaaaaaatgtggcaataaatgaagtacttgttaaaaagatacttagttttaaaatttttgtcagtccactttttattataagagttgctgataaaaataactaccatttattgaatacttactacatgttagaccctttgcaaacatcctcccctttaaccagcacaaccactagaaaagacaggcatcatcatcttccttttacaaagttgaggaccatgaggctcagaaaatagtagatagtagttagtaaatagtagagccaggattaaaatacatgttttctaatacttcatactctatcagattgtgtcacaatggtattaaaaaaattagaaatataggaaaacatgaatactttccatattttctatggtaggtgctatttcaagtatccttaaaatatgtgtgcaagtgcagaagattctattgaagtttaccttaaggcaaagacagtcataaagaggtcagaaagagggctgacttactgaaagtacttcaaaattctactctctcattaaatgtgaacagttcaaaaactttagcaattgtcattgatcagcatggtgaaatgattatggcctcatttgtgaacaggcctgataggttgcactggatttatctttcttcatttctttttttttttctttttttttattagctatttttctttttttaaattttattttattattattattctttaagttttagggtacatgtgcacaatgtgcaggttagttacatatgtatacatgtgccatgctggtgtgctgcacccattaacttgtcatgtagcattaggtatatctcctaatgctatccctcccccctccccccaccccacaacagtccccagagtgtgatgttccctttcctgtgtccatgtgttctcattgttcaattcccatctatgagtgagaacatgtggtgtttggttttttgtccttgcgatagtttactgagaatgatgatttccaatttcatccatgtccctacaaaggacatgaactcatcattttttatggctgcatggtattccatggtgtatatgtgccacattttcttaatccagtctatcattgttggacatttgggttggttccaagtctttgctattgtgaatagtgccacaataaacatacatgtgcatgtgtctttatagcagcatgatttatagtcttttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccggaacctgttgtttcctgactttttaatgattgccattctaactggtgtgagatggtatctcattgtggttttgatttgcatttctctgatggccagcgatggtgagcattttttcatgtgttttttggctgcataaatgtcttcttttgagaagtgtctgttcatgtccttcgcccactttttgatggggttgtttgttttttcttgtaaatttgtttgagttcattgcagattctggatattagccctttgtcagatgagtaggttgtgaaaattttctcccattctgtaggttgcctgttcactctgatgatagtttcttttgctgtgcagaagctctttagtttaattagatcccatttgtcaattttggcttctgttgccattgcttttggtgttttagacatgaagtccttgcccgttcctatgtcctgaatggtaatgcctagcttttcttctagggtttttatggttttaggtctaacgtttaagtctttaatccatcttgaattaatttttgtataaagtattgatgggatgtatctcaaaataataagagctatctatgacaaacccacagccaatatcatactcaatgggcaaaaactggaagcattccctttgaaaactggcacaagacagggatgccctctctcaccactcctattcaacatattgttggaagttctggccagggcaattaggcaggagaaggaaataaagggtattcaattaggaaaaggggaagtcaaattgttcctgtttgcagatgacatgattgtatatctagaaaaccccattgtctcagcccaaaatctccttaagctgataagcaacttcagcaaagtctcaggatacaaaatccatgtacaaaaatcacaagcattcttatacaccaataacagacaaacagagagccaaaccatgagtgaactctcattcacaattgcttcaaagagaataaaatacctaggaatccaacttacaagggacgtgaaggacctcctcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaactaagctggaggcatcatgctacctgacttcaaactatactacaaggctacagtgaccaaaacagcatggtactggtaccagaacagagatatagatcaatggaacagaacagagccctcagaaataacaccgtatatctacaactatctgatctttgacaaacctgagaaaaacaagcaatggggaaaggattccctatttaataaatggtgctggggaaactggctagccatatgtagaaagctgaaactggatcccttccttacacctttcttcatttctcatgtggaacattaatgttaacgggtctatgatgtatgaagagctaactctaagtaagcagaagtaagtcaaattctataacctattgatctgagatacctaaaaaggagcttggatttcaggaggattgggatacagctctcctcttgctttacattttgccataggctgggttttccagaaaacagactctgaaatggagatcagcatgtagaaagtttattagggaagacttttaagatcagcacctgtgcatggaaagagacagaagcaggattggacagtgggaaaagttgagctgtgatatagtcttaaagtcctcagtcaacccgacgaggaactctgaaggtggaatggccctaaagagtatcacaggtcagggaaggaaagctctatttttaatacccctatgttgatcagtcattggatgtgggtgcctgagggggcatggctttaagttgtttgcacctgaggcagttccctgagagggctgtaagctgaaggtcatctgctggcagcactcccaatagttgtggaaataaatctttctgtcctgaaggaggaacagggcaaaccattacagtgttcaccttgggtttgctgcctttgattgcatgtaaatattattttgtattatttaagatgtgtagggtgagtaaaatgccctagaaaccctaggaaagattaaccttgcctgtcaactttattcatttatgtgtttcttttagatttgaaagcctcagagaaggaccaaacagtgcctgagaagtttgaatttagaataaaaggttggtctggcatttttatgtgaacagaactagaaaccacagtagccaggaagagaagatggccagataactgaaagacagaaggcaggttaggaaggagctcaggccaggttgtgcccacccatctgtgttagaagatggtgatccttgtgcaagcagatatggaactaaataaagcccctttactcactgtggtgggattatgtggaataaagcacgcatctaggagccttgactatttttccattgcttccttttacataattatacccatttaatttatcctttaatttttgtgaatgcatcactctatttcagttacgctaagggaataagaaaaaaattgtgtccatatttggattaaagagaaaagacaaacatcatatccatggggtgcagatgagacaggtgtaggagaaatcaaagtgagaaagattaagaggacgtttcagtgtaggaagctctagatgcaagaattcaaagctttcaagacaggaagaaagagtccagaaaggcatgtactgctatatcttttctcatttccttctccgatatgttccctttcaggagaaaaaaaaatgaatagttgtaagcaccaatttatgatcacatggtaccagttgagcatctgtaatccaaaaacccaaaatctgaaatggtctaaaatccaaagctttttgagcatcaacatgatgctacgagtggaaaattccacacctaatgttatgtgatgagtcacagtcaaaatagaaaaactcatttcatgcacaaaatttttgaaaatattgtataaaattaccatcaggttatgtgtataaggtgcatatgaaacatacatttcatgtttagacttgggtcccatcccagagatatttcattatgtatatgcaaatattccaaaagttcaaaaactctgaagtccaaaatacttctggtcccaggcacttgagataagggacacctgtaccaggcgtgttcacgttctctcatttactgataacaaccatgtgaaaaaaacgtatattactgccattttatcatgagaaaaaccaagactcagggagaataattaggtttcctaagcccacacaataagtgatggaactgggaagagagtgtagcacaggtttagggtgagaaacaattggattaaatgtccttcagtatttgaatgaatacaaaaattgtggtatattcttataatagaatattactgaacaataaaaagtaataaactattgataaacataacaatatggtttaatttcaaagtaacaatgccagtgaataaaaccagatatgaaaaagcacataatgtatgatatcatttttataactctagaaaatgcaaactaatctctattgacagaaagcagatcagtggttgcttggagatggggcagggtgggaagtggcaggaggaaacttttggaggtgatagatacattcattatcttgactgcggtgatagtttcatgggtgtatacatatgtcacaacatcaaattatgcactttatgtatacttattgaatgtcaattatacctcaataaagcagttaaaaacaaccgggttgaaatccgtgttatactatttacaaattgcttaatctctaagactacattttttaaaaatcagttaaatggagttgctaatgcctaccacagagggttggtgtaaacattaaatcagtaaggcaagtgcttagcacactgtgtaatacaatagtaagcatgccgcagtagttatacaaggagtcctagactgagttcttccttcttagagctttctccactttaactaatcatgttagtcctttttatttacagctggaattcaaacacatcaatcttacttcaaagaccaagatctttccactaaactgtgctaagccatgacaaattttatgatttgaattgaggagggcatgccctgattggacaccaggctcagagtattccacataaatgctcctctgtattaccccagggtctggaaaagtcactctgggccagggaggaagaccagtggttcagctgcatattctttacctatactccttcagattctatctctgctcctttttcagatccctactggctaaacagcaatgaaattgcttatgcagtgtacagataaattgagagcaacaggtcctgtttctcaggagtttgccccgaatggcaatccaaactagacataatattgggagaacagcattcattgagattaactgacttactctttatgaaacatttgctttcctggataaaatagtgtattaagaatgttatacattatgtattaaaaatgttatactgcacattacacatcacatatttaaactacatgtaaatttataaaatatataaacaatgataaatctcccatgtttattttctaaagaatactgttaagagtaatacatctttaatatgtccaatcaagatgccatttcatggaattatgtaagttttttttgttgttcattttttttttctccaagtgataatcattgagagggtcttttcaagcagaatctgtggtatgctgacatcttataagattgtccttggacattccaattcaccaaaatttggaccccctgatactacagctcttttcttggcctactacccccaggcctcttctcacagcgcccagtcccttattctcctgagactgttgtttctcctcttttctcaccctctcttttcctactcctatgaagcagcaaaaacattctcctagactcagaatgagcagcttagtccttgtctctgaaggcttggttagcttcggccttatggaatcctaagaatcttaccttctactccatttttttcaaggttttaaattttctttcaaagaaagacactgttctttcttagagaaattctgatgccatctataaagaagcatgttctccacatttcacaggggaatgaacaaattcatgaataggtaagtagagatggtgaatgcagactgctgtttcaaaaaacctagtgataatgcaaaggaaagaagtgtgcagcagttgtagagggtggtaaggtaatgggatatagaagtcaggggcatgacagaaattggaaatttagaaaagatgcaggttagttgctgaggcaagtgctgaagaggagggaggggctggtctccaaagcagagtacggctggaaggccagcctagagcaggaggagacaacacttcagaagctgctactgagggaagtttgcaggtagaagagaaggagttgaggtatattatcttaaaaaataccacctggtgagaataaaagtgaaggaaataaaggagtgtgaatattgattcaagtaactttcatgggaaatgggaaagagaactaattggaaaagtaaaaggaaagccgtcaggccccagctgagacaacaaacctaataggtatagcagagagattacttccagcaatcttctcctatttttcctgttaatgataactcttaacagttaccattttcgtggttacaaaatatttcatcaactaggtgtatgataatctatcaagattactcagttccttttcaaatgaactaaaatgtggtatttttaaaaagacaactaagcatactttaattacctgtaagaatattgtctacctacaaataattaaagtctctaaaaaaggaagcaatacatttgccttttctgccaacattattcctgtcttcagcaaaacaccgtaatttaaaaatatacaccgaatcatttctttttttattatgataacatatacacaacacaaagtatgacattttaaccattttaagggtacagttcagtggcattaattgcatacatgctattgtgcaaacaccaccactatctgttaatgaagcttttccagcacccaaaacaaattcaataaccattaagcaataacactcccttatcccctccacctttaacctattttctgtctctataaatttgcctcttctagatatttcatataagtggaattatacaatactttgtcatttctctggcttatttcacttagtataatgttttcaaggctcatccatgtagtagcatatatcaaaacttgatttttttcatggctgaataatatcccactgtatgtgtataaaatattttgtttatccatttcttggttgatgaacacttgggttgtttccaccttttggctattatgaagaaggtcacaacaaacgttcatgtacaaatatctcttgagtctctgttttcagttatttggggtgtatatctcagagccaaactgctgggttgtatggtcattctatggttagccttttgaaaaactgccatgctggtttccacagtggttgcaccattttacattcccaccagtaatgtgcaaatgttccaatttctccacatccttgtcaacacttgttattttctgtttggatattttgtttttttttttcttaatcttacagctatcctagtaagtgtgaaatggtacatcattgttgttttgatttgcattaccctaataactaaggatgttgaacatcttttcatgtgcttattagccatttgtacatttttttgagaagtgtctatgcaagtcttttgtccatttttaaatcgtgttgtttgtcttttaagtatgttgttggattcagtttgctagtgctttgttgaagatttttgcttcaatattcagaagggatattggtgtgcacttttttgtgatgtctttatctgactttggtatcagggtaatgctgacctcacagaaaaagttagaaagtgttctttcctcttctattttctgaaagagtttgagaagaattggtgttaattcttcttgaaatatttggcaaagttcaccagtgaagctatctggtcctggacttttctttgttgggaggtttttgatcactggttcaatctctggccttgttgtaggtctagtgaaattttctatttcatcttgagtaagtttagttaatttgtgtgtttatccatttcatctagattatccagagctggcagtaatgcccctattctcattttaaattttaatcatttgtgtctttcttttttcttttgtcagtttagctaaaggtttgtcaatttgattactttttttacagagccaaattttggttttactgattctctctattgtttattctgttttattgatctctgctctaatctttctttccttccattgtctagttttgggtttggtttgctcttccttttctagtttctcaagggataaagttaggccattggttatcttttgtcttttttaatgtaggaatttatagttataagtttgcctctgagcactgtttttgctgcatctgatgttttaatatatgtgttttagttttcattattaaacatcttatgttaggctgggcatagtggctcatgcctgtaatcccagcactttgggaggccgaggcgggcagatcacctgaggtcaggagtttgagaccagcctggccaacatggtgaaaccccatctctactaaaaatatgaaaattagccaggcatggtggcaggcatctgtgatcccacttactcaggaagctgaggaagagaatcacttgaacccaggaggcagaggttgcagtgagccaagatcatgccactgcactccagcctgggtgacagagcaggagtccgtctccaaacaaacaaacaaaaacatcttatgttttaatatgtgtgttttcattttcattattttctagtttttattgtagtttcttctttgaccaatgagtgtttggtagtgtgtagtttaatttccatatatttgtggattttgcagttctcctttgattttgatttgtagcttcattctacttggtcagaaaagatactgtgtatgatttcaactttttaaaatttattcacttgttttgtggcttaacatatcatctatcctgaagaatcttccatgtgcccttgagaaaaatatgtattctgctgttattgggtaaaatgttctatatacacatgttaggtctagttggcttattcaagtcttttattttgtgacttatcttctgtctagatattctattcatttttgaaagtaagtattggagtctccaactattattgtacaactatttatctgcctttaattctgtcaatatttgcttgaaacattttgggtctctgttgtttggtgcatgtatgtttataattatgataactttttgatgatatatatatttatctatatatcaatatataatgtccttctttgtcattacaacagattttgacttgaagttttttgcctaatattagtatagcctccttggctctcttttggttactatttggatgtaatatcttttccattctttcactttctacctatttgtgtcgttaaatctaaagtgaatctcttacagacagcatttatccattctgcccatctctgcctttgagtgaatagtttaatccatttatatctaaaataattactcataatgaagtatttctgccattttgatacttgttttctgtatgtcatacttttttcctctcttattttctccattattgccttcttttatgtttagttgatttttttgtagtgaaccattttgattcgcttctcatttccttttgtatatatcttttagatattttctttgtggttaccatagcaattacgtttaatgccctaaatttaaggcaatatattttgcattgataccaacttaacttcaaaaacatttaaaaactatactactatacatctttatcttccccctttatattgttaatgtctttttacatctttaacattgtgtccccaacaggagatttattatttttatatatgtgtttgttaaatcttattaaaaataaaaggtagagttacaaacaaaaattaaatagtacttgttcttatatttgccctacctttactgtaggcctttattttcttaacatggctttgaattgctggctagtgtcttttcatttcaacttgaaagacttcctttgcatttcttgttggaaggaaacgttgaactcaacttttgtttatctgaatatatcctaacttttccatcattttgaaggacagttttgctagatataaaatttcagttaataggtttcattttctttcacccacttaaatatgtcactccactgtcttctggcttccatgttttctgataagaaactggcctttaattttaatgaggattccttatatgtgatgagttacttttttcttgtttgctgctttcaagattctctctctacctctggcttttgatgggttggttaaaatatcttaagtgtgggtctttttgagtttatccagcttggagttcattcagtttcttggatttgtaggttactatatttaataaaattttggaagtttctggctataatttttcaaatattatttctgcccctctctttgtcatctaaaactcccaaaacacatatgctggtcctcttgatgatgacgcacaggtcccttcatctctgtaaactctaaaaaaaaaattaacagactttatttttaatgccattttaggtttacagtgaaatgcagcagagttacagagaattcccatatattccttactctcacacaaatacagcctcccccactatcaacatctcacaccagagtggtacatttgttactatcaatgaaccaacagtgacacatcattatcaagcaaagtccataatttacattagagttcactcatggtgttatacattctgtaagttttgaccaatgtataatgaaatgtatctaccattatagtatcataaagaatagtttccctgccataaaagtctcctatgctccacctattcatcattccttcccctcatctgattggaatcatgcagtctgcaaccgttccagattagcttctttcacttagcaatatgcacttaaggtttgatatagtttggatatttctctttgcctgaatctcatgttgaaatgtaatccccaatgttggaggtgggacctggtgggagctgtttggaccatggaagcagatccttcatgaatggccatccccttggtaataagtgagttcttgctctggttcacatgagatctggtcatttaaaagtgtgtggcatcacccctccacctctgtctcttgttcctgctctggccatgtgatgtgcttgctctcccttcaccttctgccatgattgcaagcttcctgaggattccctggaagccaagcagaagccagcatcatgcttcctgtaaagactgcagaaccatgagccagttaaacctcttttctttataaattacccagtcttgggtatttctctatagcaatgcaagaatggattaacacaaggttcaaccatgtgtttttttggcctgatagcttatgtctttttagcattgaatagtattccattgtctgtgtgtaccacagtttatttatccatttaccttgtattagtctgtttgggctgctataacaaaatagtacagactggactgggcacaatggctcatgcctgtaatcccagcactttgggaggccaaggcagcagattacttaagctcaggagttgaagaccagtctgcgcaacatggtgaaaccctatttctataaaaaatacaaaaaattagctgggcatggtggtgcatgcctctggtccctgttactcgggaggctgagacaggaggatcacttaagcctgggcggtggaggttgcagtgatcctgccgagatcatgccactgcactccaacctgggttccagagcaagactccatctcaaatttttttaaaataggaaaaaaataatatagattgagtggcttaaacaacagaaatttactttctcacagttctggaggctggaaatccatgacaacagtgctgccaaattcactttctggtgagggttcttttcctggctttataggcagccgtcttttttttttatgtccccacacggcctttcctcgtgtatgctgagagacagaaagagagagtgctctggtatctcttcttgagaacactaatcttaccagatcagggctccacccttaacttgcactacttccttagagaccccatctccaaatacagccacactaggtgttagggcttcagcataggaattctgaagggtacataaaagcgcatcttggttactttcaagttctggcaattattaataaagctgctgtaaacattcaaatgcaggtttttgtgtggacataagtttcacctgatctgggtaaataacaacgagcccaactgctggattgcatagtaagagtatatttagttttgtaagaaaactgcctttcaacatgcctacactgaaccaggtgtggtggcccatgcctgtaatcctagcactttgggaagctgaggtgggaggattacaagctcaggaattcaagaccagcccgggcaacatagtgagaactcatctctagttaaaaaagaaaaaaaaaaagtagctataccatttgcattccaacaacaaatgaaaatttcttcattctttttcctttctgctcctcagcctcagtaatttcagtggtcttatcttcaagttcactgactcttctgcttgctcagttctgttgctgaagccacttagatttttttatttttatttttcagcttcagaatttctgtttggttccttttcataactactatctctttgttgatattctcatcttgttcatacatcattttcctggcttcctttagttcactgtcaatgttttcatttccatgtttagcattttgagcatatttaagacaattgttttaaagtttttgtttagtaattccaatgtctggacttcctcagggacagtttctatccatttattttgttcctttgaatgagccatactttcttgtttctttgtatgctttgtgatttttgtgtgtgagcttgaaaagtggacatttggctcctatgatgtggtaactagaaattagattttcttcactttcctaggggggtttgctgttttctggttcttgaaggctgtagcagtcagtttatttgatgcctgtctcaaactattatttcaaagactgtattccttgtcaatatggtcatggaagactctgtcccttagcctgtgttcagctagtgttttggcagatttcctcgaatgccagaagctctcacagtctttgcaaagtggctctaagccagggctctacttcaattcttagttagccttgcactgtgctaagggatcagcccaaaatgaaagcttagggttttctcaggtgttttctaagcaagtgttttgccctgggcatgtgcatggctttctaaattcccacgtatatatggttgcttttgaatattttaatttcccaaagaaactctctccagattttgccttaggcagtctattgcatgtttcaactgtaatctctgcctccaggtgtctagggttattacttcagtttgctgtgttttccagctttttctgccctaggttctgagttagcaaaacagaggagaggatcttgcatcaatccttcaggtagccccttgtattagtctgcttgggctactgtaacaaaataccacaaactgaatagcttaaacaacataaatttatttttcacacttttggaggctagcaagtccaagatccacattctggctgacttggtttctgctgagggcttttttttttctggtttatagatgataggcttctctctgtgtccttacataatggggagagagaactcttcctcttcttggaagggcaccaggtctattggataaaaggccctacctttatcccctcattttacctttattacctctgtaaaaccccaaaaggatagggttggggggctttccaaacacatagaggttcccagaggtttgtatgcctggagacagcatggaagctacatgccatttcttccataccttacattatacatctcttctatctggctattcatctgtatccattataataagtgagtaaacataggtaaagtatttgcccaagttctgtgagccatttcagcaaaatgggaatttgtggaaaaaggtcgaggaaggagatgcttctctatggaggatgaatagaaacaagaaaaggtatctactataggtccacctttagatttagaaatacaacttgaaataagaaaaaaaaaatgccacattatgcagctacacaatttgtaagtcaattagttcttttcaataacagatgcaacatatacatttataaataatttactcctttgggatttcaaactaaagaaacttcaactatttcacttacaacaaatgtttctgcttctgtttctcatcaattgagaaaacaattaaggaacactcctgattcttattccagggaactagaggaacaaagagtaaccccagggattctagcctcgtaagctgagaatatttttctagatgacacaagttcctcagtgcacacgtgacagtctctgctttcaagctaatatgctgtgagtcacactgagtcctcttccctcgaggttaaatgtatttcctagactttttttctttatttcttcctctgctctattctccatcttaaccctattcctctgtcagtcaattcagaaaacaacaccagccattccaattgtctcaaaatcttggtaaattttgtaaagatgtagctacaaggaataaaaactgtttagaaaatgttctcttaggttatacagggtggcattgtcaggtattttcaataggagacgagaagctctgtctaaaagcacaatgttgccagaaggatttccctgatctttgtttcctggtgtccatttttcacttactccctaatttaacataggaaatgaggtgcaagaagctctgtccctttcttccccctagagttcttctttttcttactcagggatcatccacaacaacaaacagtctgatatctaattaggccagtagtttcaactgatttgggctcacagctgaatagctgaaagcaagaaaaaaccatacaattaaattagggaccttgtatttaaggccattcatccactacataatcaggacttgagtctcacactaaggctctgtcttactcattctaacatatttacctctcaggttagtcatgccacaaaaatgtgcattgttaataattgcctcatctctacctttgatgttccagtatataaagccttcccctgtgtgccctaagttctgccctctgaaagagaaagacatgttttctgccatttattttcttgctattgggtgcaattttgctctaggatgaactcataaactcaaataaccggttatatatatgtttgttattaagtttgtttaagtacctctgtcacaacaaagaggagcagatatactcagccacagttacaaattaattcatgaaaaagaaaaaggagccagtgataattatgcattcttttaaaagagtaataaattttcaacaggctcataaaatgagacctgacatataagctaccattctgccatactcttaaatccaaactgcttgctatgaatgatgctactattttatacagtacacagtaaaatcagtaaataagttgtcacttcctgaaaggtctccatggtattcatgtaaaatacttaatgcttaattgcttaaacatcaggtagacctcatcagcctaatttaattaaaagaatgctaatgctttatatgtaaagcatatttacatataatctcattgactgccttttggggtacattgggataattttccccagttagtggatagggaaattgagattcagaagggttaggtgacttactacaggtcatccagctaatcagtgataaaactgggggcactgaaagataagtacctggattgggcttaccaaagtggtggctacaaaaaggctggagctgtgtttaaaagtttacaggagagccatccatttttagttgacttttttaggaaatgatccagtttgaaaaggagcaagaatgcaggaattctgcaacagagggctttgagagaatttagatctgtagattctgatctttggatagattacatcaaagcagaattgaaccgcccccttggtagacctgagaaatgtagacagacctgttggcgagccatgaaaatgttgcagagagagtcatcagaggcatctgtagctaaacatgctatgcatcagactggtcatttgtgaagagaaataatacagccaactttgtgaaatagtattgcaagccctctgggcaaatttgtattatgagtcaatctgtaatttgcttggagatggcagacaagatggctgtctggtttcaagacatggtttaattttgtgttaactcattaatttttaaaaaattaaaaaaaattgattgaggaaaaacaactgggggcagaattcaagtttcaaggattccgttgttctattcaccatgttacttccacaactggcaaagtttagctctcagtaagattcacactacatctctctataagagatcaaaaaacccttagataatacaggtgtcagggagcaaagataatcctaacattgtatgctacctactaaagtgaaaaagatatacttcattcaattatttattcattcaaacaacaaataattgaacacctgcatgtgtgccaggcattgtgctaggctctattatatccagctgtatgagttacctattgttgtataacaaactatcccaaaacttagtggcttaaaacaacaatcatttaaacatttagtatctcactgtttctgtggcctaggaattcaggagcaccttagctgaatggttctgtctcagggtctctttctaggttacagtcaagatgttgaccatgatgcatgcaatcatttgaaggcctgaagggttggaggatctgcttccaagctcactcacatggctcttgtcagaaggcctcaatacctcaccggttgttggctagaagccttaattactcaccatgtgagcctccttataagttgcctgagtgaccttatgactctgacataacagctacctggccccaacaagtaatcctagagaaagaataaaaagtctggcatgttttatagtctcccctcagaagtcacattacatcatttccactacattctattcatgagaacaagtcatttaatacagtccaaactcaaggtgaggggaatgaagtttgaccctttgaaggaagaagtatcaaataatttgtgaacatattttaatactaccatatgagttaataaaatttaatacacgaaatttaacttaattattataaactggtgttaatatatttgtaaaatgtaggtatttaaagggaaactaagtctattaaagaagacaatgttttaatgttgttgctagcttgtttgcattttctgtcaccattttcacctcattctgtctattaaaaaattctatatatagtgctaaataaatgatgacttggcctatcttattatgtcaactaagaattgcatttgatacttacaacagacaataacaaaatcttatatagaagggatataatcttcctcacctaacaacaaatccagaagtggatagtccagacctggtaagttggccctccaaagcaaccatggacctaggcacctctggtgtcctacactattaatagtgtctgtgtggcttttgttattatgggtgaaatatggctgttctacctccagtatcatgtccctgtttcaggttcaaaaaaaaaaaaaaaaaagggatgggtgcatatcaaatggctaaagcgatatttcttccataaagctttccttgagtctcctctacagaaattcacttttatttaattgatggtcacatggccagccatgacttatgaaagtctaggggcatgaatatttttaactggccacattgtcaccctgaagaaatcagagttctactagtaaagaagaaaggattttggtttagacaactagtaatgtctaccgacctactccaacgagttttgacatgcattattaaacactagacacaagagaaacaacaatactgaggtttatgtgtgtttcaagtatgtttcaaatgggagaatctggtcagttttgagtcccacatataaagtatatttttcaaagtaaccacaatttttattctctaattgaaaatgtcgaagaattggctgacattaatgtcacttctaggaatgtgttcaaggagataattgcacaattgtgcaaaagcctatggataagaatgttcatcagagactttttttatggtagtaaaaacttggaaacataaatgtcaatcaatagaatactggttggataaatgatggtatatccatttaacagacagtatgcaacttttaaaaatgatgttattcatgactgttgttcactgtgcagataatacgatccaatttatgaaatattgtatttatatgtctatatgtgcttttattcttagagagatgcctagaagaatgtaacacaaaatttaagaaatggttatctctatattatggtatttggacagattttaacttctttgcatttttgtttaaattttttaaatttgtttgcataagcatgtattgtttttataaaacaatagttattagctgggtgccacagcctgtgcctgtaatcccaactactggggaggctaaggcgggaagattgcttcagccttcagcccagttattcgaggctgttgtgtgccaagatcacacctgtgaatagccactgcattccagcctgggcaacatagaaagaccatatctcttcaaaaaaaaaaaaaagctattttcaaagaaaggcagggtgggggcagggctgatttggtccagtattgtttctagcaagtaattttccaggataaggctgtggctgaccttattttaggaaagggttctaatctttgctcaatggaaaaaagtgttattctttattaattataacttttaataaaattaaaacgagataaggagttgtgagttttggtttctatttggaacactgacccctgaaagagttctccttccatgtttcacaatggatggcaagacattgcggaaaggtggaaggatgttgcggaaaggtggaaggatattgcggaaaggtggaaggatattgcggaaaggtggagggggaggaggctgagcaacaactgtatacaagttggggaggagtagagaatggacgtaatcatgtaaggcagagaagtctggacccatgagccaaggaaagagcaataacctggacatcaggatagctgcacttctcttctaacatggacctatcagtttatctttctggccttagttttgtcatctgaaaaatgagacatctgtattagaatcactacatgtgctttatgtttcacaattcttttggatatattgatgcaatgtcctgagaaactacactacagctgaacctaagcaaattaaaggaaaaataacaataactaatgtatattattatttgtctcaggcattctaagtaacttgccaataggtggagggaccaagatgccagcccgggcagtctgatttcagagcccatactctttaacaaccatgctgtagagtactaaagaaccgcttggatagggcatttaaaggaagcagggtagctttcctattctggaacgtggtcttgtagataatggttaacgccagtaaagactaaaccttaccctcacctcatgactattgtggggttgcctcaacaggtggcagcctcctccccctattccaaagacaacttccttattcagagcccagcgaaaggggagataggttttgttacgcccctaagaagctcttccggccattgccccacagaaccgaagtgctgacagaaccaaagacgaaatgtgcctatagaaagctttctggtatcattatctcggttctcagctcttcctggttctcacatgatgacccagcacccgtatgcatacttcatcttattacttccttttattaagcccagagagatactgagtaaagagagcacggggagagaacagaaaaacaaatgaacgggttaagagcaggctacaggccacaagagtcctgcagggttagagcctgtacctcagacaaaggtccttcaagcatcccctttctcgctccctattgttaccctgctttcgtcccgctcaaggtcttgaagctagtgcataaccttacagcaggatcagaaatgcggagagtagcagacacaagccgcaagggggatacaacaaaatctactgctcgtgcaagatccgacttcccagaccccttcgcattagggcggagcgtgcacccggcagccaatccccgcttcctcacgtcgccgtatccccgcccaccgcccctcccgctccgcccttccctggggctggtgcggcggcggagacgtcagcgccaggagacttcgggtggcggctgcgccataggcgggccacggcctggacgcgctgcggggaggggcggagcgagcgggcgggagcgcgcgctgggcccgccttggccgccgccgctgtgctgccgctgccggggaataatctgggcggcagcgggcggcctcggctagcggccacgagccacttctgcggctgcccagagaagcaaaggtcaccagtcccaagtcgtccccctctccgccccccaggaggggcgagagggagccgcagctgatgtcaggtatggccggcggaggcgccctcaggctacgggtccaaggtctcgtctcccctcgccctcccccctctccgggttggtggggaagcgtggaggatggaaccaaaccccgggcgcggcggaacaggtgtctcggggtcaaagccgggctggggtcgtccgggctcctgaggaaggcgcgaggacttcccgctcccggagccttagcgatctgccacagcgttcggctgcgtacccggcctcaattttgtggacatgtaccctcctcttcgtcgtgggtccttcccttgtgcccgctcgcgcccctcttctgctcgcgcgctgcctggcggcgcggcggggcgcgcagtgcgcccggaccggaccacttagcggtcctgccccgccgggccctcccagtccctcctcccgggccctccccgccccgccgcagacctgtgggtcccgccggactgggcgcccaggtgttgggcaccttcgccggggagccactcggctgccgcgccgcctgagcgcccagcgagcgggctccttccagaggtgcctggagcttgcttgggtctagcttggatcatcaggtttgtctgtagctgatttatttctttaagtttccctgccgcagagtgaagcagatacgtgtgtgttggggcattcggggcatggaggaggaagaaaggcattaaattttttttttttgcttctgcaccccatttttccccaacaaattgtgatggaattagtaggtgttgacaagttgtccatttgctttgaatttgggtaagtcgtacactcttaaaagatgaccataatttagcgctgtggatttattctttcctggtccttaccgtctccccaccccccaccaccccgcatttaaagcaaacaacagtatcagcaacaaaaaacccacacatcctggaaaaattctcaagatttctaacctagttctctatatccattgtacatactactgtatttccttttaacgcttttttaagatagaaaactattgtgctaaccatggattgatttcattatgaatttaaaagttataaatttagaaccataatgaatcaatgaataattggccgatgtgtaagggagagaaatatgttaacttactaaaagttgggcatagaacatagctctgccaggaaaaagtgcgcataatttcaagttgcttcattctggtgtgagtttgggaagttggaatccgagtttttagaaggtatttagatgacagcttttcaccctcttaggtaaatggcagttgagcttaatgcccatgatgctgtatgttctaaatattgtatatagtacactatactttctaccagtctttatatatagatgtacagtttaagtgaatataaagtttcaagttagcaaacagttaactcttcaccttatggtaagtgaaacaatgacttagtaaggaaagtatgactcatttaaaattcttcataaagagaataatttttcagtattagtggagagctactaaatgcctctcaaatttgcctggaatgtgtatttttttgtatcttcctacttaggattaagcattttagaaatattttgtgtttcctatttaaagtttttcataattatgctttttaagactagactacgttgagtaaattcaatatccagttattcttaaaattgtatcacaaatttatttcagggtacacataatgagttcttgtttacctaatagaaatatgaaaaagtatgtcactaggcacatgctactatttgtgtattgatttgtgctaaaattaaaattgcattatgcagtttaacattataagccatggtaatttagagtctttgtgtggtaaaatcattgattggaatttttgtgacagtgcagctataaataaaccttaagtagaaaatggaaagcttgatgctgaaattaaattcagataggcttaaaagtttaagcttcccaatacaaccatcttttcttttagaagatttcttaagatttgattaaagacgctgatgtacaaactatagcaaggctgaaagaaaggtatgacaaaaatctttttacttcaaattcagtgggattaagtcattcttttaaaagaagaaaggtggggagcgggaaggagacttgttccataaaatgagaagttagccttttatcttaaaatctggttagagaggaactccaatgtgtacttaaattattttgcagctaattcaaatgtccaaggggaatatatatgccaaaatctgtaatatgtgagaataggaagagggagaaaaaaaatatataaagaaactggtgtttgtgatttagggaagcacataagaaggtgggggaaactgaaaggaaagtctaaataaattatctagcacctgtagtatgtgctgccttgcacattgaaggggcgtgttgggggcaacgagaggcaatattagggagattctggaatgggaaacctgtatattaaagcacatttaaacggctagatgttggataataggcagaatttgaaattaaatacagcttggcatagttatttgcattcttggtcattgtattttctagggctgcggtaacaaaatacgacaaactgggtgatttaaaacaacagatttattgtctcagttctggaggcaagatgtctgaaatcaagatgtaggtatggccatgctctctcaaggttcgaggggagaatctgttccatgcctcttagcttgttgtgttactgccaatccttagcattttttggcttgcagctatgtcactccagtctgtgactctgttatcacaacataatccctgtgtggctctgtcttcagatggtgtgctccacttcttgcaaggatactagtcgtattggattaagatccaccctaatcacctcatcttaacttgattacatctgcaaagaccctattttgaaataaggtcacgtgcagaggtactggaattaggacttcaacctatcttttgtggggacacagtttaacctgtaacagttgcacggtttatcttttacatcgttcagtaaatgtttagcattatagactgaatcagaggctatagtggaaacaggatgggacacttacatttatttacatatatcagtgatgtcttaatctgttttctgttgcctctagcagaatatctgaaactggataatctataaagaaaagaaatttattccttacagttaggaaggctgaaaagtcctggttcagggggccacatctggtgagggcatttgctggtagggactctgcagagtcctgaggatagcacagggcaccacatggtgagggggccgagcatgctagcccagaactctttctttctttctttctttcttgtaaagctaccagttcctttcccatgataacccattcatgagggctgaacccttagtacccagtcaccatttaaagactccagctctcaatactgccacagtggtgattaaggttcaacatgagttttggaggagacaaacattcagaccacagcaagtgcttactatgtgccaggtcctggagataaaacagtggataggcaaaaatctctgtcctcatggagcttacattctgaaacacgggttctaaaaatgtggtccctggatctgcagcatcatcatcacctgggaagttgttagaaattgaaattttcaggctccatcccagaactctttatttaactagccttccaaatgattctgatggagactcaggtttcagaaccactgatcaagatggaaaagagacagtaaacaagatgaataagtaaaataatatttgatattaataggtgctgtgggtaagcatagggtggccagtgaagactcctgaaaagtaaagacctgaaggagttggagagtgagccatatgagcacctgggtgcgtgttcttagcagagaacagttaagtgtgaagaccctggcacgtttgaggaatgacaagcagttagtattaggttcaatctatgaaattgctgctgtttgttcatttttgacctacaaaaacaccaaatactggggagaagagatcagaaagaaaggggtggagtaggatgcagattgtgggtagatccttgtaaggttttggctctctaagattaggaagacgggagggttttgagcaaatgagtgatgtgatctgatttcagttttaaaaggatcattgtggctattggtaaaaatgggccaaagaagcaaaggctaaaggaaggggaaagttggttagaatgttgttggagtagttaaaagacagagaggttgctcagaccagggtgatagcagtggagaagtcagaagaggtacaagactaaaaacgcacagtaaatggtttgaaaagtaagtttttttcatcccactccagttacccagttgtcctcctcaaaggcaattagtgttaaaagtagtcttatctctattcttcctgagatttttttttttttgagacggagtctcactctgtcgcccaggctggagtgcagtggcgcgatctcagctcactgcaagctctgcctcctgggttcacgccattctcctgcctcagcctccccagtagctgggactacaggcacctgccaccatgcccagctaatttctttttttttttgtatttttagtagagacaggggagatcttttatgtaaatgtgagaaacagttttaacaaattagtggagaggttgttacctggaaacatttagcaatgtctacagacatttttgtttgtcacaactagggggaatactactggcatctagtgagtaaaggccagggatgctggctaaatatcctacagaggaccggacggcttccacaacagagagttatccagctcttaatgtcagtagcgccaaggttaagaaaccttagtttaatgggatttacagaggttggtgggaagcaagtgttgtagtcagagaagacagtaggaagaggagctgaccatattgggaacctttcagtaactgtagacagttcaggattgctgaagcagacataaattataaggcacagaatagcaaaagacgaggctggaaacctggacaggctctaggtcatagcctttatttatatatcatgttaataaaaaatgtttagtttttgtcttgtaggcagtggagttccgtgaaaggattcatggggtgacatggtcagcttttcattttagagagctcattctggtgacggggtatgagttaaagagggatagcacttgagtcagagaggttagatattgtaatagcctgtggggagagaggagagtctgaaataggataaatactagaaatggagaggagacaatggattagaataatatttaggaagtaatgttggcaagacttggtaattggatttggggtgaagataagggaagcattaagaatatctgtgtactttgtagtttagataatcctgtggctctgagtgaaataggaacccattggtgaataatttaggtaattaccagtaattaaggtaaaatgagcagaggaaagtaatgagtcactttggaggtgttgaattagagatgcctatggtccaggtggaagtatttagcaggcatttgtgtatgtgaatctgaaacttggagaagtctgaaaggatcaagagatcattttgtttgacaagtgtggagaaattagtggactttaatttttatcatattatttcactctgtagataaaaattgcctccctttatttaatttttatcagaaaagtaatgtgtgtacccgatgcaaaattaaaacatcaaaaggttataaaataaaaaaaaatttgtccttccttgctcatgccacccagtgctagttcccagagatagctcttgttaaatatcatatgtatatatatcttaacagattttaaaatatatacagaaacatttaaaaagccaagtgaaatcatactagaaaatatttcggtacattgtcttaaaaaataaaccttttatcttatacagttgttaaaatgaatgacattgtgttatggataaaataagtgaaggggtaaattaaagtgcagactaaccgataagcatgatctctgatgtaaattaaaagctgaacatacatatgtgatgatataggcattacccaacgatacgaaagcagttacttttggggagagatagtggtagagatggtaaagaaaatttactcttttctgtctatgattttctttcatttgtttaggtttgttccttttgttttctttacattttctgatgtttaaaaaaatacccagtataccttattaacaataaaaagtaacctttgtcaaaagcacaaagattttccctatcagcacatgtagatcattgtttttaacagctactactattctatgctatggctctatcttttttttaaaaaactggttcctcatcaacagacagacgtcttatggttatggctgtcgagcatcttggctgacttctatgattatatctgtaaaataagtttctgatcatgaagtgatatatcaaggcataattagttaaaaatttaaaaagatgttgtgaaatgcccttccaaaagacagtaaaagtatgtattatgagaaagaatacaggactaccagttttcttgtatctgtgtcaataacagctgttaataaactttaaaagttttgccaatatgttaggttaaaaataatatctcttcatttgatttacctttgtgagtgaaatttgaacatcgttgaccattttttactgtgaatcttttattttctttatctgtttttgtatttggttaactatcttttttattatttatgatactttttggttctttttgctgtacattaaaaaaatatatttcataaagaaatatgccctttaaccagcgacttcattgccagaagtttatccaatgaataaactcatagtgttttaatagtcacagcttctgagtgtgggagagatctcaattcgtaatatcaaaatgcaaaaatatattttcttccagttttgttttaattccattttctaaaatactgaaatcttagaaacatttgaaattgttactagaaagtaaggatccagctggttttgtttttttttccccaaaagattaattaattcaataccatttcttcaataagccacctttttcttgatttgaaatgctgtttattatgtattaaatttccacatgaatttttgttttccatagagtctttatttcaacctgatgaagtccctttataagattcatctggtagagaccaccagggacacatctgtaggctgacaaaggttaattagcttgctgcagtgaaggagacttgcacagcagaggaaatgtcagcatttctaaagaaggaaccagggttattataggattttggagaatggtggagtttggataaagtttaaacgcaacaatatttgataagcttaaagcacggcaagactgtgtgtcaagggttaataaacatcaggcctgggctgagaagctgactcaggattctgattccctggagactacaaaatcgcgatacatgtggaatgttgtgtctggaaaccccttatctgaagctctgagttgcaaagtgaggttgcttctgtttcataatgatctaccatcagtgcgagagtgggatgttccattctcactttataaaatttcaaataacatagtttctgacagtctgatgtagagaacagtttctcagcacattgtctttagtattaacaaatgcatttttttaaacagactgagagtttgttcagcataaataccaaattgttttcattaccttttttaaggtaatatatttttatatgtagtaaactttgtctcttccccttccccagttcccctttcaagagttttccagtgatactcacctatttttccagataacatttagaataatttttgccacattaattttttaaaatcttttttataacttaaaattgatcagatcagattagtacaccccttcccacaatgcccctttccagaatttcccagttacacccacatgtttattggtccaaagttttagaatactttttgccaagttatataattttttaaaatcttcctgtgttttagctgggattactttacatacaggttaattcggaggaaatcaacatcattatcattgatacctttttttttccaaactttttaaaattttggtaaaatacatacaaagtttaccatcataatcatttttaagtttatagatcagtggtattaactacatttatattgttgtgcaaccatcaccgctgtttatctccagaactctttattttgtaaaactgaagctctatatccgtttaaacgatagctctccattctcacctttccacaggccctggaaaccaaaagcctactctgtctctgatttttcactactttaaagtacttcatgtaggtggaattgtgcattatttgtccttttgtgattggcttatttcatttagcaaaatgtcctcaagattcattcattttgtagcatatatcagaatttccttacttttcaaggctgaatactattccattgtatgtaaatacattttgcttgttcattcatcctcagtgaacacgtggtttgcttcacattttagctcttgtgaatactgctgcaatgaccatgagtgtacaaatactttcttgaaaccctgctctcattgggtatatatccagaagtggaattgctggatcatatggtaattctatttttaattttttgaggaattttcatactgttttccatagcagaaataacattttactttcataccaatagtatacaagggttccagtttctccacattctcttcaacacttaacaattttctgaattttgatggtaaccattgttatgggtataaggtagcatctcattgtagtcttgatttgttttgctaatgattagagatgttgagtatcttttcatctgtttattggccatttgtgtatcttaggagaaatgtgtatttgagtcttttgcacattgttgaatcaggttgattttttttgtttgagttttaggaattttctatatattttggatactaatctcttatcagataatacgatttgcctgtattttcacccattctgtggcttgccttttactgttgatagggtcttctggtgcacaaatttaaaaatttttcatcaaatctaatttgccaatattttctttcagtgactctgcctttgttgtcacatccaagaaatcattgccaaatataatgtcatgaagctcttttgttcaatgttctaagaattttatagttttaggtcttatatttaggtctttgatccattttgagttactttttcttcttttttttttatttcaataggcttttggggaacaggtggtgttgggttacatggatatgttttttggtaatgatttttgagatttgggtgcacccctcacccaagcagtgtacacagtacccaatgtgtagtcatttatccctcaccccctcccaccctttacttcaagttcccaaagtccattgtatcattctatgcctttgcatcctcatagcttagttcccatttatgagtgacaacttacaatgtttggttttccattcctgagttactttacttagaataatggtctccacctccatccaggttgctgtgaatgccattatttcattattttttatggctgagtagtattccgtggtgtgtgtgtgtgtatattatacataccacattttctttatccacttgttgattgatgggcatttgggttgattccatatttttgcagttacaaattgtgttgctataaatgtgtgttcaagtgtgtttttcgtataatgacttctttttctctgggtagatacccagtagtgggattgctgggtcaaatgttagatctacttttggttccttaaggaatctccacaccattttccatagtggttatactagtttacattcccagcagcagtgtaaaagttttccctttttaccacattgatgccaacatctattattttttgattttttgattatggccattcttgcaggagtaaggtggtattgcattgtggttttgatttgcatttccctgataattagttgtgttgaacatgttttcatatgtttgttgaacacttgtatatcttcttttgggaattgtctattcatgtccttagcccactttttgatgggattgtttgttttttttcttgctgatttgtttggtttttttgtagattctggatattagacctttgtcagatgcatagtttaccaagattttctccactctgtgggttgtctgtttactgattatttcctttgctgtgcagaatctttttagtttaattaagtcccatctatttgtctttgtttttgttgaatttgtttttgggttcatggtcaggaagtctttgcctaagccaatgtctagaagggtttttctgatgatatcttctgggacttttatggtttcaggtcttaaaagatttaagtctttgatctaatcttgagttcatttttgtgtaaggtgagagatgaggatccagtttcattcttctacatgtggcttgccagttaccccagtaccatctgttgaatagggtgtcctttccccactttacgtttgtgtttgctttgtcaaagatcagttggctgttaagtatttggctttatttctgggttctgtattctgtttcattggtctatgtgcctatttttataccagtaccatgctgtttcggtaactatagccttttagtttagtttgaagtcgggtaatgtgatacatccagatttgtgggttttggggggttgtttttgtttttgctgagtcttgatttggctatgtgtgttccttttcagtttcatatgaattttaggattgttctccctagctctgcaaagaatgatggtgacattttgataggaattacattgaatccgtagattgcttttggcagtatgatcattttcacaatattgattctacccatccatgagcatggaatgtgtttccatttgtttgtgtcattttcaatttctttcagcagtgttttgtagtttttcttgtagatgtctttcacttccttaggtatattcctaagtattttattttttttttgcagacatagtaaaagagtttgagttcttgatttgatttgcagcttggttgctgttagtgtatagcaatgccaccgatttgtgtacattaattttgtgtcctgaaactttactgaattcatttgccagttctaggagctttttggatgaatctttagggttttcttggtgtatgatcatatcatcagcaaacagcaacagttcgacttcctctttactgatttgatgccctttatttccttgtcttgtctgatccctctggctaggacttccagtactatgttgaatagaagtagtgagactgggcatccctgtcttgttccagatctcaggggaaatgctttcaacctttctccattcagtataatgttagctgtaggtttgtcatagatggcttttattaccttaaggcatctcctttctatgccaattttgctgagtgttttaattataaagggacactggattttgccaaatgccttttctgtgtctattgagatgattatgtgatttttgtttttaattgtttatgtggtacatcacaattattgacttgggtatgttaaaccatccctgcacgcctggcatgaaacccacttgataatggtgtgttatctttctgatatgctgttggattcggctagctagtattttgttgaggatttttgcatctatgttcatcagggatattggcctgtagttttctttttttttgttatattatttactggttttagtattagggtgatactggcttcatagaatgaattagggagggtttcctctttctctgtattgtgggatagtgtcaataggattggtatcagttcttctttgaatattggatagaatttagctgtgaatccatctgattctggactttttgtttgttggcagttttaattaccatttcagtcttgctgcttgctgttggtctgttcagagtttctatttcttcctggtttaatctaggagggttgtatgttttcaggaattcacccatctcctctcgattttctagtttgtgagcataaaggggttcatagtagccttgaatgatcttttgtatttctgtggtatcaatctaatatctccatttcatttctaattgagcttatttggatcttctttgcttggttaatctaactaatgatctgtcaattttgtttatcttttcaaagaaccagctttctgtttcatttatcttttgtgttttttgtttgtttctttctttgtctcaatttcatttagttctgttctgatctttgttgtttcttcttctggatttgggtttggtttgttcttgtttctctggttccttaaggtgtaaccttagattgtctgtttatgctctttcagactttttgatgtaggcattcattgctgtgaactttgcgtttagcaccacttttgctttatcccagaggttttgataggttgtgtcacttttatcattcagttcaaaggatttttaaatttccaccttgatttcattgttgactgaatgatcattcaggagtaggttatttaatttccatgtatttacatggttttgagggttccttttggagttgatttccaattttattccactatagtgtgagagagtacttgctataattttgattttcttaaatttgttgagacttgttttgtgtcctgtcgtggtctgttttggagaaggatccatgtgctgatgaatagaatgtatattctgtagttgttggtaaatgttctgtaaatgtctgttaagtcaatttgttctggggtatagtttaagtgcattgtatctctattgattttctgtcctgatgacttgtctagtgccgtcagtggagtattaaagtcccccactattactgtgttgctgtttatcttatttctaaagtctagcagtaattgttttataaattagggaactccaatgttaggtgcatatatatttaggattgtgatattttcctgttggacaaggccttttgtcatgatataatgtctctctttgtcttttttaacttgttgctttcaagtctgtttcgtctgaaacaaaaatagctacttctgctagctttctgtgtccactggcttggaatatcttttgttgttgttgttgttgttgttgtttttgtaatttaattttattttttattatacttcaaagttctagggtacatgtgcacaacgtgcacgtttgttacatatgtatacatgtgtcatgttggtgtgctgcacctgttaactcatcatttacattaggtatatctcctaatgctatccctcccccctcccccaaccccatgacaggccccagtgtgtgatgttccccaccctgtgtccacgtgttctcattgtttaattcccacctatgagtgagaacatacggtgtttggttttctgtccttgcgatggtttgctcagaatgatggtttccagcttcttccatgtccctacagaggacatgaactcatcctgttttatggctatatagtattccatggtgtgtatgtaccacattttcttactccagtctatcattgatggacatttgggttggttccaagtctttgctatagtgaatagtgccacagtaaacatacatgtgcatgtgtctttatagcagcatgatttgtaatcctttgggtatatgcccagtaatgggatggctgggacaaatggtatttctagttctagatccttgaggaattgccacactgtcttccacaatggttgaactagtttacaatcccaccaacagtgtaaaagcgttcctgtttctccacatcctctccagcacctgttgtttcttgactttttaatgatcgccattctaactggtgtgaaatggtatcttattgtggttttgatttgcatttctctgatggccagtgatgatgagcattttttcatgtgttttttggctgcataaatgtcttcttttgagaagtacctgttcatatccttttcccactttttgatggggttgtttgattttttcttgtatatttggatattagccctttatcagatgggtagattgtaaaaattttctcccattgtgtaggttgcccgttcactctgatggtagtttcttttgctgtgcagaagctttttagtttaattagatcccatttgtctattttggcttctgtgccattgcttttggtgttttagtcatgaagtccttgcccatgcctatggcctgaatggtattgcctaggttttcttacagggtttttctggttttaggtctaacatttaagtctttaatgcatcttgaattaatttttgtatcagctataaggaagggatccagtttcagctttctacatatggctagccagttttcccagcaccatttattaaatagggaatcctttccccattgcttgtttttgtcgggtttgtcaaagatcagaaggttgtacatgtgtggttttattaccgagggctatattctgttccattggtctgtatctctgtttttgtaccagtaccatgctgttttggttactgtagccttgtagtatagtttgaagtcaggtagcatgatgcctccagctttgtttttttggcttaggattgtcttggcaatgcgggctcttttttggttccatatgaactttaaagtagctttttccaattctgtgaagaaagtcattggtagcttgatggggatggcattgaatctataaattaccttgggcagtatggccattttcatgatattgattcttcctatccatgagcatggaatgttcttccatttgtttgtgtcctcttttattttgttgagcagtggtttgtagttctccttgaagaggtccttcacatcccttgtaagttggattcctatgtattttattctctttgaagcagtcgtgaatgggagttcactcatgatttggctctctgtctgttattggtgtataggaatgcttgtgatttttgcacattgattttgtatcctgagactttgctgaagttgcttatcagcttgagatattgggctgagacgatggggttttctaaatacacaatcatgtcatttgcaaacagggacaatttgacttcctcttttcctaattgaatactctttgtttctttctcttgcctgattgccctggccagaacttccaacactatgttgaataggagggtgagggagggcatccctgtcttgtgccagttttcaaagggaatgcttccagtttttgcccattgagtatgatattggctgtgggtttgtcataaatagcttattattttaagatatgtcccatcaatacctaatttattgagagtttttagcatgaagggctgttgaattttgtcgaaggccttttctgcatctattgagataatcatgtggtttttgtctttggttctgtttatatgatggattacgtttattgatttgcgtatgttgaaccagccttgcatcccagggatgaagccaacttgattgtggtggataagctttttgatgtgctgctggattcagtttggcagtattttattgaggattttcacatccatattcatcagggatattggtctaaaattctcttttttttattgtgtctctgctaggctttggtatcaggatgatgctggcctcataaaatgagttagggaggattccctctttttctgttgattgggatagtttcagaaggaatggtaccagctcctctttgtacctctggtagaattcggctgtgaatccatctggtcctggactttttttggttcataggctattaattattgcctcaatttcagaacctgttattggtctgttcagggatccaccttcttcctgctttagtcttgggagggtgtatgtgtccaggaatttatccatttcttctagattttctagtttatttgcatcaaggtgtttatagtattctctgatggtagtttgtatttctgtgggatcggtggtgatatgccctttatcattttttattgcatctatttgattcttctctcttttcttctctattagtcttgctagcggtctatccattttgttgatcttttcaaaaaaccagctcctggattcactgattttttttgaagggttttttgtgtctctatctccttcagttctgctctgaccttagttacttcttgccttctgctagcttctgaatgtgtttgctcttgcttctctggatcttttaattgtgatgtcagggtgtcaattttagatctttcctgctttctcttgtggtcatttagtgctataaatttccctctacacactgctttaaatgtgtcccagagattctggtatgttgtgtctttgttctcattggtttcaaagaacatcttttatttctgccttcattttgttatgtacctgatagtcattcaggggcaggttgttcagtttccatgtaggtgagcggttttgagtgagtttcttaatcctgagttctagtttgatcgcactgtggtctgagagacagtttgttataatttctgttcttttacatttgctgaggagtgctttacttccaactatgtggtaagttttggaataagtgtgatgtggtgctgagaagaatgtatattctgttgatttgggatggagagttctgtagatgtctattaggtctgcttggtgcagagctgagttcaattcctggatatccttgttacaactttctgtctcgttgatctgtctaatgttgacagtggagtgttaaagtctcccattattattgtgtgggagtcgaagtctctttgttggtctctaaggacttgctttgtgaatctgggtgctcttgtattggatgcatatatatttagaatagttagctctttttgttgaattgatccctgtaccattatgtaatggccttctttgtctcttttgatctttgttggtttaaagtctgttttatcagagactaggattgcagcccttgcttttttttgttttccatttgcttgttagatcttcctccatccctttattttgagcctatgtgtgtctctgcacgtgagatgggtctcctgaatacagcacactgatgggtcttgactctttatccagtttgccagtttgtgtcttttaattggagcatttagcccatttacatttaaagttaatactgttaggtgtgtatttgatcctgtcattatgatgttagctggttattttgctcgttagttgatgcagtttcttcctagcagcgatggtctttacaatttgtcatgtttttgcagtggctggtacgggttgttcctttccatgtttagtgctgccttcaggagctcttgtaaggcaggcctggtggtgacaaaatctctcagcatttgcttgtgtgtaaaggattttatttctccttcacttatgaagcttagtttggctggatatgaaattctgggttagaaattcttttctttaagaatgttgtatattggctttcactctcttctggcttgtagagtttctgcagagagatctgctgttagtctgattggcttccctttgtgagtaacctgacctttcagtctgacaattatgtgtcttggggttgctcttctcgaagagtatctttgtggcattctctgtattaccagaatttgaatgttggcctgcctcgctagattgggggggttctcctggattatatcctgaagagtgttttccagcttggttccattctccctgtcactttcaggtacaccaataagacgtagatttggtcttttcacatggtcccatatttcttggaggctttgttcgtttctttttactcttctttctctaaacttctcttctctcttcatttcattcatttgatcttcaatcactgatactctttcttccacctgatcaattcggctactgaagcttgtgcatgcatcacgtagttcttgtgccatggttttcagctccatcaagtcatttaaggacttccctacgctgtttattctaggcagccattcatctaatcttttttcaaggtttttagcttctttgcgatgggttcgagcatcctcctttagctcggagaatttgttattaccgattgtctgaagccttcttctctcaactcgtcaaagtcattctccgtccagctttgttctgttgctggcgaggagctgcgttcctttggaggagaagaggcgctctgatttttagatttttcagcttttctgctctggtttctccccatctttgtggttttatctacctttggtctttgatgatggtgacgtacaaaatgggattttggtgtggatgtcctttctgtttgttggttttccttctaacagtcaggaccctcagccgcaggtctgttggagtttgctggaggtccactccagaccgtgttagcctggttatcaccagcggaggctgcagaacagcgaatgttgcagaacagagatgttgctacccgatctttcctctggaagcttcgtctcagaggggcacccagctgtatgaggtgccagtcggcccctactgggaggtgtctcccagttaggctactgggaggtcagggccccacttgaggaggcagtctgtctgttctcagatctcaaactctgtgctgggaaaaccactgctctcatgaaagctgtcagacctggatgtttaagtctgcagaagttactgctgccttttgatcatactggtgaccagggaagcgggggaaagccggcagtaacaggcctcacccagctcccacaaagcccgaaaggccagtgccactcccaaggtgcctcttccagcagcactgagttaatttccaggcagctgctgagcagtattgagaagctgccccaggctatatgccctccccctcccccgaggaagtaagcagggctttcaggtttcacgcttccctacctgccgtggtttctttgctgctttctgcactgcctgtttgcctcctcccccgattctgtccaggaaacttcatgtttgtttgaaactgttacacagttcagctggaagtttccttctccttggggtctttccccaattccactggcagctctccccaagggcctctgtgagacaaagtcaggaatggcttccctggtgacagagagtgcccacagggctcttctgcttcttcctttatccctatatttctcacagctctctaaattaatctcagctccaggtgaggtcacatccttctctcgtgaattggccctttgggatccccagtgaggatgtgtgttcagaggcagacattccctttcacacattgggcactcagagttttttggctgtctcaggggaccagcagctgtaaactgcttcctttgaaaggtctatggattctctcggctttcctggtacgttcccgtggtagtagttcttcgagtaaaagttcacggtgtgagtctccacacactactcggtgtgtctgagtgggagctccaagttagttatgcgccctgtctgccattattttcccattttgagttagttttcatatattgtgttatgtaaaagtccaacttcattcttttgcatgtggatatccagttttcccagcaacatttgttaaaaacctgtccttttcccattgaatggtcttggctcccttcccaaaaatcctttgaccataaagtgagatgctttttttcctctgaattctttatttcattgttctgtatgtctgttttcatgccagtactgcactatttttattaacgtagctttgtagtaagtcttgaaatcagtaagtatgagttttctagctttgtacctctttttcaaaactgttttggctattcagggtcccttaatattccatatgaattttagaatggatttttctctttctgcagaaagcattgttgggatttcagtaggaactgcattgaatctgtaggtcactttggatagtattgacatcttaacaatattaagttttctaattgatgaacatgtaatgtctttctaattatttatgtattctttaatttcttaaagcagtgttttgtagtttttgtcgtacagatctttcactgtcttggttaattcctaaggtttcttttttttgctgttgtaaatggaattattacttcaagaagtgttctagttagtgcgtaaaaatgtaactcatttttgtgttgactttgtatttgcttctttgctaaattaatttattagttctaacaggtttttttttttttttggaatctttagggttccctgcatataagatcatatcatttgtaagaagataattttactttttctttccagtttggttgtcttttgtttctttttctttcctaattgctctgggtagaacttccagtactatgttgaatagaagtgatgaaatcaggaattcttgccttgttgtagatcttagaggaaaagctttgagtcctttaccatttgatcttaaaggaaaagcttttagtcctttaccatgtgtctgatgttcactgtgggtttctcgtgagtgtttatatcatgaaagcatattgaattttgtcagatactttttctgcatcaattgagaggaccatgtagggtttttttttcctccttaattctgttaatgaggtgtattgccttgattgatttccatatgtacaactatccttgcattccaggataaatcccacttggtcatgatgtatataatcttttaatatgctgctgaattcagtttgctagtattttgttgagaatttttacatcactgttaataatggatattggtttgtagttttttttttctctttttaggttgctctcatttctatttctaaaaataattttaattgacacagtcattgtacatatttatggagtacatagtgatgttacagtacatataatgtatcagggtaattagcatatccatgatctcaaacacttctttgtgttgggaacattcagtatcctcctcctagctgtttgaaactatattattattgttaattatagtcatcctacagtactatagaatacaataacttatttctccaactattatcattagctgtaattttgcatcctttaacacatctctccctatgcctcccttccccttcttggtttctactatcctttgttggtttgtggttttcttgtgtgtctttgtctggctttggtatcagggtaatgctggcctcacagaataagtcaggaagtgttccctcctcttctgtttttttttttttgtttttttgtttttttttttggaaaagtttgagaaggcttggttttagttctttttcacatgttgagcagaattcaccagtgaagccatcatgtccagggcttttctttgttgggaggtttttgattactcattcaatctccatactgatataggattttcagattttctgtttgttattctgtttcagtaagttttgtgtttctcacagtttttcctcatctaggttatgcagttgttgacattcggttgtttatagtatcctcttatcatcctttgtatttctgtgaaactattagcaatgccctactttcatttctgatttcagtaatttgagtcttttctttttttcttagtctagctagagatttatcagttttgttcctttttgaagaaccaacttttagtttcattgatttttccatgttgctttcctgtttcccattttgtttatctctgttctttattgttttatttcttctgctagctttgggtttagtttgttctttttctggtttttaaagttgtaaaaataggttcttgaattgagaactttctttttgtttcgtgtgttaataactataaatgtcttccttagcactgctttatctgtgtcccataaattttcttatgttgtgtttttcgtttgtctctaagtattttctaattactcttgtgattgattcttcgccccattggttgtttgatttccacgcatttgtgaattttccattttccttcttttattgatttctaacttcattgtattgtgctcagagaagatactttgtatgctatctgtcttttaaaatctattaacactttatttgtggcctaacatggtgtatcctgggaaatatcccctgtgtacttgagaacaatatgtatttggttattgttaggcagaatgttcagtctatgtctgttagaccaagttggtttattgtgttgttcaagttctccattctgtgtggttctgttaattattgagagtggggtactgaagtctcccaactgttatcatagaactatttctcctttcatttttttcacctttggttcgttcatctcagtggtctgttattaggtatgtaagtgtttatatagctgacccctgaacaacacagaggttagggatgctatcccccccacggaaatctgcatgtaacttttgacttttctaaagtttactaatagactgccgctggaagtcttactgataatgtaagcagttgattaacacattttatatatgtattatttactgtgttcttatgataaactacagaaaataatgtattaagaaaattataaaggagagaatttatttacagttcattaagtggaagtagataatcatgaatgccttcattcttgtcgtcttcacattgggttgaggaaaaggaaggattggtcttgatgtcttctgggtggcagaggtagaagaagatgcacatatagatggacctatactgttcagacccatgttgttcaagggtcaactataattgttatatcttttgctgtattgaatcttttattaatatataatgtccttcttgtcttttgtaaccttttttgatttaaagtcaattttgtctgatattagtatggcacttctgttctctttgttcttgtatgaatggaatatctttttttcatgccttcactttcaccctgtttgtgtctttgggcctaaagtgagtctttagtagacagcatgtagttggatgatgtttatcaattctgcaaatctctgccttttgattagagtttaaccatttacatttaaaatcataaggaggaacttctgtcattttgccatttttttctatgtgctttgtagctattttgtccttatttcctgcattactgtctcatttctttttgtgtgtattctataagctattttctttggttactgtgatgattacacttaatatttaaaaattacaatatttataccagcttaatttcagtaacataaaaaaattatgcttctttacaattccatccccaccacttattgatgttgcagaattatatctttatacattgtgtgtcaaaaaatataaactaattttttaatgtgttagtctcaagttatgtaaaaaaatgtggagttccaaagttacaataatactagaatttataattgcctatgtatttactgtcactgcaatttttattttttcatatagctacaagttattatctagtattcttttgtttcgactgggagaattttgctctacagagcaggtcttttggtaataaactctctcagctttttacttgagaatgttttatttaagaatgtcttgagaggctgaggcaggcgaatcacctgaagtcgggagtcaagaccagcctgaccaacatggagaaaccctgtctctgctaaaaatacaaaaaaattagctgggtatggtggcatactgctgtaatcccagctactcgggaggctgaggcaggagaatcgcttgaaaccaggaggcggtggttgcagttagccacgatcgcgccattgcactccagcctgggcaacaagagcaaaactccgtctcaaaaaaaaaaaaaagaagagaatgtctcagcttttgttttaaaggacggtttttgtggatgtaggattcatggttggcatttttttttttgttttattatcttaattatattggcctatgccttctgtcctccaaagtgtctgatgagaaatctgataattttattgaggactgcttatgtgtgattagttacttctttcagctttcaggattttctctttgcctcttagtggtttcattataatatattttgctgtgagtctccttgaagtcattctacttggagtctttttcagcttcttagatgtttatattcatgccttttattaaaattgggattttcaaccattgtttcttcaaacattttttctctctccattacttgggactatgacagtgtttatgtaggcctacttgatggtgtcacaagtcccttaggaccttcacatttcttcagccgtttttctttgttttcctaagactcaataatttcaattgttctctcttcaagttcactgattctttttttcttcctgtctagatctgcctttcagtctctctagtggatttttaatttcatttattgtacttttcggcttcagaatttttgtgtgtatccttttaggttttcattctctgtgtttctcttactctgttgcttttttttttttttttttttttttttttttgaggtctcactctgttgctcaggctggactcaaactcctgggctcaagcaatcctcccatcccagcttcctgggtagctgggactgtagttgtgcacactgtgcctggctcagattttccatgtctttattcatatttccattttgttcatacatcattttcttaacttggtccacattttcctttagttctttgagcatttttcagaaagttgttttatagtctttgtttaacagatctaccatcgggtctttttcagggacaatttgttagtttattttctttcttttagtgggccatatttttctgtttctttgtataccttgtgacttttttgttgaaaactggatgcttaaatttaatttaatgtggtaattctggaaattaggtagtatcccttcctcagggtgtgctttttttctttgttttttttttttaattgttgcagtctctttgccaaagatcagtctgagattttgtacaattaaggtattttcaggtcttttctgtgcctgtgccttaagctggatatgtaatacaatagtccctctttatccctgcttccactttctgaagtttcagttatggtcaacagtggtccaaaaatattaaatggaaaacttcagaaataaacagttcataagttttaaattacatgctttctgagtagcatgatgaaatcttgtttcaacctgcttgggacatgaattatccctttgtccatcatatgcacgttgtatatgttactcacccgatagtcacttagcagctgtcttgattattaggttgactctcgtggtattgcagtgcttgtgttcagttcaataaagttaaggttcaataaagttaaaataaaggttcaataaagttaacctttattttacgtaatgaccctagggcacaagaatagtgatgatggcatattgtcatgattttttttattatttaatatcttattgtgcctaatttacaaattagactttctcataggtgtgtatatttaggaaaaaacatagtacgtgtaaggttcagtactatctgcggtttcaggcatccactggggttctgggaacatattccctgtggataaagggggactactatagtgaatttctattttcccttgtatatgcagtttcttttgaatgcctcagtccttgatgtttggctcctaaaaaaaaaggaaaaggacaaaaatgaagagggttggggagagcaccagcctttaagttccttggcagttacctcagctagagggggaggggcttgcatcagtgggtggaggtacaaccacaatggctgccagcccctgcacctatatcttcgtgatcagaagtagcagtcaacagtcagaacacccattcctgatatttggaggacggggtccttattgcccaccctaactcccacagctacatataagctgctccacaaacacgtgcacagttgcctgcctgtgggagtgagggtggggtggggtcggtagctgctgctgagcaaataactgaaattgactgaaatcagccacagtttaccttactgtccaggactttttcttgaagtttgaagttttcagtatactttgagagcttcataatagttgtatgagatagattctaccagcgtaagtgttctctgggtatacagactcattcttggtgctttctactctactgtcatccaagaatcctctaacttaatcatggattcttcgtatctcacaacacatcttgtctttccatttactcgttttattttagatcctttatggaattatagttttctttatgtagagcctatacatttatagttttgttattctttgttacttatagcttttttgtttgctattgaaacgtgaccttccattataagtcgcatattatctgcatataaaaagtgattgacttcacatactttgtaaatggcagccttaagtgaatttactggtttttttggacagcattttagtattttttccgaagatggccatagtatctgcagttaatgatgactttctcacctcttctgaaatatttgtacctttatcttcttgtgcagttggattggctagtgcttccagtattaaatagtgttgataacctgcacccttgtcttaaatggatactttgtgcatataagtatagaaacaggagcatgatgcagaaagaacaagctcttcaagaataatctgcttccaggtatgtcttacagccttctgaaccttgtaatggataaggatcagcctactcctgggacaggcagataggacattcgtggagaaagaatattggatgttcctagaaagttttcagtgtgataaagcagtataattttctcccaaccttgggtattgtagaacctttcactcacgtccgtgtgaagagaccaccaaacaggctttgtgtgaacaataaagctttttatttcacctgggtgcaggcgggctgagtgcgaaaggagagtcagcgaagggagatggggtggggccgttttataaaacggcctatttataaaaataggatttgggtaggtagtggaaaattacagtcaaagggagttgttctctggcgggcaggggcgggggacacaaggtgctcagtgggggagcttttgagccaggatgagccaggggaaggaatttcacaaggtaatgtcatcagttaagggaggaacaggccattttcacttcttttgtgatttttcagttacttcaggccatctggatgtatacgtgcaggtcacaggggatatgatggcttagcttgggctcagaggcctgacagaacctgttgaggttgcaaaaaatatttgtgactcttggaacagtaacaaaaagttgttctgactttttattttctgaacctggaattgtgggactattttaaagggtataatttcaactggagacttggggagcttgattttgacttgattgcgaagcatctgtatagctcatgttgtatgtccagtttatggctttgtattatagaaatgtatttaaagcttcaaatgatgagaccatgcataatttcatggtgggcagattctttttttttttttttttttttggttttaaggagcggagagtttaataggccagacagaagggagaaggcagaaggaagaagctcccccgtacagagacagagggagggaggctccaaagccaagagaagggatccccaagtgcggtggacaccagccaggtatatatgcagaggctggagaaggtggtgttcgatttgcatagggctccggggattgggttgactaggcgcatcattcacatagctcatgaaaaagctggctcttccaccctggtcttttaatatgcaaatacatggcgccatgatgttctacgctcgtcgggattccaggaacatgtagggcaagggcaagaaggctgtgggaatctccatgtttgggtggacccagtttctaatggcctaaatttgcatatgaaaggttgctggcctggctttaacagccgtggctttacaagaaacttttctggagatgctttaaaaaatgaaaactttccaaggacccctttttcttctctgcctaaaataatttcttaataactcctacaacattcccgcctgtggagatgccacactaactgctgttagagggttttgggcaacaactccttctggctacttactgctgaaaaggggcatcatatggggaacagcaactagggctcctcctggggttgatctaaggatcctcggaagaatggcatgtccatgtgtggatcagtttgcagcaccatttggagattgattgcttctaggtgagagttacagtattgagtatacagggcccagatatcaatacaagacatataaacaagagaaggcttaaaaaaggagttaaccaattccttaaggaagactggaatgtattaaagaagaatttgtagccacccggggctgaagctggcgttttccctgagcctgtcaataattttgatttgatctttaagtacctgtagatttttctctactttactagaggtgttaatcacccctaaacccaaaaaaagtcctagcagactcagtgatagtaaaactttcatgcttccttgtcagtaactattattcctgctctaaggataataattaagcaaaatacaacagcaatggaaactctgtccaatatttcagttagaaggtgctaccgtgtgtatccctattgcaaacagtagagtgagtatagcagttcccacaagtgtggtgtagtagataatttccatctaaaattttacttgccaagataatttccctttggtggtctatgaagctttggttttattttcctaaacaaagaaaccttcgggttatggataccctacttacttttattacctggcagaatttgcaggataatttcccacaattagtatagtgattcagatttttacattacccatccctttttctttcttccaagctgcagaagattaccacttgagtcacaggaataagcagggttaatttaaaatgtaggcaaaaagcttaaaaacaattaatgagactaggatttaatgacaaatgtatgataagctttggagcaaaattttctctccagttctcatttttggtaaaagctaattgtgaatgaactttagtcttatacttggcctgattatttgcatgaagtgttagcaagaatggttatttctacataggtcttttggatggctttgataaaactcagttccacaaggaatcttagataagacctttaaagcctaggccagcaatgggtttctatcctcaaatacctgtgagttaggtgatcctctcttcttgaggtcccaagaaactcggagcttccagacctgttagaaagtgacgttctttactgaccacaggttaggagccctgtgcggggactgtgtagacaaggtatgatgccagttctcccaggggctttttattggctctgcgtgtcaagcttgattccttaaagggaaacacaccctttcagtcaaagccttggtataataaccagtttttccaattgtgtcctgttgagaaagaaaaatggattcttactgcactaatgcaaacaactatattgccataagttaagagtaattacagttagtctccaaattatagaggaaccaggtggggaaaaatgaacattgttacttatgtccgtataagagaccacctgagcaggcttagtgtgatcaacaaggctgtttattcacttgggtccaagtgggctgagtcagagaaaggagtcattgaaggatagtgggattagcattggtttttaaaggtttgggataagtggtggagtcaggagcaattttttgtgggtaagggatggatgttgcaaagtacattcacaagggcggggaggaatgtttcagagtacattcacaagggaggggagggtgtattgtcacaagggctgggaggaatgttacaaagtacattcacaaggacagggaatatcacaaagtacattatcacaaaggcaggggaatgtcacgatggcttgaccatggtgcagccagctcagaggaccttacaaaacatgctccaaattttgtttacagtagtataccttactcaattattaaaaggtcataaatagtttagaataagtttccttgactctgaaaaaccaaacaaggatcaacaatattccaagcaaaagttaaaaagttgcttaaactttttgagtgcagtccacttagttaactcttgttttgcttgatatttgtgagcatgtcagttctttaggagtcccatatcttctttctcaatttcagtgttacaatcttcaaagctattaaaaacctgcagttaaagtccttaatatagcttgattataaaccgtcttttgagaaggaacaaagcaagacaacaattgtctgcaaatgacaaaattttcaggatagctacagttaaaaacatgactgataatttatttccatggtttacagtaactttagccttaattgtgattgacagcatgtacttcggcattagaattttagaaatcccatacaattttggaacgtatattagtattatttaccgaaatataatttaaagaagattggacatcattttggcaatcttatgtgactaaacatgtcagatgattccgtctaccttttctctgaatgtttcaggggccctctgagccatccagaaagccaggcatcaggaaggacaatttccagattggcataaatattttgccaaaatggtgacttaaaaggcaaaaatctttcattagcctttactgtgacatgaaaattttgtttaaatccaaattttacccttgcactagtttattaatgttaaccccaattagtttaaatgaaaccttatggattatttcatctaattttatccactttgaccatgaggtaaaaatctttacaaaccttttataacctttttactaaagggcagattagtgccttaagaccctcttgctatgcgtttatttcaatgcttaatttatgaaaagaacatataaatatcatgggagaagacactgtagttcttctaccatgcatttcattgcaaggcaacccaaagccaattggcttattttgtaatcagtccatccctgatgggaggctcatctcccagtggggggtagggatgtttccttatcttccaggtggccaagagcatgctttctaatttataactactattagccatccctacagtgtattttctacttagttattacacaccaaagcttttcataatgtgaagtaatttgataccccccaaacttaaaacacagtagataacacaatgcaaaacagaatagagcctttgattttgagagggatccatctccttttaattcctgggatttcatgaggaaaaaaaggtttttttcccaaaacagggtctgtggcatctcctgtttttcccaaggagttccatgctaccagaagttatcttaggacctctcatgcatgcattaagagtggtaagacaaaaaatggagaaaaataattcagtcgactgaggagagcctttttccagaaaaacaagatccaagaagagaaaaacataaaagccttttaagtatacctataacttgaatatccacttttaattaagctgagcactctttaaggaaatccttttaaatcccctgttacttgactttagccatgccaagcagttaagattttcggctttcgaactttcgaaagtaacctcacaggtgaaaccaacaaggcttaatcaggtaatgactcaactgagggtgtacagagtattttcaaaattgagactgagacagtgaaagagatccaacccaagcaactccatttggtttccagcccccaagctgtccttgcccatcccaggggtaggccgaacaaactttcggagaagccgggtttacattctccagtcgaaaacaaagatgataatagccacttcccatgatatactttccacttgcctggggaccagaccaggaagctagctacaagactagaaaccttggcccaggagccatgcagctggaggctacaagattttgaccctccttaaactgctctcaagatcaggcttaagatattttgtaaaccctgcctctgatggatcagctggtaccatccaggttgactaactggattatctgattttgtggccctcacccaggaactgacttagcacaagaagacagccaccattgtaaaatggtggagactaaaacaaagtattgccacgcggttacagatcgtgttcccaaggacgtgaaacaagatggaggctgtagccaagtttgccaccgactgctttgctgggctggcttgaacagcaggcttacggagtcctgggcctgcatcctaacctaaggtaccctttctttgacagaaccatacagaaagagacatgcaaagcacaccagattgtttataactgaagaccaacctcacaaatccttcttcattaattataaatttacagagaatataaacaatgatccttattatccctttgccagtttgtgccgggagagaaaagccaaaagcccgactggtaagaaatttttacacttttgccagcatatcaggcttctgggttccctttccccctagcttaactttaagccaagcattttaaggtttggaaaattagcctttttcaggttggaagaacattataaaagagacagaagccattttaaaccgcgaaagaaggaaaaacaccatagaaaggaattccagttagggttttcaagaagtattgcctctcttcctattgggaatagtgtttcctctatttctttgccttccctattttttcttttcccttttggcgtactgtaggagacatattgcttatctccaaaattctcttctgcttgcagagctgcctgttttagctgcagtgagggcttgagttagcagcaacataacatcctcccgtgtgaggttaaatacctgagttaaattttggaaagtctctgtatacctatttcgggtcattagaaaatcagtctaagtctccttttacttgcctaaggtcctgcaatgagcagggaacttgaaggtgccccaaataagggggacccctagatgatttccctgaaagttacttttttttttaattttggggaactattttccctgggcctgcccaatatggtgctaaaagatctgagttgatcttacaacgcttgcagaggtttattagaaatgccatgctcttctgcaaaagaaaatgagttgctttctttaaagttctgaggttaaggaagttccagtgtttgagagtgcactccagaggggtgcaagctgaagataatttattacccatttagaaaaagaagcgagaataaaagcattttcttagtctccttcctttctgtatgacccagagtggaggagaagacggggtatcctctgaatgtcttaccttcccagtttctggattccggcaccttcttaaatgtgctcccccatggttgtaggcatggtcctccaagctgtggatctggatgaactaagtaatggggctaaccacatctacccaagcagccttagcttatccgccttgtgtgatttctctttgacttcctagaaccagtgtgatttgcctggatcccccctcccccagccaaaaaaaacatctggagaggctgtcacctttcgggcaaggctcctttaacggaggcaatgtgctatagattgcctgctattacggcccatgctataaagcacttacccttgaaagaaaacagttccagttaacttccgaacttaaacttcccttactaattaagtactatcttaatcggagacagaatagatgccttaaaagaacgtaggaatagaatggccgttttcccactgatgggacaatatcgggactaaaatctggctgccgaagacattttactgctaacttaaaagcataaacttccgttctcagaagagtcctagagcctgatttctgctaagtggcttagaaatgaccatgtgcttcccagagaaaccatagagagagagagttattgagtactgcctgctgtaattctctttcttttctaacagacctctttttcctaaactgtaagtattcctgcacattagacacacacacacacagggtaagagattgtggataaaaagagaaaatttggcgacagggtagatggaagagagtattgagattataggacagatttaaagttgaaatccgctgcatacttaccagtctgatgaatgaacttcctttaccggccaatgcaccaaaatgataatggttctgatgagtgaaggaacaccagggttcttggtactcatgctggcttagataaaacgacatggacacacatggaggggttttaaggagcggagagttgaataggccagaaagaagaaagaaggtagaaggaagaagctcccccatacagagccggggagctgagggggtgggggggctccaaagctgagagagggaattcccctacctgcccccaccttttttttttaagagacatggtcttgctacatcacccaggctgcagtgtagtggtcattcacaagtgatcctcctgcctcagcctcttaagtagctgagactacaggcacatgccacctgcacctggcagtggttaaaatcttaatgattatgtgggcacatgctttattcgctgatggattatttcatttttattcctttttgtttaataagatagaaacttctttaaaagctttgagaaaactattgaaaacttaagaggtgtaggcatgatttgaaatacaacagaagcagttcttttgtttttatgtatttccttaaagaagcaaagtctcactctgttgcccaggctggagtacagtggtacaatcatagttcattgcagccttgtcctgagctcacgtgatactcccaccttggcctcctaaaattctgggattacaggcatgagccactatgcctggcccagaaacagttttgtttggtaaatcaggcagcatagataccgtttgagaaaaatcatttcaattgtagctctcccctccctgccgcaaaaagctagatggctcttgcaagctgagcggtatgttagatactggtgagagaaagacacatgagcccatagctgccatttgcggggagctttactgatgagtatatagtaaaggtgtaaatgaaggaataaggaaaaatttgatgggatagtattatagtttggccgtgggagttaggaaaggggagcagtggaaagtgctgaaactaagataacctttaaaagttagttacaggtctgtggagtagacaaaatcaggccaggcactccagtcataaagattaaaatggtcagtcatctgtataaaaggccatggaagtcttggagaaaggctcagtgtaggcttagggatggggaatgtcagaaataaaatgacagaaaggtgaactagagctagaccctgtgtaccaagttaagcagttggatttaattttgtggcattgaaaagtattatatttttaagacaggactgttaggtgaagtctctatggggttgtttgcagatagtagtaaaatttattggcccaacgaaaaatgaacaaataatggaaggagaaaagtgtcatcagagtggttaaaatggagcaacgtagagatattagatttgggggtgggggatgaataaggtgagctgctttgccccctcattacaagctagttcttgtgtattgcactagtgcctcataaaaagaatcatagcaactctgagaggtaagatattctgttttgccttattttgccttctgagagtttacactgaaacagtagaagatgtgctagtgactatatctttggctcctagtacaatatttaacatttggaaaggtccatttggtagcaccttccaaagattacagaaaaccttgtaattgggtttaaaatcaaattggtatacatctcaaaccgtgtttctatttttttttttttttgagatggagtcttgctctgtcgcccaggctggagtgcggtggtgcaatctcggctcactgcaagctccgcctccgcagttcacgccattctcctgcctcagcctcctgagtagctgggactacaggcgcccgccaccacacccggctaattttttgtatttttttttagcagagacagggtttcaccatgttagccaggatggtctcgatctcctgaccttcgtgatccgcccgcctcggcctcccaaagtgctgggattacaggcgtgagccactgcgcctggcatggaaatagttatttttcataaaatacatgatttgtgttaacaggtagaaggtttaacattactgttttgaatagtttatacataggcttttaggggaatgaaaatattctatgatactataatgacagatatgtatcattgtacatttgtccaaacccatagaatgtacaacaccaaaagtgaaccataatgtaaactgtagactttgaatgataatgatgtgtcagtgtaggtttatcagttgaaacaaatgtaccctctggtgaggaatgttgataacaggaagctaggcatatgttggggcagagagtattgggaaatctctgttctccttcctctcagttttgttgtgaatctaaaactactctgaaaaaaataaagccttaaaaatttttcagttttaatttctaataaaaatctaatcaatagataaaacctacataaataaaaactatttggagattctcactaattaagagtttaaagggatcctaagattactttttgagagctgctcaagaaatatatattcattaaactcaatttagaaaaataatgttagttggcccttatccaattgaaatattagaagcattttaagtattttggtttattttcttctagtctttttttagtatcactttttttaagcacataattgtaataacattgtctataaaattttgtgtggaattgtatatgaaattgttgtatataaaatatttgtgttcacttatgttctaatatgttttcataataaaatgtaatcttcaacaatttagcagttgtataatctacttagtgggtatatcttaatttacataattttaccttgtattgattctgatttgggatattaaatctttttcatttagcacatccttggaagcttattatgtacaggcactgctcatgaatgctttttattttttattaagattttcttagattaagagttgagtggctgagtaaaaagaggggaatgtgctaaagagaatcttgtcttttgagttttttgtagtagcaggccatatagcaagcaattaaaattaataggaatttacacaactctgttagccagcatagggttgtggaaagttatggtaaattaatttaaagcacttagaagaatatccttttcaatgaataattactcagtgttagctatttttatttgctatattatattttagagttgagtgttctttttaatttgtaattcaaatatacaggtgaccaattctgaaacttctcccagtccccagacctgtatctccaacagcttgctcaacatttctacatcagtgtcctactggtgctttaaaatatggtatatgctgagcattgatctaaacaaaatctgtcatgtctttaaagtatctttattcttttttttttgagacggagtctcactctgtcgccaggctggagtgcagtggtgtgatctcggctcactgcaaccaagctccacctcctgggttcaagagattcttctgcctcagcctcccaaatagctgggactacaggcatgtgccaccacgcccagctgatttttgtatttttagtagagatggggtttcaccatgttggccaggatggtcttgatctcttgaccttgtgatctgctggcctcggcctcccaaagtgctgggattacaggtgcgcccagcccaaaagtatctttattcttccctcacacttgttgcatagtttgagtataaaattctaggttgaaaattatttttcctcagaatttcaaaggattttctccactgctttttagctttcaatgttgtgcaagtccagaaccacttactttctggtctcttgtatgtgaccttttgttcctctctctgaaagtttgcaggatggctttgacccacgcgtcctgaggtttcatgatatgtctttatgggtctgtttttatttactgtgctgggtatcattggatcctttcagtgtgaaaatgaaaatgtctttgaaatattgagttaatgatttcctcttctcttttatctggacctctaaagtgatctttagttttcacagttttttttcttattttccatcacctcgtctttcttgtcttttaactttgcttactttcagggagatttctttatctgatttacagctgttctatttgaggttttcaattttcttacattttaatttttaggagtcttttgtcttctgatttttaaaaactgataccttgttcttcatgaatgcaatggcatggtatcttttctctctcaagatattaatggtggtatgttgtttgtttttaagttttcatctcattgcataatctctaccaaattcatttaaatgtgactgtttgtctttttctttcttatcagagccattccttaaaatgtctggtgattgataactggtgttggtaatttagactagctaataaaaagcgaattgaaatgtctgtacaagttgttgggactaatcaccagtggtttttaactgtaggatgatcccactggagtgatatattgctcaacctcttaggaattccataatgcaaatccaaacaaagtggtttttaactttctgtatccaaaacttaaactgtagcagatgatgccagtgctctctccataggcctgtgtttccttcctgctgtcagactcctagtgtctgttgattctcaacatctagctcctaaggcttgttgcaaggccaccctcaccatgccagagcctgttttgccaatgtacatgccgtggaagtgtctggaaaatttgcttcctgaagacagcccttaaccaatgactaatgatatgagtaaactctgaggtgtgacctacgttaacaccagaactaccctgagggactgagctaaaattaccctctatgggaccttccttggtgtcttacccttgcttagcttccttcccttcctgtcctgtttccctacaaggttttccatagaatactttctaataaatcactttgacacaagcacctcatcttagagcttactgccaaaagacccaacttaacgataactactactaattgctcagcattctctttaattggagtgaaatcagactgaagttttctatgctgttctttgggttctgtttgtcagataatgtcatcaaacttttatattaaagaataattggttaatttctgctccttaattttctggaatgatttatgtagtccaaaaattatttttttaaagattgagagacttcgtccaggaaagtctggacctttttgaagtctggctctttgacaacattttattttttctatggttgtctattaggttgtgtatcttgagtcagatttgataattagctttcttttaaatagaaatgtgtgtttcattgaggtttttatgtttaatagctattatacaaagtgttattttttcattttttctgtgaacatgaatactatttgaattctgatttgaacaaaccaactgcgaaaagacatttttgtgctaattgagacagtttgattacagaagacagttgtggaaatttgattacagactgtgggttagatgattccaaataattattgctattttgttaggcatttagtaatggcgttatagtttttaagaaaatgttgatattttcggacaggtatacagaagtatgtagaaatgagatgactttatgtctaagatttgcattaaaatactataatcatttgaagaaagaataaagtaaatatgccaaattttgtattataattcaatctgtatgacaggtatgtgagtttttttttggttttatgcttgtgtgaagatttttgtagttaagctttttttaaaaaaaagtcaactgagttacttacgtgatgaaattagaacacatacttcttacaagcacattctctcctatccccctctccatttcagttggcaccataatgccatttttgcctaaccataacataaattaatatcattttattttatggagtttttctttctgggataataacatttctgctttgttgcataattatcacagacaggtttttctttttttggagatggagtcttgctctgtcacccaggctggagtacagtggcgcgatcttggctcactgcaacctctgcctcccaggttcaagcaattctcctgcttcaacctccccagtagctgggatcacaggcacctgccatcaagcccagctaatttttaaaaatatttttagtagagatggggtttctccatgttggccagtctggtttggaactcctgacctcaagagattctcccacctcagcctccgaaagtgctaggattacaggtgtgaaccacagtgcctggccacacacaggttctttagttttatatgggaagagattgcatgtcttttgccaagcctttcattgtatgatttctccatttgtgagttttatgggtttcgtttttgtttttgtttgttttttattattttggcatgtgtatcttatatcctgtgaccttgctgaatttactctttgtagcatttttcttttcacaaaatccttgagatttccttcacagtcacattatctacaaatctgcaaatagggatggtttcattttttccattacaatctatatgccttttcattctcttttttatttttctcctttattatactggctagaatttccagtactatattgagtaagagtgatgagagtggacatcctttccttgttcatgatcttaacgtgaaaacattcagtcttttaccattaagtgtaccattagctgttagtttttgatacttgttctttatcaagttaaggaaattccttctgtttttgtttttctgagagttatttgtcctgaatattggattttgtcaagtattttttctgcatcttttcatttgtgtgaattttcctttttagttggttaataggatgaatcgtgttgatttttaaatgttgaaccatccttacatactcagaataaactctacttggtcataattctttttacataatgctgaattctatttactaatactttgtgaaatactaatacttcattaagtattagtacttaacatgctaattcatacttttaagtatttttgtttctgtatttctgagaagggtagtagtctgtagttttttttggttttttttttgtactgtctttgttggattttggtatcagggtaatatgaacttgataaaatgaattgggaagtgttctctcctactttttggaggagattgtacaaattgatgttaaaacattaaaaaataatttttagaacatctgttagaattctccagtaaaaccatctggacctggagatttttgtgggggtcaggggcggggggtgaggggagttttaaaattgtgagttcagtttctataaataattatatggctgttcaaataatctatttcatattgagtgaattgtgatggtttatgcttttcaaggaattggtccatttcatctaacttgtcaaatttatacgtgtagagttgtttgtagtattcccttattatcctttggtatctgcagggtcaatagaaataacccctgtattattcctgctattggtagtttgtgtctcaatctttagaggctgtccattttattaatcttatcaaagaaccagctcttttttttacattttaggttcaggggtacatatacaggtttgttacagaggtgaattgtgtgtcatgggggtttggtgtatttaagcatagtgtatttaagtgtattaagtgtatttaagtgtattaagcgtatttaagtgtattaagcatagtgtatttaaccaatagatagtttttcagtcctcaccctcttccctccctccagtcttaggtagtttctggtgtctgttattcccttctttgtgtccatatgtcctctgtgtttagttacaagtgagaactaataaggttttctgtcctgtgttagttcacttaaaataatgcctgttttaaattttattaatttctgctctttattattttattccttcttgctttgggtttattgtgctctttttgttgagtcttgaggtagaagcttaaataatcaatttatttctctcttttttaatgtaaacagttagtgctataagttttcctcttagcactgcttttgctgtgccgctctattgtttccaaactgtttctttgctatttttacttccctgtgtcattagcaaaactaaactccaggaaagcagggaaaggtacttgctttttgcttttcccagtatatagcatagtgctgtgtatttgaaaataatttttgagctttaaaacttagatctcagcttggcagcttacatctgcttataaccaggaactggaagaaacacaatacaaatattccctaaaattagaagaaaactatagagggtttattgcaagtaaaattctacttaataaatttatttttgtttgttgaaaagcatatggaaaacactgtatgggttaagtctttagcagtgtgttttttgtgtttaagaatttatatagagaaacatttgagttttttaatggcaaaattaaagagcagaggcatgaatatttagtctgaaaccagttccaatctctcagcaaacattaacatcctcccagtccattcttagagcccgtggacttttcaatatcttatttgcacctcaagatttataaatagagcaaaagcggtttcttgttggacctactgatgacataaccttttaagtattccatttaaagataattttagagagaaagggaaaggatatggaaagttaatagacagctataggtgcgagagtggtgtgtggaaaaactagtgaactttaaatgaaatgggggtgaaaattccaatttaccatgttggctggctggtttgggtccatttaattaacctgtctcatactcagtttcttcatctgtaatatgaaagggatactgctatcgagttttcaggttgctgtgagcatcagaaaaaaacataaaaatttctaacatggtacctcacatgtactatatttgtaaatgtaaggtgtgtgactgtaagatttatatcactttcataaggaaaatcttttgggaaaatataaagatgtatcaaaaattattttaatatggttagaagagggaatatattttgaatacataaatgcagcaaatgaatgccataatccagagcaaaattagaagtacctgattgtcaccttggcaaaatgtggtataaagtgttaaaatttaaaaaaaaaaataactagaatttcagggctttattgtgaattacactcactgacttcccgaaagcctgaaaggaagaagacgtgcgctcatggtaaagggcattaaaatcttggtgaaagaatattcttgaactggtggagtggctgaaaaccaagcataagagaagaggttaaaggctgtatcctcagaattctctggcacccatgtaagaagaccatggagtaatatttacaaagttcttagggagaagaaagtttgtgcaatagcagacattctgaagcctgcaagaatttcagatgtggcaccgattagcgccattaaaaaaaactgcttgctgaaacccagctaacaaaaacatgatattaatgaaaaactcaaatttagaggagttgtgattaaaaaggactcttgttgagcatggaatctagtttaatgtagatccaggattaagcagtcatggaattacagttcataattcatataatgtaaactatgtacatttttaccaaataaaagcagttaacaaaaattggttgtggcagagggagtgtgtgtgtatgtatatgtgtatatatatatttgtacatgtgtgtatccatgctgatttccacatttcacagcaagaaatcaatagatagtgcctaaaattgagcttatttaatgagccctccaactcctttctgtttttttgtaaacttttcttaatttttagagggatcctttagaggatgggggtcatattacagatgtctaggtgacattcagattttttagattcctttatttcctataaattcaaataaatctaatatgttaattctttaaaaacgagatgactaatataattcccattctgtaaaactgtagggttatggtttgaatatttgtcccctctaaaactcatgttgaaatttaattcccagtttggcaatattaacaaggcctttaaggaagtgattggtttatgagacagacctctgccctcatgaatggtttaatccattaatgggttaataacttaatgggttatcatgggaagggaactgttttggctttataaagaaagggaaggccgggcgcggtggctcacgcctgtaatcccagcactttgggaggccgaggcgggcggatcacgaggtcgggagatcgagaccatcccggctaaaacggtgaaaccccgtctctactaaaaacacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaagggaagaggaacaaacctaagctaacacgttagcatgcgtatccctcatgccatgtgatgctctgtgccacctcaagactcttcagaggagagtcctcaacagcaagaaggctcttaccagatgtgccccctttggccttggactttctagcctccgtaactgtaagaaataaatgctttctctttataaattacccagtttcagttgttctgttataaataccagaaaatggactaagacataatagcaaagtggttaagagtctgaattcctgattcagattgctagtgtgactctctgtgtctgaattcatctgtaaatgggaatactagtccgtactttatagtttgcagatgctcttagtacagggttcaaatgttaactgtaattacctctcctatttttgttattgctagagagaaacctgtaatgataatcacaaaatattaataattgttgtttctgggtagtaggacttgtgatgatttcttccttctaaatccttttttaacaatgaatagcataaagctgtccctttaaaaataaaattaaaatataaattttagttgtcccgggagttcttttgtatctgaaacctcagttgtcaagcttggaaatctgtacttttaaaatatcctcaagcgattctgattacacatcaggtttggaagcacttggcataaagaacttcccccacccaattcaaagaaatagtatttaagccctcataatgtgcagtgtggttaagctgtgtctttttccagtctagtctacctcaacactcttgtggacatgatttttgccaaaaatctgagtgagctttgggatgcattctacccccatgagatggctattttatcccaggagcaggaaaaaaaaaaatgggagtttacagttatttagtcataaggccggagtcctttaaattggaagggaatgtggtaaacacaacacaagaggagccaacacattctgagtgtgctgatactctgggggagaagagtaagagagtatgacaggcatcagacagcatcacaaaacattttaaagttaaaaacaattacgtaacaccaagaagtcagttttccttacattcactccaggatagatgccttgcttaaaaagtgcctcttcagctaagaaaaactgtgtccataagtacttcagtagctttccacaaacagtaactgtttttgtgttatagaagtaggcttgttctgaagctcagcatgtccttggaatatgattgagtagcatgttagtattcatagttgatggagctgggttagcacttctttaacttcagatatccatatgatgatagaaataggaattttctctggtcctgcagtccttcctcttctcagtcacagtgctttctgcctaagtggtactgaatggcattgtgactactgctttcttctccagtgccaggagcggtagactctgcagcagtaaaatactgtctttgttcttttctgagatggtgaagtggctgtgtatggtattaaggcaaaatcacagctaggacaaaaagcaatggaaaaccaagatcagtgtgctgtaaggcaaagtgttagtgagagaatcagaggatgtagagagtgacaactcagtatctgctaatgctccaggttcactgcttcaatcgtattctgcttgtcttcctccataagaaattaagagttaaaacatctttcatttacttctcttggcttcatgttttcaattcatggtactttcatatcacatacctctattgtagattgtcttgatcatgtatactgctaaaggaaggacttgtataatatcgaacagatacttgactaatcagttctctctggctgtttgaatgaaatttcaaaccaagatttctggttagagcaaggtctaatgaactggtcctcagacaatcgagatatttagaatttcagaacaatcacttaagacaggagggatatgttttattgtatcttttggatataaagattacactaacggccaacctgaatgagggaaagggggcagtagggaggcagaatttgagaccccctcatcagagaaaacagcagaaagacatggtaaacttgtttctggttttcctgtggcaaatttgattgggtgtagagagaaggatcgttgagtggggctatgtactcatcatccatgaaggcctacctttctgaacttgaaggtacagtcaggatagagcaaaaggtgtaaacatgtatctgatagtttcagatggttaatttacatctcaagatactgggcagctttgcttatactgtgctgttccttcacctctcctcttcctcttagggtttttcttcccaaactggaattacaattcaggagagagcctgaaatataagatatataatgcagcataagcatggtgtgttgtcatggcatgtcaattttacttgtagattttgggatatttttatatcaaatatgaatatattaagtatgtacttaatgggataaagacacatgaatgggtttttgtatacactttttactgaaataaatgttaatacagaaaagtatgtaaaatcataaatgtagagcttaatgaatgtcacagagaacaagccatgtaactactagttttttttgtggtatcaataagctttcctttaattactgtttgtatggtatatttttctattattttgctttcaactttataaatctatttaatatgtgtctcttgtaagctgcatgtagatgagtttatttttctcgagtctggctggcaatctttattttttaattgtagtttttagtctatttgcttttaatataatcattgatatgtttggttctaaatcaaccaccttactatttattttctatttgtctcatctattctatattccctttttttttttttttttaacattgccttgatttggggtattttcccatttcatttttttgtatttgaatttaattatattgttttactgtttgtttgtttaaagattatattagacatccttggtcttttaaaggctattattaatcagttttttttttttaaacaactcctggacagtgaaatgactttagagctcttaaactctatggatcctccttatactttttgatgccagttttgtaatttgttttaatggtaataatactaatatcttgtgagactttcaaaaaatgttttattatagccaatatttatttggatttacttacatacataccctttttatgactctcccttccttcctacatctctgaatttttatctgaaattcttttccttctgcctgaagaattagaaatagaactgttagtgataaattcacttaggttttgtttttctgaacatgtttttaaggctcattcttgaaggacatttttgctggatacagaatgctaggttggtagttctgttcttttagcactttaaaaatagttcactgcagtcttgattctgttgttgctgctaaaaagtcagctgtcaatcttattacacctttgaagtttttttttctgtccttggttttcagtagtttgactgatgtacttaggtaacattttctttttctttgtaatcttcattgggttttgtagatttttaatgtgagggttggtactgtgtcagtttcggaaaatattcagtcattatttctttaaataccacttctcctgagttatgtctcttccctcaaaggttccagttaacacttacattagaccctttcactttattctgtttttttgctcaattctttttcaatccatttgtttttccatacttcattctgcgtattttcttctgacctagctttttaggttattaatttttttcttcagctgtgactattctatgcctaatttcttaatcttgccatttaatttcttgactttattaagaatagttatttctaagctaaaaatatgaaaatcttatttgagtcttttggctctgtttctattgtctacttttttgtgtttagccgtaattttcatcttgatgcctggttgttttggacattgtgtatcaaaattttgtccatgttgtataccaaaaaaaaaaaagtcgtcatgataatttgaggttcttcatgattttatatttctccaggagaatatttttacagttaggctagggcggatcatccagtcagtggctgagatgactctaacgtagacttcagccgttgtaaagattggtctatttttgttttgttcttattctcagattgtagcctttcagagtccttgataagagcataggtgtttttcaggacctcttctcctaagcagactttggacattaatttttgcttagctttattgcccttgctgttttctctttcagaatcagtcattgtcttgaggatagagcagtgccagatgtctggtctgcctctttccttccttcttccagattttggccctactaattctcactgccttgatatcttaccagtgtcttcaaacacatatttatatttttttacattttgttcagtttttctgattgcacttggttgtactaaaagaacctagtcagccattccagaaatacatgaagttgttttgtttttattattgtagtggtgattgttggtttgtacttttgctttcacaaactatttcaaagcaattttgatttttagggttatatttcccagacctctactttcactgcccattgccctctgctgttagtggtgattaggtgaagagtttgagaaatgtaatggaaagggcgtgggttttttttttttgtttttttttttttgagacagagtcttgctctgtcacccaggctgtaatacagtggcatgatctcggtcctgcagtcctgcctcccaggttctagtgattcttttgcctcagtctcccaggtagctgggattacaggcacgtaccacaacgcctggctaatttttgtatttttagtagagatggggtttcaccatgttggccaggctggtcttgaactcctgacctcaggtgatccacccgccttggcctcccaaagtgctaggattacaggcgtgagccaccacgcccagccgggcatgggctttttaagcacacagacctacattcaaactgtggctccttctgattgtgtcagcctatatgaattaattacctgtttaaaattacctttttaaaatttctctttcctcatctgcagacgggtttagtgagaatgaaaaaggacattgaaattaaattttatttaaaatgaaataatgtatggacagcttctggtatataataaatgcttagtaaacttatttttttaattatcttgaggaataggaaactagagttaagaccaatcttttaaggaatttaatagaagtttataacttcaccatatagtaattgttaacaaaagcttaaaaagggcgtttatgtcaatgtttggttgtggggcagttcaacaggcatctgtgtcccaggtaccctacttaatctcgttaatattatagattccatccaaaatctagatcttgcagtatagagcagaggtcagcaaactttttcttttttttttctgagatagtttcactcttttgcccaggctggagttgagtggtgcagtcttggcacactgcaacctccgccttctgagttcaagtgattctcccaccttattcttaccaattcttcccaagtattcaccttattcttcccaagtagctgtgactgcaggcatatgccaccatgcccagctaattttttaccatgttgtccaggctggtctcaagctcctgacttcaagtgatccacccgccttggcctcccagagtgctgggattacaggcatgagccactgtgcctagccagcaaactttttctataaagggctaggtacggttttgtgagacatattgcctctattgtagctattcactctgctgttttagggcaaaagtagccgcagtcagtatataaatgaatgggcatgggtgtgttcaaataaaactctatttacaaaaacaggtagcaggccaggtttggtccatgggtcctcaaactgtgctgaccctagtcctccacaagctacaagtgtttttttacgtttataaaggattgtttaagaagaagatgcaacagaaaccacatgagacccaaaaagccaaaaatattttatttctagttctttacagaaagggtttgctaacttttgggttggagaaggggtggtggttgctaccagagaaaaagaagtagacttccgtactcagagttaacagcaaagaaagaaaaacaacacgacaggaagccctggatccacaaaggatcctggtgggaagaataggaaattctgtgtgcaatactgacatactcatccataccccaccccaactgtgactgtcctactaattaatctggttttatggattttccataatgtgctgttttagcagcaaatagaggggtaaactcatagataatagctaaatactgttagaaattaactttccgttatagctaaatgttaccagaatttttactccggttatgtatacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaaggtatggtttactttattaagcagtaaacataagcagtattttagtctaaattttgtcatattcctgtctgtatctgttaattaaaatgggctatatattccagatattaaaaataattcttggtttgcctcaagagaagggaattgctaaaactcagatttatttagggaataagatattaattttgaattcgtttttaagtagaaatagttcagaacccatgatttggggaagggcataactattcagatttgatttgtttctgaaaatgtttttctaggttcagttttgttatatgtgtgtctttggtttttgttacttgttttggtcatagcttttgcttaagtcttgttttcctagagaaacttgaggtgtatgtaagtttcgatttatatttttataattagttaatagaactaatcttttttttcctcaagaggcacaaagaacaaggaagttaaaaaccaaggatgcgttctaaagacttcattttctcctagcctcctacctctaaccagattttctcagttgagttatttatgtgtcccttaagtgttggttctctccaagtttctgtcctttagctgtttgtctgtgtgacatcattaacccgcataattttaatttccttctatttcttactgtctttagcccagttccagacattgtgaggtgacattaacacaatgcaaaatacggtttgacagaaaataatataagtagcttgaaaacaattggaattctgggatgcagagggtccactattcagttttttctcttctcttctcagtagtaaattatttcttcaccacctctcaagcagaggttgaatggtgagatttcaaagcctggttccattttatcaactagcaaacataaacatactattacaaagtatgtcgtgttttgtgattgtttatgtaacagtaattcagctctgagcaagtgctctgtgttcctacagaacagtttggtcactgtgtatttgctctgtagcatagccacatgtctttaggtgatcaattggaggcagagttccctactaatagtaagccgtacgaggcctcactgcaggcatgtgtattagatacatacttgtccagctcagtggcctacaaaatgtggggtatgctaaaagtttgtctactcccttcagactcagcatgtgtaaattgagtctccttttccttcctactcctagaagttgctcttcctcctctattctttcttttatatggctcattaccatctgtctgtgccagaaattaagaaatcatggtaggtgcttgccttcacatgctagccaattcgatttgtcagtacattctaacagtgctgctactttaccatttttcatctcttttcctctcagtcctcagtgcatttccgattcaggccttcagctatacccatgtacctgcactcaaccaaacttcaccattccttttggtgaacttataacctattttctgtattatgtctttattttttaatcttcctctttgttctacctaggtccctatctactgctctgtaggatttattagccactattttccttcagcacattgaatcctttgttcatacctctataataacatctcttagtatttagcaattattggtttgtgtgtcaggctcaggctccctgaatggactgaattcctctgcagcaggaaatgtgtcttactcatttttttcatctcctatgccagcccatgcccagtacaaagcaattagtgaatgaaaaattatttatcaagttcagcggtggacaaacctgtcttacctgaatgaaacagattggggattcctgcattcactgttctatccattcaaggtttggtatatttgtatagccaagagattgggctcctcaaggatatgagatgtctatgctttctgactgaaagtagggtgattttgtctgctgttgtccttttggattgtgaatcttgatactcagagggacatgagaatttttattttttattttttttgagatggagtctcgctctgtcacccaggctggactgcagtggtgggatctcggctcactgcaacctccgcctcccgggttcaagcaattctcctgccttagcctcccgagtagctgggattacaggcgcccaccactacgcttggctaattttttgtatcttttttagtagagacagggtttcaccatgttggccaggctggtctcgaactcctgacctcgtgatctacccgcctcagcctcccaaagtgctgggattacaggcctgagccactgtgcccagctgggacatgagaatatttttatgttccacccagcttttcccattattccctctcagttggttaactagtatattatatgcctccattgttaatttctcataggactaagcttctgtaacttgctgtttgaccttaattttaagcatatgcttcgtcaggatactgcccagaacattgctactgaaagtcagttcatagactcattctggtcctataactaaagaatgtctgcttatttgggagtaagcagaaacttttattgtaattggagtaattttgtctgaagctaaaaataaaaatttaggacttgttttatattttagttttatttttcttataattcatttttatcctatttacacagtgtagacctcttttagaaataaaaattggcctttcaccacagatagcttgggaagtactcatctagaatctcatcattgagctcttcctctgtaccggtgctactcaaaatgcggtcctggcctgacactttgtcagctgtttgtctgcacaagataatgaggttacactaggatgtaaatcagttttacgctcactgcttacttaaatggacagttttaagtttcagttttaagctcactgcttagttaagtggacattttgattggttggttctgatagtaggcctttttcaaagtaatgtgttgctttctgttctggtataagctccttatttctttgcaaacctgtagtttaaagagcactgctctagaccatcttggaattcccatgtctaccattgttctcttctgtttttgattggtggatttacattttggaatgaggtatgtgactatcagaaagtaatctcaactcctgtgctttgaccttttaccacctcagggtacttgtagaaattcttaatagtggattattgtgaacttcaaaaatgaactgccacttcagcagcatgtctttcctgctcttcagaaactcgttcagagcagtgagaaatttctgtcagtaatctattaaaaactggctgctttcttttatgaagtgccaagcagagactatttaaggcagcatttagcatgcctatgaagcaccaggagaacttattaaaatgctgattctgagtcagtaggtctgggcctaagattatgcatttctaacaggctcccaggtgatgctgctgcttttaatcagtaaactacagtttgagacgaatttagattataatgtcaactcttactagctccagtgatgtcctagataacactgacatgaaaccaataaatcagagtgtcagttcacattaggatgagtttgctttcctttggctaaatcactaatagagggataaatagggactttgaaattaggacagtgctttcttcagtataatttattaatatttggattttacatctatgtaaataaccttttaaaatgttttgtttaatagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatgtcaatacttggactgactgaattttgttgataaaaacatgttaatatgtgtatgtttctttagtaccaacaacaaggactcttccttagtctttttaaatagagtggcagtataacaaaatagatgagaacagggacatcagcaatcagcagtagtcacttagcaaatagctattgatgctgttatatgccaggcactgagaatgtagaagtaaatcacagccaatttccagttctcgtgaaccttacattctggatgaggagatatacagtaaacaggcagacttgtaaatataaaataggattttagtagtaagtgccctgaagaaaaataagccaagtaaggggatggagagtgacccagagtgggatggagtcctctggtttgggtgattaagaaggcctctcaaagaggtgacttttgagcagaaccctgagtgttattagagagcaagttgggtgaagatctgggtaaagagccttctagtcatcaggaggatttaatggaggttcagaaagacctagagtcaaatcctgctctctcacttaatagccgaacaaccttggatggacaggagccttggatgacatctgagcttcagtttcctcatttgtaagatggacataatgtacctgtcttatttagttgttgtaattacaacatagtacagcccttcacacagtaagcatttaataagccttggctcacattcctgagaattttatctaaagtgcattattttaggaagtattccagtagtacaaatatttcagaatatacattgtacttatcccctgtctttaccaaatattaatctttttgccacatttgtttcagttatttaaagaagaaaatgctatagtattgtttttcagatttttaaataaatatctttctacaacttgcccttttcacacaacattgagatttatcaatgttaattacatgtctgctgtgttcactattataagcattgcttcagtgaataactgaatgagaccaggaatcatggaacctagcttttaggctcagttctgttactaataatgcctttaggcaagtcactagttctctatgccttcttttctgtggacctaacgtataaataatacacttcatgctactactgtcatcttcataaggcaatgctttcaaatcatcatctggaacagtgattctcaacccagggcaattttgcccccagaggacatttggcaaggtctggagacatttttggttgttacagctaggaggctgctactggcatctaatgggtagaaacccactacattataaacctactaaatgctaaacatcctaaaatgcacaggacagcctcctacaacaaagaattactctagcccaaaatgtcagtagtaccatggttcagagaccctggcctagaacatctgacccaagctttaggtaatcagctttaaaaggaaacttttgatagtctgtttttctattttagtgagagtactactttggatgcttttttgatgtaaacttttcttaatatattttgaccattccaagatgacttgatcttttttccttaattctgtatccttttcccatataaaaaatttacccaaattcaagaatataaacatgtagcaaatacatccaaatgcatataagatcttactaagagtatctgatgttggatacacatacagtagtagcaaagggacatcataattggcaaatttgttctttctctagaaatttatcaaattatgttgaagaccataaaacagaattagaattcagagtaccaaaattgacccatcaatctgacattgcctgttctccctcaggagattcttacataaacccaacgtgaaactaaaattctattattatccatctatcatttagtaagttttcttccccctaaatgagtttaaatcttatacatactttttttttctatatactaattactgaaaatacagaaaatttttatctagcaagtcagggtaaaagatattctaattcatgaaagagttacattcctaaatttcttgttcagaactgactcttaagcagttcccttcccactccaccttcttagtaatagacttttcaccagagaagttgcagtgagtcttaatatggtagatttaaaatatatgtgtaattgtttacatatatatctctctacatgaaaaattgacttttctgtaggtcagaaatggtcaaatatgatctactttattcagttttatttacattattctatctgaaacatattagtacataagtgaggtagagagctcctgatttttttaaattgttaactaattattctactaccattttttaactcattactgatttaaaatgtcccccttatcatacactgtaaccttacttatagtaggatctaaatctgggatttcatttctatgccattgttctcatttgattttggcccagcaccatattgttttgaaccttgtagctttacagcagttttaagttactattctaagggcaaattaactcttctttttttctaagtgttttggcaactcatttctttatctttgcatacaaactcattaatttagggacaataacatctttgcccaggattttttgtaagtcaccttttaggtcctttggtcaagttttataaactatttccataggtatgcaatatttttgttactgttctacttgggcttttaaagacttaactttttactgatatatatgaaaacttatttgtttgattttctttttaagcatctttaaaatctggctttgtaactgaattctctatttctgatgattcttcacttgagattcttgagtttttttgggtaaccataattgtctgctagctcttgttttctaataattatagctttttacttttattgtcttttattgcataaatgcttaacagaatcctggccatccagtaaaatataaataaataagagcaatataattaatgcagtaaatcttatcaaaaatattattttacagaatataaaaattgcttccagaggtcagcaatttataactattactggtctagtccttaagtttaatatgcactggacagtatagtagccactaagtatgtgtggttattgagcacttgaaatgtggctagtccaaattgagatatgctgtaaataaaatacacacctaatttcaagaaaggtttcattaatcatcgcaaaactattgcatgttaaaacagtatgatgaactttttcagttaaataaaatgaaatttcacttttttttttttttttttacattttttatgtggctactatatggcttacatatctgttggacagagctagtttagataatcacaagttgacttatctggttatttttcctatttgcttttattctgatatttcctaaaggtgcaagagtaggttgtctaagaatctacatatccagtgtgtgtttcaaaggaaagtttagagataacagcagagaaaacgcagtggacagtttgataatttttacacactgtaagctacatacttccaaacataaattattagatttattaaatattcagtcaatatgaatcttctcttggaacttgccagactatctccctcattctttacaaagatgtcagatggagcctgaagttttgttggagtcacctggatgacaccaacattctccagataccaattctgactctaggttgactgcttaattcatctctttttctgtcttcttaattttcttgctttcttgttcgttgtattgttgttgttttattttaaactttgttctcataccaaccctattaggaatttatgagaattacataactggacaaaggtttaaatctgacctaccttagggccacctgatatgatttttcagtcaataatagctaacatttattgggcatttattttaagcaaagggtaatttacacacattgtctcctttaaataaccaccttttacaaatgtggaaattaaagcttatagagattaaataacttactcaaggtcgtatactagcccacaaaatttgggttcaaacccaagtctaggttgagagctttgtctcaaatactgtactgtttgggttgatacatatatagatgaagtgtattgggttgtagacacctaatgggcaaggctttgtagtcattgaatgccctagaggtatgtttccgagtatgagccacacaaaaaattacagtgagaaaatgaggaagagaaagcagatgttggagaaggagatttctccttgtatagctgctcctttgatttgaagaaatctcagtaattttatccgctaaagagtgtgagagaatattgtttcatttaaaaatactttccacagtttcacttggtttcaccaatttcaattggttttaaatcattaggatgtctaagtaaactattgatttcttccacaggtctagtacattaggttcctctgctttaccttgccatctttaatgtttgtattcttttaaaattagctggtcctttataagtatgtaaatattgtagctagcaatgtgctgtttattaacaatacctgtttccactacttttttagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattatcatgggccttgactatattatatacttgattctaattagtcatcttttacgcaatctctgttgtctcttttctaaatgtgtttagccactcttgaataccattctccactattaacattaatttactcaaaccgttcatagcattctgtaaacatgtattttacatatttgttcccaaatttgcccattgttcattatgggtaactaataataaatttaatgctgtttcaggatgcttttcttataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttggtgctattttgggataattgttttgctaatggataattctaacaatgcagaatacctagtcaagactgtcatcaaaaacattcacaaatgtttcattctatttttagtgactctgtttaaagagtttctgaaaggaaagaaattttttatttttattatctttagcagtactgagtgtcatagcagaatattttacagactttctatgagattatttttatggtacaaagtatttacatttccctcatgtttatcattatgccaattttacatggcagtcatgccactgactctgctatttagctaagtaatttcttttttcggagactgtctcactctgtctcccaggctggactgcagtggtgcgattctcctgcctcagcctcccgagtagcggggattacaggcacgcgctgccacgccccgccagttttcatatttttagtagagacagggttttgccgtgttggccaggctggtcttgaactcctgacctcaggtgatccacccaccttggcatcccaaagtgctgggattacgagcgtgagtcacagcacccggctaagtaatttctatttattgtgccaaaacatgtcaaaatcatgacctctttgaatggtatatttgagaggatgttcatttcattggttaaccatggactactctgtccacgtagtgaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattagggatgataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgcccaattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttgtttcatctgattatttttaaccaatataaaagttgtgagataaatgttgtcttttatgggtagtttggggttatttttccaaaagtttaaaattgttttcccatcaaagctatttagtttgaattggctttcataagttttactgcaatatatgtattatttactttaaagcaacaaaatattccacctctgactgagaataatatactgtaaaaaaattagaaacactgtagtctaggtaagtgtgtctagatgggtgggggtggaagaggggagagaatctcatatatttagagagagattgcttctgtgctccttggtatattttgatctatctcatacactgagaaattagtttattcaacaaatacttatgccaggcatctgctagaaatacagtggtgagcaagacatacaggatgtcttaattctagagttagaaaataagctagtagatgaataaacaaagtatttcatagagtggtattaggaaaataaaaatattatcagaacaattttctggatggggtattaaggaagactaggaagtaacatttgagcagagacttgaatgttgaataacagacattttatatacttcagaagttacttttatctatgaaattatttgctccaactatgtgttaaaaaaaaaaaaactttccacccttgcttaatcatgctgtaggtgtaagtgaaggcttactgaaatgtacactataggctaaaaaactttgtgtttttaggcatacttcatccagagctcaggtgtattgatagatttgtctgggagtttcagaatatgaataaaaatagacctagtattttatctctttctgggcaaacagttacaaattccataaggcccttgagtctagcctatatgtcttgatttttcagtaatctgctacccagtatgttattagcatgtgtgtgtgcacacgcaagcatgcatacacactgttatttggattagacagctttagaaaagctgaggagataaataccacttcatactactttagtagtagagttgtataatttaacatattcagacagctaaatattttccaaccagctgtactgataattgttaagtcattggaaagtagatatatttacctaaatatatacaattaaacctattttaagttttccaaaggtatgacttcatagtactggaaagcatacaagaagattcttgctgaatttatctccttgttaaagggaagtactctacagagctcaacatagtggtcgtcttaaagtctaataatgctgacaatatggattgttcaagggaaatttttttagtggttaagaatgaactaacatttaactactaaagttgaatgagttcagcaacattggcattctccagatgcatctgtattagtaaaacagaagtgaactttgttttgccatgagtttattactaattaacgcattttgtattgctgcctagaacttaaaactgtctctgtgttgcatttcttctacaaaatgtgctagtgtttcttgtattattatcaatattgcttttctccaggactgaaaatttgtccagggcattatatactttcttatatattgcccctgtatagtgcaggttaatacaacagcttactttgaaataacaaaatactcatattttaaaaaatgagattcaatcctagaacttaggctctttggcttttctaatgaatgcctagtgaaagattaacagtacttcatttctagaactgccgaatgatgtgctatcgtagaactaatttgggtacagtgtcttcatttttacaactaatcagtttttgactttcataagcttcaattttttttcatagaactacctaaactgcattgtctccccttctatacctctaacagttcattcttattaattttcttgtctaattgttagattgtggaaaggtggtgataaaatccagaacataggtttggaagagaagtaatatgcaacttttcctttagttctacacatgactctcttccttgtttttatactttttggtggggtgtgggtaggtgagtgtgggtatgtatatgtcagagacaaagaaaaaggatggttatgattatattttaataactggatttttaatgtaattgaagtattaaaaccactgcattttcatgttgattaggtttatataataagtggtttatttgatgaagtgaaggtaactatgtgtttagaataattggccacagatataattcctgatttttaaagtaatttttacaaacctacttgcctgacggaatttctctcttttttggcctttgaatttatagctcttggaaccttctcctactcatctctcattccatgtttttttcttttaccctttctttttcttctgattggcagcagcaagtctttagtttcttaagactttttattgcccccattctttttttttttttttaagtagggacagggtcatattgtgttgcccaggctggtctttaaacagtttggcctcccagagtgttgggattatatgcatgagccaccatgcccggctgcctctattttctatcaaaatggatgtgtttaagactttttaaaaaattgtgtatcttttgtgaacctcagttccctctcaccagcctagaagttgctgaaagaaagaagagatagcactcaaagaatcgatgcccacattatcctgcagtttcctctttcttaaggaaatgtttccttctagaacctactcagtgaaaatatgggtgcttaaatacctgaaaaccagtggggagaaaaacttaatctttatagataaaagatttcagtgttcagtattaaggcagtcctctctcacatcttaaaaatggtcactatgacctgttgaataaaatgaatataacctcagattatgtgaccttccacagcctgacctagcatgtattccctttttaaaaaattgctattccttacctaaacgccagacaatttagctccaaatcatttaaccaacatttgagtgcctactaaaagtattgagctagataatagggataaagtggcaaattatatttgttgctgtcaaggaactcaccttctattagaagcaaagtacccaaaaaagtagttgtgtgcagtagagttatactctcaggcagtgtgctaattgttttacattgcattatcccatgtaattcttactacaatcctggtggatggattatactatccactgtttcaggcttctactggggatcttggtatgtatccccccgtggttaagggggaactactgtattttgttaacctccagcactttacacaaaaggggaactgaaagtaccagatgctacatagaagaaagaatggagtgtgtgaagcaagagactcttctcgaaaggggccaatttaaatcatttcatttccatatgcagccataaccatgtaaaaacttccatccacatcattcaatggcttttatactcttaattcatattgctaagaaaacttctggcttattcttcttgttaaagtttatgaagtgtcctgatatggaggggggaaaatgccatttctatgacataagcccattaacccacccaagttgtcagaatcaagaggaggtgtttgagaaattgtttcctctttttaaacatttaacatttttcttttgtgttagtttttcttcaaaacgtacaaaaaagtacgcatcattgtatcttgtgtatttactaccagcttttactagataagtcatctttccattgaaaaagtgataagctccattattttaaaaaaaacttaaacattcattgcagatgaccatttcaaagatgaaaatttttaaaggaccccaaaccccaccaccccccaaagtaattccaattaatgcataaatataaattggataggaagctaaatagatagaaatggttttattaaagtgagatcgtgtaacaaatgctaattttaacattataatttcaaaaaaatacagttgctcttgatgtggccaaaatctgcaaattgtcctgggggcagggagaggggaatgtcatcttagcagcaacaaaattgagtgatttctttgggagggggagatggagagaggaagaacggactggacttaggcttctctgtagcaacattcagtgctaaagcagagtgaagcaaactctaccagattcttgggggaggaagaagccaagtgatttcaaatggaagggtaaattgaaagagtgagggtggacacttcttgaaaaatctagatgatgaagcccatctaaagagataaatggacaaacattgagaacaggactggtggtggttaattatttaactatgtagctatagaattatttaaataaggctatggaagcatattgaaatgttataaatcttgatatagaaaagatgattaacaagttagaaaatagaatatcaaagacgaggtaatatatacatgccctaattggttttacttttcagaatagaaattttgtaaaattgataatatatcaagaaatagggatgtaatattctgaatagttatgaaggtaatcaccaaaactgtaagcctgataactattaaaatgaaaacacaaaattaaagataacacaggccatataagagagctaaagggagaatttacaatagatgacagaattaagaccaaacatagatatgatgtcaaataaggaaaaatatgatttaacttataaatgtatgaatatacaaaaactgttggcagtacctttggggaagggtactaggattggaaagaaattcaataattcactgttttcctttttgaacttttaaaaaatcatgtttatactgtcacagtttagagaagtaaagtgggaaaaaaaagctgttggccctggctccctagggtttttacaaccagtggtgaagaatgtccacagacattcttaagcagcagtagaggtaagcaggtacacacatgagctggaaagatctcaaagctgatttggattcttttatcttgccataagaaattactttcttcaatcaagggtataaagactgctgaactagttcataatgagggtagatgaaggaggtatccatcttcaagagtggtaaatagttgacccatacaaaggaccagcagcctcatgtggacccgtcttagcatccttctctccttctactccaagggtgaagagtactcggaagttactatttattctcaaatccttgtgtcagattattttcatatctttcttagatctgttctggcttaagtcttattctcttattcatggaaatagaagacactgagccctttcccacataaaaatataggactactgatttctagagcttaaagatgttctaacgcctcgtttgaaagattcagaaacagatctagagatgttaaagtttagaaaaatgacacaaataatgccagaagtggcaacagaactcaattttcctgactcccaggttagtggtctttgtactaaatgcaatttcttatcttccctgaacaacctgagctatgtactttaacaaaattttttgtgggtacatagtaggtgtacgtatttatagggttcatgagacactttgatacagccatgcaacaagtaataatcacatcatagaaaatggagtatccatcccctcaaatatttatcctttgtgttacaaacaatccaattatactcttttagttatttttaaatacacaattaaattattgactatagtcaccctattgtgctatcaaatactagatcttattcattctttctgtttttctttgacccattgtactgctagatagaactcacatatttggtccctgccttttcccaccatttgcaaatagattctaggaacgatcctaatagttgccaggcactgttatcagagatcaaatctgtcttgtttccaattgtgcctgggacataataggatttttttttttaaataacaaagccatgtgtagtgctgcatgcctgttgtcctagctacccagaaggctgaagctcaggagttcaagtccaccctgggcaacaagactccatctccacaacaaaaaagtttaaaaaggttactatacgattactatacattgtatgtatcaaaatattactctctcccccataaatatgtacattatatatcaattaaaaggaagtaaatggtgagcatcctttcactatgaagaaaagttctccatatgccccctactttcttctgtttcatttttatggagacctctaaacaaaatgcttttctcatagatatggagggactcctaaacaggttttctgcttgagaaaatcttgatttgaactccacgtatcatacaccatcaggcaaaaaacctcgcatttacgttggagaatacagtccagaaaaagaacaaaacctcaagtgtgggcagaagattgtgtgtatttgctattagggaggagagctcaggttccttttctctacagtgaccattagacattccaaagcactgtcacttggtgtagctcagtgctcttggttactgaagcaacaagtgatctctgatgacaaaacaaaggtagggtcgtgcctaacactggtaaggagaaaactgtgtcgagttagttaataattaatttacatgtcaagttacaagttttctatcctaaaatccaaaaaaagcaacagctcttttttttcctccagtcattaaatcacccattcaacaaactttcaccaggctcatggtttgtcagctatagaagagaaaggagggcgaaacctgtggttaaggcttgcctgaaggatctcacatttgggttgggggctgacatgccagtgaacaaatagcctcctcaggactatgatagaggtatttacaaagaactataagaggactgtatattaagtgtttagggatctgagaagtttcaaagaaattgtggcatttgaactggatttaaagaataaggctcaggtacaacttcatgtgaaagagtcgatatattcacaaatttgccaaagcccagttaacttcaattcttcgagagttccagttttttcccaggtgcagtcagtgtaccatttttttctgagacccacagccattttctttcattggcatgtttttaggtttatttttcaataactccagtacccctgaaatttccttccttagatcttgaataaatatattcaagttgggcattactgcatggtttgaggataatgtctttcctgttaaaaatatttttaagtttttatacaaaggtaatgtatgtgcttggtaaaagagaatgaatataaaatgaaaagctataatctgctacagccccacccagcagtccctttgtccagccataaacagaaaataacagaactgtactcatttccaaactaaacacatcattctgctccttgccttttctgcttactgtttaataacttagagataattctttttaatagttaactagatctctgtatggatgtgccacaatttttaagccattcctctattgataattgagttggatacttttattataattattgctgcactgaacatccttgaaatgattgtgtgggtacagccataggataagttcctagcaagtaattgctgagataaagaatgtatgcatttaaatattcatagatactgccaaattgccttcttaaactgtactgtactaccttatactactactcaacatttgcgagtatattttcctgccccttttaccaaagtttttgattattgaacttactagttttatcactgcattaatatctgataattgttgatttgtacttaaggtttgagttttttttatacattggtaatttgcatttcatcttcgccagtttttaatattgaattactagggtttttaaaaatttttataaactctctgaatattggtttatttatatgtattagaactgttatgattatttcgtacttgttttttccccacacaaaccaattaatcttttcttagggctattgaattgtgtgtcttgctcacaccaaggtttatttataatatgcttatgttttcctcttactttcatagtttcattttttgtgtttatatttttgatccctccagaatttattttcttatatggagtgaggtaggaaaatggctacccgtttgttgtaatacactttatttgacgatcctttctttcaacatttattttaaatcaccattaccccatgatatttcattatcggtttgtgtataaactgtattctggtctgcttatctgcctatttcttgtgcagtacattgttttaatgatttcagattcataacacttaataactgacagaatgaattacctacttaaacatttcgtacagacactgtggtggattctgctacatatcatggcattatgccatgaatgctttccagcattactggcagaaatagccacccttaaaatatgcccctcgtgatcctcagcggttcccagggtacagtgtaatgtgtacccagaaatgggttgccctcttgcccattcctgggctgcctcctagggacagtgactccagttaacttgctgcttcagtgggcactaccatcttctgctggtgacttctgtcatcttgtttgaccctggggaaaagacttattttcctctttgttgcccacagtagagaccagactttcctgaccgttccagaataatgaaagaaagggtccagatagtactttatgagagcggccaagctccagtggaatcctctccacccttaccaggctactgctctgccctctttgctacctgtttccaggtcaccaaaggtagttcagctaccccactagaaaccttcagttatcagcacttctttagaattggagccaaattgacatctgcactaaaagaaatgaggaaggtttccactcacctaacactctggacaccctcctcccaaaattcctgctgaaccaacctctcccctgggaaactggcagtgaaaacatttagtcttttcagaggaaattacacctttactcagagaaacgtggtctggattttggatctgcagccccagtaagagaattgcctaatgatctggtatcagttagtacaatcaggcccttcatatctgtgggttccacatccatgaattcagccaatcgtggatcaaaaatattcaataaaaaataatatgacaaaaatataaacaatacagtataactgttatttccatagcattcgtattaggtattatagagatgatttaaagtatgcaagaggataagcataggttatatgcaaatactataccattttatataagagatttaaacatccatgggttttggtatcagagggggtcctggaaccagtaccccaaggatactgagggacgactgtctatttcgcagtctgtattgtttttacaagtggggcagcaacaaccaaacccaaatgaggccgcatcaggctcagccctgttcctattttgtctccctgcactaagggtttcaagcatgtcttagggctgtggtcagcttgttaacacaaatcagccttgaaacctaacagaatgttactttacaatttcctgttactatgttcctttttaaagtaagctacttccaaatcgatcttcatccttttcaaaataccaaatttcggaaatggaagggggaaaggaatgggggaaatacaaagtgaaatcacctgtattttcttagggaccctaacttagacatgaccagctatttctgagattcttaagtaaactgttttttctctctgaaagtctgacagtctctgccatgtcaagctctttatttcatgtcttatacttagacccactcaggctacttggacaaatgctcaaataagttgaccaaatgaaaaacgtgttcagaggttgagtgactcagagtgagaacaagtgaagcagaactgagtggtggaacttaacctgcgcctgaagttttgaaacacatcaagtctagtcttctgtattttaataatatacagacttagagggtggaaagagataaagtgttatgtgctcataaaatcaatttataagtgacctcatagggtcaatcacctcaagataatataaattcatgatttaatatattaatgtaacctttgctatgtattaatcagtataaatttataattcagtagtctacaaatcctaaacttagagaatattttctgaatttgctctttgattactccacgtctctgcatagaattttctgacactcactcatcaggatgtgtttataaagggttttctttcttcctcttcacatttaaatgatatagaattacccaaacttcctgttgctactgaaactgaagcaagagaagcaagggaaattgaaactgaaaatgtgaaccagcgactttacccagaagcacagttgatggcatcaatgagatcaattttttaatgaaattaaagaaagtagaggtttcagctgacactgtttttctccagactctctactatgcggcaggatggtagttgtttcctctcaacggagctaaaaattaacttcatcctatggcatgatgtattaaaatcaggagtgtttggcccggcgtggtggctcacgcgtgtaatcccagcactttgggaggccgaggtgggcggctcacgaggtcaggatatcacgaccatcctggctaacacggtgaaaccccgtctctactaagaatacaaaaaaaaaaaaaaaaaattagccgggcgcggtggcgggcgcctgtagtcccagctactcaggaggctgaaggaggagaatgctgcgaacctgggaggcggagcttgcagtgagccgagatcgcgcgactgtgctccaacctgggcgacagagcgagactccgtctcaaaaaaaaaaataaataaaataaaatcaggagtgttgatggtaactttctctttcccctctccaacaggtaatttctctcaagatccaacccaagctattctatatacacaaggtcagcaaacatttgattcattttgtcagctttaatataaatcaaaatcacacccaggaggctggggtgtggtcaaacagacatcaaatcccctattgccctaatagccagtcagtcacccccctctttcatgtgggaaagaacaccggaagcaatttgacaagtaacaatcaggcttctggagccatggacaattgctgttaactcttgactgttctgacaacattttagagctatctttcaggaatattagcctcccccattaacaaaacggggaaaagctcattcctcaaggacctcactcttcatttagttcaacagtttggatggagaagggagatgtatcttgagggaacacaagtacattgatcccattttctacctcactacattgcttgcaggaagaggcctgcaacttggttcacccctttttttttctgctttagtattttagttgggtcaaagtaactaaagagttacttacttaaattgcatattgcgatccccataatttccactgggtaaaatttagctatacactgaagcttgctgtaaacatgcaagcaagttgggagaaaatattaccattagagaagtggaaaaagaccggcccccttctccatcatcaccaatcaggtgttgagtgaaatctcccgcttactataacatattactctcacagagaataaacaccgtatctttcagtaaggatctctgacctgtcattgtgaagggaggactagccagactgagggtgtggtgaggaactaggggaagcacagacagaagaaactgctttgagaggagaagcaactttgaagtgttgcttagtccaggccctgacctagggtttggtttttttgaagtctgtcattaacccttccctcactttccttctactcttcaagtcctattacattcataggaatgactgatttgcccccaggtattttgctggtcctgggatcgcagagaggaaaagatacaatcctgcccgcaggaactcagtgtatagagatggcttctccaacttaactattacagagggctgataatacttttcagacatgtcgatccaaaatgaccaattaaggataaggacttggaagtaaagaacataactcaaagacaacaaatgcccattcaccaaagataaagccatgaactgtccagggcaaacgagctcgccttttggaggctaagcttcttgtgggaatttgtagagtttgggggaggtcactcagtaacttctgtaatgaaaagttttgtggcagccaagtgcagtggctcacgcctgtaatcccagcactttgggaagccgaggcgggtggatcccttgagcccaggggtttgagaccagcctgggcaatatgatgaaacctcatttctactagaaatacaaaaattagccaggcgtgttggcacacagctataatcccagctacttgagtggctgaggcatgagaatcagttgagcctgggaggtggagatcgcagtgagccaagatcgtgccactgcaccgcagcctgggcaacagagcgagactcttgtctcaaaaaaaataaagaagttttattggtagtatttgttctctgttaagcccatctgttgagttcttgatttcatttatcaagtttttcaattctagaatttccatttggttattttttatatttccaggtctctgccaatgtcctcaatcttaatttttatttccttaaacattttaagcaaatcattatagaatccatgttggatagtcacattatcaagatcccctattggtctaggtctattgtctgttatttttttggtattcagttacattttctagttatttttggttgaattctgtctttggcaagaatatgtcagtcaccttttgaataggatgaatgaatctgttacaccttatggaagccataaaatctatgctgccccacatggtggcaatggtgtatatacaaatgaaaatctaagaaccccactgaccttctgctgaccaacatcgtagtgaggtaaagaagtctcagagtttagcaaagtattatccttaaagaatcaaatgagattgtaaccagttcatcttgcctgctgcccagatacagccaatttgtaaagacagggaagtgcaatagagagagattttaatatgcatagagccagctaaataggagaccagaattttactattatttaaatcagcctccccaaaaatttggaggctaggattttttaaagacactttggcaggcatgagttagttcctgggtaggggccacaagaccagatgagttggtttaccattctgggtggtgccagctgatccatcagaatgcagggtctaaaagatatctcaagcaccaatcttaggttttatagtagtaatgttatctataggagcaattggggaggttagtaatcttgtaacctctgggtgcatgactcctgagtcataatttttaatcttatggccaatctgttgattttacaaaggtggcctggtccccaagatacattttacccaagatgtaatatcacaggaaaccagaaccttccactcaacctctcatacacaactggctttgttagtttcccaccacattcaagagcacctgatgccctaaactgtttaaggttgaattaaggagtgctcttttcaaactatcccaatttccatgaaaaccaaagacagcagaagacctagaaaatatttatagaattgggtatcttgggacatgaaacaagtggatacttacatatgtgaatctcacatgtcttaatatccagactaattccaccttgacctattcttacatactatctatttttctcttgggaagttttctaatactagcttagcatcagcatgtctgtttcagtgaaattaacacgttaaaatatccccactggaggtcagtgagtcagggcacatgctgctctacagaggggcccagttacaacctaaggagtagcacttcatcagagctacctcttcaggccacattccccactacctcaaccaactgctcctcagaagaagtaagatggatttgtgggaaatgatttccttgagccatttttccaaagatagtggggcattcttaaatggtattcatttgaacatggtattcatttgaactttgacataatgccattattttgtaaatgccatatcctggatagctaactatggctgacaatctacccctcatcatgactgtgctcaaatgcagatatctctagtgcatcattgaacgaaaggaatttcacacacttaagcctctctgaaattttcatctttcaattgttcacttttgtaacttttttgtggggatgaaattgacactttaaaaagaaaaattgaagcttgtgatgggattctaaaatctaaaaaatttcctttccaatcatattttaaactgttagatcgtttgcccatttattgtcaatttaacatgaaaacagacacatgtgcacatggacacatacacacaggcacatgtgttgaaggcctctagcaaggttgatgagacttgctcaactctattgctagccacagatgagcatacaggaaggtcgtaggacccaagtgtgtccaacccacagcctgtgggctgcatgtggcccaggacggctttgaatgtggcccaacacaaatttgtaaactttctttaaaaaaaattttttttaaagctcatcatctattgttagtgttagtgtattttgtgtgtggcccaagacagttcttcttccagtgtggcccagggaagccaaaaaattggatacccaatagtgcctttgagattgacgcctatggggaaatggagggagcagaattgggtggagggagaagttggaccatgaagcagtcctagcaaaggcctaagccaattcctcagggaaactgtgcagccaggatagccctttggtcttgttctactggagtctgtccttgctaccctaatatttacgagtcattggataaggaccgcccagggaggagccatgaccttggacaagacagctctcttcagctcctcttaattccctgagaagaactcagctgagggtcatcagctgccagcactcccagcagctgaagaatgggtgcctcaaacttgaagtggggactggcccacataccacagtgttccgtatagaatgacagtaaaaaaaagtggtcatgaagctcatctacagtttctgtcttcaaacctgtaatttttttcatttaggtttttcaagattatcccagaccctcccatttccagcagatttctttgtgctttgatttttggtcatttgtttgtttgtttgtttctattttgagacatggtctcactgtgtcacccaggctgcagtgcagtggtgtagtcatggctcactgcagtctcaaactcctgggctcaagagattctcccacctcagccttctgagcagctgggaccacaagcatgtgccaccatgcccagcattttttaaaattttttgtagagacgaggtctcctatgttgcccagactagtctcaaactcctgagctcaaacaatcctcctgcctcaggcttccaaaatgctgggcttacaggcataagccagtgtgcctggcctgattttcaatatttaaaaaatattccaatttgaagattgaaaagcagactaaaatagtattggcctgagaactcccaaaaaattatctggacaactacaaggtatgccttgctccaaaacagtaatttcagatctgccagaaccaatttgggcttctgtgaaaagtagaattgagcttaggaaggagggaagtgggtggctgccagtgcagtatgactggagtggccgtggaaagatttcccaggcccatctgctctgaaatcatctttattcgtgacagcttctgaactccagaagtgctcacctgtcagtgtccttcacctgtctcctattgctgtttgtcattttgtgtttaactgaaatcctaggcttgaatacctgaggccccgaacctctcgaggtcaggccagcctactattcctctatgtccatgggacccacaaatgcagcaagtgaaattgccgtcattcctgccttggttttcgcccaacataggaaatgattatacctacatggagctgcagtgaaagacatgatagatgctaacacttcacctggagattgctaaataccagctgataagattgaaggctggatgagagcctctggggaaagggttgctgaacagcaaagtggacagacagctatggtaggcagaatttctgaaaatgccctgagggacgtcccatcctaatcctcagaacctgtgaagattgagatatcacttctatgattatgttataaggtacaattaaccttaaaataaggagattgcctgcacgggcctagtgtaatcgcataagcctgtaaaattagcttttccaaagaggggcagaagaggaagttaaagagttgctgctttgaacatcgaggggaccatatgagaaggaatgtggatggcctctaggagcagagaggaccccagctgacatccagcaagaaagcagggacttcagtcttaaaaccacaagggtggaattctgccaatattctcaatgagcttggaagtggattcttacccaagcctccagggaaaagccctgacaacactttgactttggcctgtgagactcttgagtatagaacccaacctagcctgcctggagttgtaacctacaaaagcgtgagatgatgaactggtgtcattttaagctgctaagtttgtggtaatttgttgctgcagcaatagggaactagtacagtagccaagacaaacaagtctacttgtcactatttttgaaaaaacactttctttggaagaaactggaatctgcctctaaaaccatctggcatctggcataaggggaaggcggactgagatccaaaactattatgtgccggcttgagcttcaactttatgtataccaaaccatttatacctcacacctaccctctgggacgaacactattattatcccagtgttatctccatgggcttctaactgctgttcggagaaattaaatgattggaccagtaagttctcaatcccagctgtgcaccagaatcaccgcatcacctgagttttgtttattttgctttgttttgtttttaagctaatgagcttttagagagtcaggatgctgaggcctcaaccctgacccactgaatcagggaggcccagacctcttgcacttattaaagctcttggatgattctgatttaacccagatgtttggcaaccagtggtataaagtgtggttaatggacaccagcatcagttgccctcagggtggtggtaaccgctgatgttgtgtccctaacagccatcctctgctacttcacttacagcaggacctcaggtgtgctcagatggctacgtgcctggccagagggggttctcaattttcagctctagtcatgttatcacatttctctttcccaataccatcctgtgaaggttaatttcgtggagcaacttgactggccatggggttcccagattaaatattatttccaagcgtctctgtgagagtgttcccaaataacattagcatttgaatcaacagacttagtaggttgccctccccgacatgggtaggcatcatctaatctactgagggtctcaatagaacaaaaggtggaggaaggaggaatttgccctctttttcctgcctcaccccttgacctgggtcatctcatcatctctagtccttagactgggatttacaccatcaactcctctggttctcaggcctttggacttggactgaattacactgtcagaggcatttgaaccagagtgactccatcttgcataggggctaggtaaaataaggctgagacctgctgggccgcattcccaggaggttaggtgttctaagtcacaggataagataagaggtcagcacaagatacaggtcataaagatcttgctgataaaataggtcacagtaaagaaactgggcaaaaccgaccagaaccaagatgacgacaagagtgacctctggtcgtcctcactgctcattatatgccaattataatgcattagcatgctaaagacactcctaccagggacgtgacagtttatagatgccatggcaatgtcaggaattcaccctatatggtctaaaaaggggagaaaccgtcagttctgggaattgcccacccctttcccagaaaactcatgaataatccatcccttgtttagcatataatcaagaagccacaataagtataagcagcagagcagcccatgctgctgctctgcttatggagtagccattctttatttctttactttcttaataacttacttgctttcactttactctatggacttgccccaaattctttcttgtgggagatccaagaacactctcttggggtctggatcaggacccctttcttataacaccaccacctgctttcttgggtctccagcttgcagatggcagattgtgggacttacttcttagccttcataactgcatgactaatttatcatattaaatcttattttctttatatatatctccatcctactggtttctctggagaaccctaatacatttcccatctctctgcagctagaatcagccagaaacatataaggagactccaccaggagtggggagttcttgggaaagcttttgcttctgaaaaaagataaaagtacacaggagagctgtctggtgccattccttgagcatgtgagagactgtgtcaccgggagcagcagttatctgtggccataagttgagatgactggatgaaatgctaacatgttgagaaggtaggacaaaaagaaagaaccagggacactgatgacattgttgaggtgcatcaaccctagaaccattattaagagatttattatgtgaaatattattatttactgttttactacttgtagctgaaagcatttctaactgtgtacaggactacttttaaacgcaagaaagaatttctggtgttgaggactgggttatttgcattaacaaccatccaattctttgtgcactgaagtctaagtcacccacattctagggtcacctacacagatagtgatgaagctgcttctaactggtccatgttttttccactctatgatagtaaaaacaaatagaaaaacatctgcattcctccctttttacacactccctgcggcaatattggtattagacatagcagaaaataataactaagaaaataacttgaagaaaacatgtctacaagctttttgttaagaaaaaaaaaaaaacccaatctttaaagcccgtatttattatacaaataaatcagaaataataggtatatggggagaaatgggagaagagaaaggaaagccaagatagtgctcatttttcacattaattccaaaggacaaaggatgggatgggagctcgggggtttctgaaaatgctcaccacaatcagtttacacaacttttcagaaatatgttaactctgtatcagagcacactttaataatctagatatatatagagacacaatctgtttgtctaaagaagcttccagattttccatttagtgtgtcttttacctttaccataaccctgagtcatctctgatagttctcattttggaagtgattccatgcatagaaagttgtgtgtgggctccctaaggacagtagctgggtcccttttgttcattggcttacccatagcctgcagcacaatgctttgaacataggtagtattcaaccaatgtcaactacaagatcccagaagacccagaagaccccttacctttaggaatgtgtgtcttgtgaggcacctgggatattatcgctagctcattttctcagacaaaacacagaacagtgacatagttttgtaaaggtcacagggctaagcagctctctccaaatttagtcctgtgcacttttccccagatttattcccaacaatgcctgctacactctttaaaaaccagcctcagacacatctgttctatgaaaattacatggaacagagaagtaactatttcctctcagtgaacaacattctgccatttaaaaggaaaaagtgaactttgtgggttcctcttgtataattaggatttaatttccttcagatggagatgtgtaactgatattgcatattatatactgcacagtcactaatatagagagattcaatatgcattcactatgacaatgcatcaaagaacttttttttttacccttttatcttcatatcccagtttgctttgcaaaaagaattggcatttcattaaatatataaataaataaaagactattttttcaagattcactaaacaggtgttgcttaccttaaggcaaaatttttataaactaaaaaaattcagtttctgtaactgttccaacatgaaaaggactagttattcacctgagaggaaatgtcttataatgaagactttttattgaatctggattagtcccttgcccaacactaatactgacatttttcctgctgagttgcaagtggcaattcacttttggaagaatttatgggaaaatataacattattctatttcccaaccacaagttttgtttattcctcacactatatagatggtgagtctcagagaactgggggcttctttgctccttgatggggaaacccagctgtgtgcttcacgcagggctgtccatagcctgcagcacaaggctttgaacatatgagggggtgttcaaccaatggcaactgcaagatcccagaaggctccttacactgtggggactgacagcctcttattccccagtaactcctgtggtgtttccagcttcactcttacattggcaagtagggatggaacgcgctgactgccgtgtgaatgaactgtgtaccttgttacttcaaacattgaaactctgatattaaattttttttttttttttttttttttttttttttcagacggagtctcgctctgtcacccaggctggagtacagtggcgcgatctttgctcactgcaacctctgcctcccgggtgcaagcgattctactgcctcagcctcctgagtagctgggattacaggcacataccaccacacccagctaatttttctatttttagtagagatgcggtttcaccatgttggtcaggctggtctcgaactcctggcctcgtgatccacctgccttggcctcccaaagtgctgggattacaggcatgagccacctcacccggcccattaaatattttttaatgtgagaagatatacttattatcatgaacatacaagggagggatttgatcacagccgagcattgcggacatgtgactttgcgtgacttgaaaaaccctggataccaacatctgatcaagtggaaaattcatatgcctaggaaaagtagcccctgtgatgggtgaatctggtggcactgaaattttttctttaactgcattgaaaggagatgtatcaaacaagcctcagcatgttatttaattatgagatctgttttaaaatttaagtgagaaaccaggatatctagaagcaagttatagagaatgcaaaacctattcccctttaggtattcagcttgatgagccaagtgataataatggctgtagtcagctgttgttatttttgcagtatctaaggaagagagtgtagatgaattcttctcttgtgaactgcttcagttaactatgaaaggaatcaatgtgttcaatctcatccaagatttctttttgaaccattagctaacacttcatgtgtgtggatcagttcttactgatggtacctcctgctatgcttggtaaaacatcaagctttgctgcctagaatacaaaataaagaaaaatgagtagctatttgtataatgcactattgtgcacttgctgcaagaagtttgcctgcaaaaacaaataatgttctgtcttctttatatggtaacaaaaactccaccaagaaaaagatccaaaactttgcctcttccatgattttttttaaaggaattggtaagctgacacatccatttccatatagaaatgaggtggcttcccacagcaacatgtttattttgcaactagataaagtgatgaaaattaagtgaagcacttctctctttcatccttctgagagggtagccttcccttagttgtcttgggtgcccatgtaattgaagaaagaaagaatgcaaaaatattatatttttccaattctggcactaaaaaaataagattatgcaggaaaaaaaaaagactttcaagtcaggttatttccttgagagatttcccaaatactctgtctcctctttaacataccatagtcccagcctggaggatctagcttacagaattttcctgtgggctagagaagaaacctttactccctatgacagcaaagcttcaagacctgctgctacatggcagaagatacgacatcacaaaatagacaacccaccctttttttccccaaaggatggtgggaagaaggaagcagaatggaaaagaactaggaaagccaagtacagagatgatgtgtgttccaagcaccacccaccttaccccacccctgtcccgcccagcttagaggactgaagagaatgcagaattaggcatgggtagggctgcttttgtcctagttcccttgggactggtcggggacaggctcataggctgttctgcaccacccagagagaagctgtgtcacttggcagtacagtaggccaggagaagattgtggtggccccacgtggctctgtggtatttatataggatcctgcagctgctgagtctctggtgcggagcagcccagtgggggttgttatagtggcagtggggtgccctgtagagagcattacagagtgggtcaccaggcccaggattagaagtgtctgtagcccccgaggaaccgggacaggactgaatcagtcaagaagagacgagatgatgatgacggagtggccacaaagtcctcccacccctaccctatcccagatgagcccatgctgtaaccacatgaagagcaaagaaacaactatttattctcagggactgtgttaatgattcccaaccatcagcatcgaagaagaggtccggaagaatgtgaagaatgctaagtcttgtgtggagaatagaggggagcatgaagacaatccacagcctgcaggcagggacttcatggacactctacattgtgcagcagccacagaattcagccacaggtgccagctgggtgagtaccaaccaggtggattaggtccaccacccagaagatgcataaaaaaaccacacctgtccccccagatccacagaagccatcttagggaagaatcagtggggatactcaagataaaaaatgtggaaggctctttttctgtcttttttccaagagctgattattatctgaagggattgcttactaattggaactaagatttcacccagacagtgctaaatgttagagattcttccccccgctactggagatcagagagaagttcgcaacatttatagataaaaatcatatctcaattgtagtataagttaaatttgtaactattatatttgtttttgaaagccataaaagtctgcctatttacaaccaaataatgccatagttgacaattttaaaaaatagaaagtttatcttttacctagcatatgcagtagctatattcaaacatgaaaatgaacacaattaagtcatctaaatattaatctaataagaacatggtgtgaccagagagaaattatttgcttttataagaaaattttagtgggggataaagcatattgaaataactttccttttcttagagaaactgttttaacaaaatgaaaaactgaccattgcaactgatatgacaacatactttgcaacaattgagtgactcatttttatggattttttttccactagacatttcatgtagaaaaaaacaaaaacaagaaccaaggatactggagcttttttaaaaatttcatttctatcgatgattgtcttctatataaattatttttacttaattacaactcaatgaatatattttaacaagaaagccttgggaatttctgagaacttgactagcattttctacaaatggcaaagagagcagtgaagattatgtgattttagatttttctcacttttacacatcaaaataagaactagaaattgatgttgacatgaatatagttatttccaagggaaatgtccttatttcttgaatatcttggaacaaaagctaaaggagtatatattatttttatatggcaataactttaatgtgttatgaattcagggttgtaataaactctagttgtgttttcactctataattataattagttaaaaagtatcttctctcatcattatgtccatgatgcttacgtggacatagtttgagaaaaaaatgatgcaatttgccatacaattaggaccacagttcaaaattcaaactcagcacaactttccaaagatctggtacttaacttccgttcctatagcagcaactcaacacacaaagcccactgccctgatctaaatgtaaccaaaacctaatgcaagcattcatttacctctcattttaaaccatgtcttgtagattttgatagactatgtgtgttaagaagcaactggaaaagctagggcactgtataatcactgctgttgatataaaacaaatgtagtaactatgtctaaattgtaagagcacattttgaacatagaatcatttcaagcaggcattttctcatgagctatttgatcttgaaggctcagcatgtcaacattcaatacatgagctcagtgtcattccttccctccagtgttcttccagctggcagtcctgtacgtccatttgtcaatggcagctccttttccttcctcattggcagtcagtcttgctcgaaaatgttggggcctgcacccgacatctcagccttcctccctccttactgtccttgtttttgtccagttattacaccttctcacattccaatgggcaccagattcattttcattaaaggaagtaggtagtgtggaaaatccttacatgtatagcattttgttaaactgtgcattggttagagttgagcaattagattgtctagattcaaaggtagtttttactaccagatgtctgcttctcccaagaagaaagtctgtctcacagtttcatccccaggtcccaaggggtccacgggggtgtgtgagcttgcttcttgggaaaaaagacatctggagttctcccacactgcccatgctgtgcaggatgtctgggaggctctcctctgctgacttgatgcttccatttctcattgtgtctaggtcagtctggctgttcactttggtatctcagccacccaccccttcttacttccaacaagtgcatccaacagtattggatgcatataatttttttcacaattttaccaagaaatcaacaaagtactgcagcatgtttactaatactgtaaagacaagttcctcatacaacccttttccaatctccatactgccctggctcctgccagtctcagataccctactcttagacctttgtgttttccacaaggactctgcctcttcggcccagtcacctgggtcacctgagctcatggccctccatctataaccaaagacctatctgagtgccacccccttgggaggaactcctagcaaactcacacaaattttatggatataaaacttaatagatataaaaatatctgactaatggatatacatgaatttatttctgggtatgtttttggctaacaaaagaattttggattaacagcagctcctatcaggggtacttagaaaaaaacaacaaattagtcatagacaaaaggaggcagagaaagttggaaggaaaggaatagagatatgtgtaatggaatactgaaaagataaaagaagataatggaaagtaacctaaggcctaagaaccaaagcatgcgaggatatatgagtaaagagaagtactgaagagctgggatgctgggaagtaggtgatgggtgttaacctcagagtaaaaaattcagaaaaagatttgcagtaaatatggctagttatctataggattcaattttcctcttcttctgtaataaaatacttatttgtttagggcagaaatgtcatcagttcagaatatttaacttcctagacccccctttggctaaggggcagatgtgacaccagtgagatgcaggtgaatggggttctagaggctttccttccacagcaggggacaaagcctcagaaagaaaagaatgttgctatttccctctgctttctcctaattcctgccttgtgagtggtcctgatgctgacagatgcagtaggtatcttgcagccacgaggaagaaaacagcatgactaaggacaggaggagctgaaagggggatgacacgtgatttctgatgaaagccttgagccatgacattttttaaatgaaactagatacctcttactgaaatgcagagatttccagttaaatttccagcaaaagaatgaaaaatggaaattaactataaatcacttatttatgtaaaataatacgaacataatttctatttggggttctgtttttgttattgtattttagtaaaccttaaaatataagagatttaaagcttacttataacctgagtctgccaagtgttttctatttctttgtgtatggttttaagttcttcagcctcaaatagtacttcactgggtgttttcaggaacctacatctgtttggggaggaattgctatgttataatcctctaggactttgagtccaaggatatacacaccccagcaatcatagtcttatagccactaattcaattcttcttatagcttttggggtttgggtattaccccttagaagccaagttattagctgaataaggaagtaacacctccaacaatgctgttcactcagcatgtttcttaaaaaactccttgttatccgagcaaatcctaaggatatacacccaagatgagttatggagaattaattactgactcctgagaatctaaaaatggggcagcagcccaggtgttctcatcctggagtcatgctgtttcataaatgcaacttaccttaggtaaacttagtgtttatttttgatagtgcaacaagtatagagctcagacccgtttccggtgacttcctttaggaaatctcagtatatatttgttcattaatgtgcaataagaataagctttctaaaatttggacaagtagaaaaaagtggtatttctgttctttgaataaaaagcaaatgcatttaaaacacgcataatacacaagtaggtaaatttatcaaaaggaaaaagtgatcaatcctatttaaactacctgttttacaattgcaatagtttcttattcagaaatgtattaggtcaacttaagtactatttattacatcagaactaccaacacctttagtaccctgtttggaagaccgaacatggatcagatgttagtcccaccttagatatagcaaatcatttatttccattttaatagttgaaatttagaaagcaaacggacccagaggggatatgcccacaagcaggagatgaacgtgttccaaatggcagtatatttccaaggagacttacaggctttttattccaaggattggctcaatacttcattactcagaaagtgtgtttgatcaggcgagaccttcaaatttgagctcctctgtggtcaggggaatgctaatgactgtctgacagcttgtcacagacattggattttttttcttagcatctctggccagatttcctgttttctggcagctgtgctggtgcagattgccaagaggcaccatacccacaatcttgagaggattctgtttccagcaagccttcttttactgtcatctatgtattacatctctatttcaagtctctctagaatttatagtcatactgggcatttagtttcaatttgcatttgtttgttacgtggctttacatgactttttgtctacttcatgaatctgtccgatcttcccagtagatctaagtacctggaggatctgactctctttgacatagagagactccccagagaccatgcctttgatttcatttatagccctttaggacagtgtttccccctcaaactctcttgcagactggtaaatgtcctaaattaccatttaggagtggggaatagaaggaatggagtaggaagtgaaatccaagacaagtcacagtacctgttcataaaagggaggggttgctaggcaggaaatctttgccactctggtcttttctcttagagaacactacccaggactgctcatcgatcattgtcaactatttacttttacgttagggtaaaaatgaccttatatgcaagtagtagtgattcttagagtaatatatgatgcctaaacaatatctgcaggtggtaataaattagaggtgtgacagggcagtgcttcacaaatgttccagctcaaggtacaatctcaagcttgttccagcaagtacatgcccatgtataggggttaggggctttgtcttctaccttcaccattcctaaggtatttaaatccaagtctctaataacttattctggtttttaaagagggtagttgttcacatgataataatttcaatagggctgagatgttttggagcatggtagatgggcatcactcctactgaggcttgcaggcaaagaggaagacagatattgacatttctcagcactggtacatgtgctgcaagtcacctattggtcagttgtaagagcaggtgcaggacagtgtatatacaagtcaacactgggagaggcacatgtaagagctgagggcttatagcaaggcttgggcaaagcaaggggtatggttgagccagaaagtctatgagaatgaaaaggccaggggtagaacctcaggcctcagatcttggttaaatcctaaaaactactcattgtgcttctgttgcagacaatgcataggagtgaatgagacagaaagcaagaccatgaggatgactaagaagagcaagtacaacatggctgagactaagtgtccagggagttgagaataagtggcctattgtcatgtcctatataagtagagtatatggatgggaggccaagaatacaccaacaaataaaatattgaatatatcggtcaagggcatatcgagatgatcaggatgctgcctattggaatgtttatcctcccaccctaccccagaagaggagcttctcgtcttgttcaccgctgtttcccagctcctggaagagcctggcacataaaaggtgcacaatgaacattcattaaaatcaatgattaattgaactggctagtattccatctcactttcattactggagaactgaagagccagctagcctacaaaaactcattctggatgtagaagcaataagaaaacatgcattcaaataaaagcagagaatccttctaatatttcttcatgtgtctatcttttcccatccccaacacatttattttccttgacctacaaaggatctgttttgtccatgatgagtcccaaaaacagccctcaaagtggttctccccacctaccccactccactgatgctgcatcacatggtagggtgttgccttgctcctccatgcagggagcttttctcagcaccactaaggtaccagggaagtggtaactgggaacaattttccccaatacagataaagcctagataaaaagtagggtgatacataggcaaggggtagatggggccttcctagaggacactatgtcttcctgaatttagtccattcataatcaacaaaccagccctactgatttaatgcctaggctctgctgcctgactatatttagcaaagcttttgaatggcagagtgatttcctataggaatactgagttttttccagggacagatgtagccttggtacattgtctggttatgtaggatttttttttttttttttttttttactgcacttgtgctgttctccttttttcaacttatagctggagaccgttttctgctacctcaaaacctttttgaaattaaccagtaataaataagatctttctctatagacagcttttttcaaaggaataaaagaattagaaaatatggaggatccatagtatgcacgcctttggttcctgaggtcccttagatgatatggaattctttaaaaatgtagatcgattttgataacatcataatcaagatcctaagaaatcactagcatccatcagattataaagtttctgagcaattctctccccaacccccatcctgagcctaacatggtgacttgctcacagcctcactggatagatactggttagataaatgaaagcattcattaatcaatgtgatgtgaagaatttagataaatgattcctatttctctcagtctaacaaggggaaatagtccaataaacatatctgtaagtttaatagaatttgtaagttcctttgaatatttggaaatctatgatttcatttttaagacacacagaatctattatgatagagcactgaattttattcagttaggtaattttgtgcctcttatttttaaccagtttggtgtctttcttgtgcttttcactatagtattcatggatcctattaacagtaaagaaagtggcagacgccaggcatggtagctcatgcctgtaatcccagcactttgagaggctgaagcagaattatttgaggccaggagttcaagaccagcctgggcaacatagtgagaacctttttgttgttactgttgttgttgttttttaaagagagagtagagatactaggttactccgtggtgaggcttgggatggtggtgggaatggagtggaggagggacttccttcccaatgactagatatgtcttaatttgtaagacggctctctcccatgtgactttctctcctctacctatgtcaactttgtgttgggagtgttcaggacaatatgtgaatggaaaattcataaatgaatgtaccaatagaaataaagatacatgtgggtgttgctttttcactttttcaatgaagatctgatcctttggtgttttacttggtcccaatcccacttttccacaagttgtggctaaggacttgtccttgattataagattctggttgttgaaactgttatttatgcatgaaggactactcagaatatcactgtaattacacatctgcccctctgagttcttcaaaaataggaacatgacagatatgtttggaaaaggttaaaaatatgcttaatgctaaaaggaaaatgagctaaaattttcctggtattgtattatagttctatattttatgatgatctttattgcaatagttataccttgactttacaaaattctttcatgttttaacccttggtgtccatacttttgcctttgggaatatcatgcaggcttgatgtaaccattttgcttataagacaagcaaattggaccagccacagtggctcacacctttaatccaagcactttgggaggccaaggggaacagaacacttgagtccaggagttcgagactagcctgggcaacatggtaaaaccttgtctctactaaaaatacaaaaatttgccaggcatggtggcacacgcctataatcccagctactcaggaggctgaggcatgatcttttgtcaatttagtttacagggccccagcaacagaaccttgaagggtaaaagaaaagaaaccgtgttcttccctgcaatacaataggagagttcaaaggatgtgactcagggtaggtcagagatccacaagggtttcatttctgttgtcaaaataagtacagtgaaaatacctacgaaaagtaataatttagagactattagtaaatagttctttggtataaggtaatttgtcatattatttgactggggaaggaacttaggtcatcctcagctctgggatgcctacacggcaggcagattggtgctttttgcagcctcacagaagacagaaacaagcagagggcaaaagatagaactcagaaggagaaagtctagttgacagagcaggaacatcgccatcttggacaagcactgccattttaatgttcaccttcatcaaaaacctcgtaaatccaagggcatcagcctaatgactaaggtcagaatgaccataagccacaaatgacatctcttaccagaaacattccaaccataagataaacccctccccaaccagagacttgccagccccaagataacctcccctccagccagagagatgtcagccccaagataacctcccctccagccagagacattccaaccctgcaataaatttctcccccaccagaaacattccaagcctgtggtaagttctctcaccctgaacccttaaatacttattctgtaagacagaaggctcctaaccaaaaatcagccagaagcccctctcaggtttattctccaaaataaacctgtctttgacggttgagctgcttttcatgtttctttcctctttggctcttatgctagcgctgtagtgctacttcactatttttttttctagaacagctgaaattctctttttatgtagaatgagactcagggagatttgatcactttataaattttttttcaaagcaggtcccatttctttccatccctttcaacaatcctcagtgccttatataaatgacagttttctaataaatgacaatattctagcttagtagacaataaacaaaatggagagggagagttttgcatagtcttaaataatagctaaataaaatataatcatcaacttaaagatgagaactctaattaccacatattgtgaacaatttccatataattaactgttgtttaggctatagagtaactaagacagctctctggttttcctgtatgtagaaaacatattggtttggcagatgttttacttactatcaattgcttttcaatagatagtttctcttcctttgcagtgaattcaacacaatccacttaaaacaacaaatgtttattgagtaatcagtacatacaaggcaatatgttaggcctgagaagaaaaacaaaaataagcctcaatactttctcttgagaaggtaacaaaaaggaataaaatgtatgtgtaaattatgataatctgtggcagaaaaagtaagtgaataaacatttcatctgggtggaaaagtttggtcttacatttgtgatgatactagaaggtaggcaagatttaaagggctgagactaaggagtttccaagaaaagggaacactgcctatgaaaatatgaggcagataatcttgaagtgtcttagttttttcaagtttctataacaaaatataaaccacgtggcttataaacaatagcaatttatttctcactgttctagatgctggtccaagatcaaggcaccagcagatacagtgtctggtaagagcccatttcctcgctcctaactgacacctttcttgctgtatccttagatggtaaaaggggctagctagctctctggtgtatctcttataagcatactaatacctgtcatgagggtggagccttcattatctaataccttctaaaggcctcacctcctaataccatcaccttggacattaggattttaccatataaatttggggaggacagaaacattcagactatagcagagtgttttcagggaagaatgagagatgtggctgacagaaatttaagggatcacaatagagtaggactagtttatgctaatacagtagccattagctacacgtggctactcagcacttgaaatatggctagtctaaagagaaattttctgtaaatgtaaaatacataccagattttggacacttaattttaaaaagtaaaatatcacatgtttttatattgattgtgcattacaagatattttcaataatacagattactagaattaacttcatctgtgcctactttttttaatgtgcacactagaaaattttaagttacatatgttgctcatattatttttctataggataacattgggccaaattatgccaaaatttgagtatcagacaaagctccccaataacccttgctgccactgcagactcccatagcctaggccaccaaggtttcccacagtctccacagatggtgacctcagttgacagagctacatggagactgcaccactgcaccctccccataactgcagccactgcaccccaccagccagcaccctaacacatacctgcaagtgaaacgctttccccactgaagccagtccataaaatctggaaatgtttactgctccctccaatggcagacatctatgcaaggccatgagaaacatgaaaaagcaaagaaacatgacaccaccaaaggaacaaaataattgtccagttactaatcacctcaaaatggagatctagaattgtctgaaaattgattaaaaataattattttaaggtagctcagtgagatacaagataacacagatacctcagcaaaatcagaaaaataagacataaaataggaagttcaacaaagagatagaaatcatagataagccaaatagaaatcctggagctgaagaatacaattaataaaatgaaaaaaaatacaatagaaaacttcaccagcagatgagatcaatcaggagaaagaattggtgaactcaaagacaaggcttttgaaattattcactctgaggagaacaagaataaaagaatgaaaaaaagtaaacaaaccctgcaggactcatgggccaccattaagtgaacaaatatacaccttataggagttttagaaggagaaaagagagaaagagaaagatacttattcaaagaattaatgattgcaaacttcccaaatcttggaagagaaataaacaaccaaagtccgtgaagctcagaagttcccaaatagtctttacccaaagaagacttcaccatgacacattataatcaaattgtcaaaactcagaattttgaaaacagcaagaaacaagtctttccacatacggtgaaacctcaaaggttatcagcagatttatcttgcagatcaggagagaatgggaagatacattcaaaattattaaagaaaaaaatttgctaatggagaatactttaactggcaaagctgttcagaaataaaggatagataatttctcagattaaaaaaaaaaaaaaaagctcaacaagttaatcattcctggacctgccttataagaaatgctaaggagagtttttcaacaaatgaaatgaaagaatgctagcttgtaacataaaaacataaaaatataaaattcactggtaaggtaaatgtatagtcaaattcagaattctttaatactctaacgatcttgtgcaaatcacttttaaactctagcatataagttaaaagacaaaagatttaaaaataattgtagctacaaaattttgttaacaaatacataacataaaacaatgtaagttgagatatcaaaaacaaaatatggagtgtaaagaagtaaaagttgagacctcttgtgtgctatttaagtttttttatctttaaatagatggttacactataagatgtttcatgtaaaatccgtggtgaccacaaggcagaatcctgtagtagatacacaagagataaagagaaagtaaccaaagcataccaatataaaaaatcatgaaatcacaaagaaggggagtaagagagaaacaaaggaactacagcacagtcagaaacatttaacttaatggcaatagtaagtctctacctataaataactactttaactgtaaatacattctccaatcaaaagacatagagtggctaaatggactaaagaaaaaagcaattatatgctgctctcaacagactcactttagctttaaggccatatataggctgaaagtggaggtatagaaaaacatattccatgctgatattaaccaaaagagagcaaagtggttacacttacatcagacaaaatagactaagccaaaactgtcataagagacaaaaatagtcattgcataatgataaaggtgtcagttcatcaaaaggacataacaactgtaaatatgtatgcacataatatcacagcacctaaatatataaaacaaatattaacagatcccaagggaaatatacataacaattcagtaatagtaggggacttcaacaccctactttcaacaatggacagatcatcctagcagaaaaaataatataaaagcattggagcattggacttaaagttcattttacaccagccagacttaacagacatgtacagaacattctatcccaaagcagcggggtacacgttcttctcaggcatacatagaacattctccaggacagatcagatgttaggccacaaaacaaatcctaaatttaagaagattgaaatcatataaagtggtttttttaatcacagttgaatgaaaatagaaatttataacagaaggaaaatctggaaggatccaaaatatgtggtaattaaacacattcctgaataatcactagatcaaaaaagaagtcaaaatggaaatttaaaatatctgaggcaaatgaaaatggaaactcaatgtaccaaaacttatgaaatgcagcaaaagcagttataaaagggaaattaatagcaataaatgcctgcatgaaaagaaaaaagatcttaaataaactaactttacaccccaaagaactagaaaaaagaacaaactatatgccaagttttcagaaggaaagaaaagattaaaacaaaaataaatgaaatagggactagataaaccatagaaaagatcaaaattaaaaatttattttttgagaagataaacaaaattggcaatagttaagaaaaaaagactcaaaataaaaaatgaaacaggacacattacaattgatgtcacagaaataaaaaggataaaagactactatgaacaattaagtgccaacaaattggataacctagaaaaaaatgaacaagttcctagaaacatacaacctacctgaatcatgaagaaatagaaaatctgaacagactaataatgagtaaggagattgtatcagcaatcaaaaatctcccaataaaaaagctcaggacaggatggcttcaactggtcaattctactaaacattaaaaaaaaaaaaaacaaaaaaaccaatccgccttaaactcttcaaaaatattaaagatgagggaacactttcaaacttattttatgaggccagcattacctttatatcaaagacagacaatgacactacaagaaaagaaaactacaggctaataaccctaatgaatatagatgcaaaaatcctcaatgaaatattagcaagccaaattcaacagaacattaaaagaatcatacagcatgttcaagatggatttatcctgaggatacaaagatgttgtaatacatgcaaatctataaatgtgatacatcacattaacagaatgaagaaaaccaaatgatcatctcaagaaatgcaggaaagacatttaaaaaaatttattattattttatgattaaaactctcaatgaattaggtatagaagaaatatacctcaaaataataaatgctatatatcacaagcttacagcgaacatcgtattcaatggcaaaatgattaaagcttttcctctaagatcaggaataagacaacaatacccaattctcccgaatttctatttaatatagtaatgaaagtcctatccagagtaattcggcaaggaaaagaaataaaggcatccacatcagaaaggaagaagtaaaactgtatgtttgcagataatataatcctgtatgtagaagtcctaaaggctcaaccaaaaaaactgtttgaactaataaacaagttcagtaaagtagcaggatacaaaatcaacatacgaaattaggtaacattctcattctctctcactttattgcccaagctagtcttgaacccttggcctcaagtgatcctcccatcttggcctcccaaagcactgggactatagctgtgagccactgcaccttgtaagtggtttctatacactaacaatgaatgatctagggggaaaaagtcaagaaaataatcccatttagagtagtatcaaaaagcattaaacacttaggaatacatttaaccaaggagatgaaagatttgaacactgaccactacacaacattgacaaaagaaattgaagatgacacaaataagtagaaagatatcctatgttcatggattggaagaattaatgttaaaatgtccatattacccaaagtgatcaatgcaatccataaaagaattccaatcacatgtttccatagaaacaaaaaaatcctaaaatgtgtatgtagctacaaaagacaccaaagggggggaaaataagctagaggcatcacattacctaatttcaaattatatcacaaaactatagcaatcaaaacaacatggtactggcataaaaccagacacatagaaaaatagaacacggagcccagaaataatctcatatatatagtcactaatctttgacaaaagcatcaacaatacacaatggggtaagaataatctcttcagaaaatttggtgccaagaaaactggatatctacatgcaaaagaatgaaattgttcccttatcttacatatgtgaaaaataaattcaaaatgcattaaagtctcaaacataagacctcaactgtaaagctactagaagaaaacctaggagaaatcctccttaatgttggacttggcagtgattttttgaatatcacaccaaagacacagacaatgaaagcaaaaataaagaagtgggcctacatcaaagtaaaaagtttctgcacagtgaaagaatcaatcaacaaaatgcaaaggcaacacacggaatgggagaaaatatttgcaaactatatatctggtaaggggctaatatccaaaatataaaaggaactcatacaactcaagagcaaaaaaaaaaaaaaaaaaaaattgaaaacgggcagaggatctgaatagacattttttcaaataaaacatgcaaatggtcaacagctatatgaaaaactggtcagcatccactaatcgtcacagccacaaggagacatcacctcacacacgttagggtggccattatcaaaaagtcaaaaaatctcaaatattggcaaggatgcagagaaaagggaattctgtacactattggtgggagtgtaaattattacagccattatggaaaacagtatgcggttcctcaagaaacctaaaaataaaacctaaaataaaaattgtataatccaacaatttcacttctgaggatatatccaaaggaaataaaatcagcatctcaaagagatacctacactcccatgttcattgcaccgttattcacaatagccaatggaataggatatggaaataacctaagtatttgtcaatggataaatgggtaaggaaaatgtggtatatatacaataaattattattctgcctttaaaaagaaggaaatcctgtcatttgtaagcacactgataaacctagaggacattaagctaagtgaaataagccagacacagaaagccaaatgctgcatgatgtcacttaaataaaaaatctaagatggaatctaaaaaagttgaatccatacaaacagtagaattgaggttgtcagggtctgggaatctaaaattctaaaatctgaaaaagtcaaactcatagaatgtggaatctaaaaatgttgaacttgcagagacagagtagaatagtggttgccgccagggaggcaggtgagcaacggcaaaacgttggtcaaagggtacaagctctcaaaaagctctagagatctaatgtccaacatggtggctacagttaataataacgtaccgcgtacttgaaatttgctaagagagtagatcttaagtagatcttgcacacacccccattcccccaccaaaaaacaaggtaactatgtgaagtaaggaataggttgttaattagatgggggaattatttcataaagtatatgtttattaaaacatcacattgtatatcttaaatatatacaatttttgtcagttatacctcaataaggacgggggagagaattttgtagctatccactattaaagaaaatactttacatagaaatttctgtaggaaaaaaaatttgttattatgaatctgaatttctctagcctgtaactttcattttccttttgaaatgatagttctttataatggaattgttaaaaactgaaggttggttacttggaaacccagttactgagtttttttatgctgcctgaaatttaaggtacttcagcatagataatgtggtatgtaggtgtctgtttaaattagtgttaatctatatccaagaagatgcttaacattcagtacactctaaactcacacttgaaaggtgggttgcatatgaaagatgctgtactctggataattctgccagagcttcaaaacttgctatctgaatctgcacttaaagagtttcagaagagataatataagaccattttcaatagtgaaatgaatgatatgcctccactcttggatgaacagaagtgtgagaaatgaagagcctgggagcttaacaccttgggaaaagactcctaaaatttagaaccctatcttgcattcctccccttaatgaagggttttcttgtctgacaccattagaaagttagctgatctttcagtcagaacactttctcatttttcctgggaattagccttccaggcaaagtggctactagagttcctagatgatcagagtatcaggactacactgagcttacagagcaagaagtatgactgtttgggagtctgcttgtaatgggtatttgtacacctcttgatctgagactttcatgagaggttgtagaaagatgtacacctcagtaactatataccctgttttgcccaggagggtcccagtttgcacttactgtccagtcttggtttttaataacaccacttttcacttctaaaagtttccaagtttgaatgttaaattataaggatactcttttgtggtattttaaaacatatgtccacaaattatttgctatttctccctcaagagaaggagcctaattcctcacctcttgagtataggctggacttagtgaccgacttctaaggaatcaaataaggcagaagtgatgctgtatgactttggcccttgtcctaaaagatccccttgcttttttagtatttttagtacagatggggtttcaccgtgtcagccaggatggtctcgatctcctgacctcgtgatccacccacctcagcctcccaaagcactgggattacaggcgtgagccaccacgcccggcctaagatccccttgctttttttaggggggaccactcactggggggagaccagctgccatgttgtgagaacacccaagtaggcctaagataggcccacatggcaaggacctgaggtctcctgccaacagccaagtcaagcaggccattttggatgtggatcctcccgccccagtcaaaccttcagagaccacagccccaaatgacagcttaactacagcttcatgagagaccctgagctagaaccacctaactaagccattctcagattcctaattttcagaaactgaaagaatgtaaatatttgctcagcactgctaagttctgaagtattatgcagcaaaatagaatacaactacctatagctttcacacagttctcatctttagactttattgacatttactatgacaaatgaaaatgaccaaattgccctaggtctggctgagccccaaaccctctcagtatgttcatatttcagcatggcaaagcaaaaattaaccattaaattatacccaatagtagtaatagctatcactttttgggcatttagagtttcttagaaactttgctaggattttgtatagatttacctgatatacttctcacaataagccctatgaaaggtattcccaacttcattttgtaagcaagaaatctgagattcaggtaaggcaggctccaaaagttcccacagccattcattggtggaaccagctctccacccaggtctatctgactccaaagttcacactcttcaccaaacttaaaactacacactactgtctttcaacaaagaatccaaaaaaaaaaaaaaaaaaaagaacagaaattttagtgaaagacaatgaacaaatgcagagaaactttgtctgaaaaagaaaatatgtaacgttttatatgctgttgttaaaccatatttttttcaaagcaaataatacattcatatcgttcaaaagacacaaaagatattttgacaagatagcactcacctttgcccccagccacctggtgaccccttccggaggcaatgaatactgtttcttgcatatctttccaaatatattctatgtgttatcgaagaccatgcctacatatactccccaccactaccattgtttcttacgccagtgatagcatagactgtacattgtttggcacctgtttttaacctaagaatgaattttggatgtcattaagaatcagtgaataacaaagtatcctcacttttttttttttttcctctttgagatggagtcttgctctgtcacccaggctggagtgcagtggtgcagtatcagctcactgcaagctcagcctcctgggttcacaccattctcctgcctcagcctcctgagtagctgggactacaggcgcccgccaccatgcccgggtaattttttgtatttttagtagacacagggtttcaccgtgttagccagggtggtctcgatctcctgacctcatgatccgcctgcctcgacctcccaaagtgctgggattacaggtgtgagccaccacgcccagccctcactttgttttttttttttttttttacagctgcattatattctattgaattgtataacataatttatgtaatgactacccttttaataatgattttagttatttgcaatcctgttatttcaaaacaaaatgctgtgacgactaactttgcccatatatcatctctaaatgcaagttctcagcctcatagcctacactgacttgctgaaggttcagtcctaaggcattgtggactaaattatttactagctgaacattaaaactataggtactgtgttgtgatttttattgttatagtttctaatttggacttgagatctctgtggagaatggccataagccaagatagccgcttgctaggagagccctggttcaagtgtgttggtcatgagacaaaatgagaaggtgaaaccaaattgcatgaaacagaagaaatgtatgacttacatatcccagagaggttaggggtcccgatggcaggccacagaagtctggaggcaacagggagctcaaccaccaagcggggagcgagagaggagagagcacatgtggtcacgaggctttcattaaggcccattagccttcctgagggggttgtgaattgtctggtttaaagaaaacacagatgaagggggaacttattaactctggtgtgggccattaggttttatcatggccagcagctgtgggatgaggaacaagtgggctatattgtaaacaaccacacagggagaggaagttttcacctggtcgaatgcgacggggtactactgagttccagtaacttgtgttaggtctaaaatggatgcccaggcagcaactccattaaatacatttatgacagtactgaaactactggtttccttttctactattctgagaatggggtgagggcaaaagagcacattttcgtatttcttatcttaaacaagtgaataggcatttatcttctaacccactttatcagaaaatagctgatgaaatgatttgaatttggcaggcttatcagttcagttttcaatacattctcatttgtctgtgcaaccaaggaaatggtggctgctttttaatataaatacctttgtattttcctcaaacttcccccatgttctcttcttggaattcctacctgcttccgtcctgctcctcctgtaaatatgcaattatttaggcctgaaagctggaattcacctgtttcctcttttttgctctcccccggattgtaggggcaatcatcagaagagccagaagtgacctcgaaattctcattcttggttgccaggacaatgggccagctgggatgggaggctccttctcacagtatgagaggctgcactcacaccagctgctcaagtgaccagcccccttcccaacccgtccctcctacccgacacaatctcccataatctcaaggttgccacatgctgcatgactagcagactagcattcctagacaaagtctgtaaactgcagcctccagcagcgtgtctctccctgcaacagatatcaaggggttagtttccactgttggaatatagacccacactgcacatccagcagggcaccctgccccagcatacttctctgtgggatgatgggagaatggagaagacctgcggtctcttccctcgataattcttccagtttcccaataatttgtccctttttccaataaagcctcttcctaaacacatgctgtgtggcattgtggaacttgtcctgcccctgaaatgagataaatgagataaaaagagacccatcttgcctagcatatgaccggtcagtctccaaatactcctaatcctggagcggctggtttactcaatgatggactttgtaggtaaggcaaagtacagcattttttgtttctcacctctcccccttaaacctgccctgcagatccattctaagccagccctggaagaactctcaggcaaggaatataacctttctggtcactgtcacataataaacagtccattctagctgacctggctgaggggatgaggaattacaagagcagtcaatgtcaccagagtcagagccacctctgccaaccaccctcctgcggcatgcataggggaacttccagcagcaccacatcttggaacaaagagtagatgtccaacttaccagagggcaacatcctaccaaaatcccaaggcgaacagaaagatacaaggggtgagaagcagcctcctttattggataaaaccaagcctttcatacccgaccatgtcaacatgagtaactaatcaaaataattagaaggtgcttacagctgaatactgatcaagccttcttcctgttggtgagcagaaatagtatggtgagcatttccacactggtttccaaggtgtataaaaatgacaagaatgaagatggattcctgtaaatggtatatgactctccggagacatttggaatgaaatttctatttaagactggcgagacacatctattctagaatttttaaaatacttaacatggaagcaaagggatgctaccagctgagatggatccattcattcaatcacaggtcatcaaaacagtagcgtttccacctaggagttgtagaaaagcagaaacacttagctccagatgagtacattcagctttggaaagctatattacttaacctacgctttagaaatttaaaaacaaaatactttgcatttgaagttgccaataaaagagactttcaagttactttaatgtttttttccccaatatgaatttgcaattcaagcagtagcttaaaatcattcagagagactttttctctttagtttcacagaatctgccaacttgttttaaaaccagagaaatctccataagaggatctttaggtataagttttcaagaatagcccccccaaaactcattgccataacagttactgcaaagcaggatacttgggggtatatttaataaaaaacaaaacaaaaacaaaaaaaaacctgactctgaattgctgttcaagatttctgattttttatgggaagtataccaaaggtcaactttcttgcagtgttaacaagtttttacctggtttgcttctagaccattacacacagggaaataacaaaatcaaaccactgcttaataggaaccttgaataattgatagttttggtctggcttctaaaacggtcccagagggatttaaaaaaagtggcatttcttttattttggatttcctccaatctaggaattcaaactagttcttgatttggtaagtaaagaagcagttgtgatcagctacattctttgggacagtggtagaaactacagaatataaaaactaaaagcatgacaattcaaatgtattcccttctaccttttggcttaaagctatacatgattcatgttatgtgttaagtttaataaaagatgttattaaaaatttctcacatttttaagagtacttcagttatcactgttaggtgaaacaagtcatcacaatttccccactctaagtgcacgtcaattgtgaagaaaatgtagcctaaggagacatatgttctttacaaatacgaggttggaagttaaacatcttcaaagttcaatctagaataaatgacgatgcttctcgctacttacatggaagttgcatgggatttactctttatgatttcctgggagtatcagatagaccacagttgtgtcattgtagactgtagaggtagcaggtcaaagttcatccttctgtgtttgaatgtgtgtgaaatacctgtatctgttagtaaaagttatttaatggagagaaaaagtcaatttcactgcatatggaccctcaactgattataaaaggatctctagcctctgtcacctactcttcccactgcatgcatctgtccacagggctaatttttaaagtgtatgtttttatattgtgtaaattctttcagcctgtctagtttagattgtatacatcatcatatttggcattcttaccactcctgtgtgagccataagattcctataagaaatactgctttacaaaaaacaccatgctttacaaaaaatgccatgctttacaaaaatcacacattagtgggtggtcactttatttatagaattattaaagcaagtacttttttcctttctttttttttgagacggagtctcgctctgtcacccaggctggagtgcagtggcgcgatctcggctcactgcaagctccgcctcctgggttcgagccattctcctgcttcagcctcccgagtagctgggactacaggcgcccgccaccacgcctggctaattttttgtattttttttttttagtagagatggggcttcaccatgttagccaggatggtttcgatctcctgacctcgtgatctgcccacctcggccttccaaagtgctgggattacaggcgtgagccaccgtgcccggccaaagcaagtactttttaatgaactatatcacatattagtgggcagtcattttatttatagaatcgttaaagcaattgcctttttaatgaactaaagtgaataagacacaactaaaaactagttttaaaaggcacttgctttaaagatttaaaaattttaaaaactaaagtgcagtccagttttaaaaactaaagttttcagtgaaactcaaaagtctcattcaaaagtctcattataacttttcctcttccctacgtcaggcctacttcaggctgagaaatgtgtggcaaaatattctttagttttagaatcctttttttagtattgttctacctcctcccttctatttggatactgctttgggcccctacaagggtacagcaacagaagactggcaattagagagaatgggcataaaatatttaactttcttgaaaggtgtagctataatctttgttgatattcctggggtatgatgaaagcaagagcctccttggtactttgagatacctgtggtgtgatggcggtatgaagagaagcttggccctcttggccaaggtgaaatctacacacagggcaccatcaaaaatgccacaaagtcatctcttcccttatttcctggcctccaagtcattctgcacattgtcacccagtagtcttctaaaaatcagctctcaccttaatatcactctcccaagccctagacatacaggctattgttacaatttccccgaaaattcaagataccgttctctgaagccccaactctgaggtaattgcttctcctaaaataaatacaatgcatgttttttttccttatagagtcattaattgtttattatagaaaattaggaaaatatagaaaagtagaaaaaactcatatcgccaccattgtttcatgttttggtgtatttctgtccagatttgaaaaagcagctttacttttgtttgcttaggtttgctactttaaagaggacaatgaaacagagagggtaatatatttgtaattttgcatctggcttttttgacataatgttttaacgtaaatattttcctacattaatacaaagtctttgtacacatgtactgggtgatgtttaacttttttgtatttcaagcccagaatgcccttttatatatatacatatatacttttagttttgggaatcttatgcagcacgtgcaggtttgttatataggtatacatgtgccatggttgtttgctgcacccattaacccatcatctatgtgaggtatttctcctaatgctatccctcccctaggcccccaccccccgacaggccccagtgtgtggtgttcccctccctgtgtccatgtgttctcattgttcaactcccacttatgagtgagaacatgcggtgtttggttttctgttcctgtgttagtttgctaagaatgatggtttccagcttcatccatgtccctgcaaaggacatgaactcatccctttttatggctacatagtattccatggtgtatatatgccacattttctttaccagtctatcactgatgggcatttggattcattccaagtcttggctattgtgaacagtgccacaataaacatatgtgtgcatgtgtcttcatagtagaatgatttataatcctttgggtatatacccagtaatgggatttctgggtcaaatgatatttctggttctagacccttgaggaatcgccacactgtcttccacatggttgaactaatttacactcccacctacagtgtaaaagcattcctatttctccacatcctccccagcatcagtagttttctgactttttaatgattgccattctaactggcatgagttggtatcttattgtggttttgatttgcatttctctaatgaccagtgatgatgagctttttttcatatatttgttggccacataaatgtcttcttttgagaagtgtctgttgatttccttcgcccactttttgatgctgttgtttgtttttttcttgtaaatttgtttaagttccttgtagattctggatattagctctttgtcagatggatagattgcaaaaattttctgtttgtcagatggatagattgcaaaaaaattctgtaggttgcctgttcactctgatgatagtttcttttgctgtgcagaagctctttagtttaattagatcccattcatcatttttggcttttgttgccattgcttttggtgttttagtcatgaagactttgcccatgcctatgtcctgaataatattgcctaggttttcttctagggtttttatggttttaggtcttacatttaagtctttaatccatcctgagttaatttttgtgtaatgtgtaaggaaggggtccagtttcagttttccccatatcgctagtcagttttcccagcaccattgattaaatagggaatcctttccccattgcttgtttttgtcaggtttgtcaaaaatcagatggttgtagatgtgtggcattatttctgaggcttctgttctgttccattggtctatatatctgttttggaaccagtaccatgctgtttgggttactgtagtcttgtagtatagtttgaagtcaggtagtgtgatgcctccagctatgttctttttgctataggggctcttttttggttccgtatgaaatttaaagtagttttttctaattatatctgttttggtaccagtaccatgctgtttgggttattgtagctttgtagcacagtttgaagtcaggtagcgtgatgcctccagctttgttctttttgctatatgggctcttttttggttccacatatgaaatttaaagtagtttttttctaattctatgaagaaagtcaatggtagcttgaaggggacagcattgaatctataaattactttgggcagtatggccattttcacaatattgattcttcctatccataagcatggaatgtttttccatttgtttgtatcctctcttatttccttgagcagtggtttttagttcttcttgaagaggtccttgacatgccttgtaaattgtattcctaggtattttattcactttgtagcaattgtgaatgagagttcattcatgatttggctctctgtttggctattattggcatataggaatgcttgtgatttttacacatcgattttgtatcctgagactttgttgaaggtgcttatcaacttaagaagattttgggctgagacaatggtgttttctaaatatacaaccatgtcatctgcaaacagagacaatttgacttcctctcttcctatttgaataccctttatttctttctcttgcctgattgccctagccagaacttccaataccatgttgaataggggtggtgagagaaggcatccttgtcttgtgctggttttcaaagggaatgcttccagcttttgcccattcagtatgatattggctgtaagtttgttataaatagctcttattattttgagatatgttccatcaatacctagtttatcgagagtttttagcatgaaggggtgttgaattttatcaaaggccttttctgcatctgttgagataagcatgtgttttttgtcattggttctgtttacatgataaattacctttattgatttgtgtatgttgaaccagccttgcatcgcagggatgaagccaactgatcgtggtggataagctttttgatgtgctgctggattcagtttgccagtattttattgaggattttcccatagatgttcatcagggatattggcctgaaattttctttttttgttgtgactctaccatgttttggtatcaggatgatgctggcctcataaaatgagttagggaggagtgcctctttttctattgtttggaatagtttcagaaggaatggtaccagctcctctgtctacttctgatagaattcagctgtgtatctgtctggtcctgggcctttttttggttggtaggtgattaattaccacctcaatttcagaacttgttatttatctattcagggattcgacttcttcttggtttagtcttgggagggtttatgtgtccaggaatttatccatttcttctagattttccagtttatttgcatagaggtgtttatagtattctctgacagtagtttgtatttctgtaggatcagtgccatgtttcttggaggctttgctcattccttttcattctttttctctaacttcgtcttcacactttatttcattaagttgatcttcaatctctgatatcctttttccacttgatcgcctcggctattgatacttgtttatgcttcgcaaagttctcgtgctgtttttcagctccatcaggtcatttatgttcttctctaaactggttattctagttagcaattcctgtaaccttttttcaatgttcttagcttccttgcattgggttagaacatgctcatttagctcagaggagtttatttcccaccttctgaagcctacttctgtcaattcatcaaactcattctccgtccagttttgttcccttgctggtgaggagctgtgatcctttggaggagaagagacgttctggttttttggaattgtcagtctttttatgctggtttttcctcatcttcatggatttatctacctttggtttttgatgctggtgactttcagatggggtttctgtgtggatgtcctttttgttgatgttgatgctattcctttgttagttagttttccttctaacaggcccctctgctgcaggtctgctggagtttgctggaggtccactcccgaccctgtttgcctgggtatcaccaacagaggctgtagaatagcaaagattgctgcctattccttcctctggaagcctcgtcccagaggggcacctgccagatgccagccagagctctcctgtatgatgtgtccgtcgacccctgcagggaggtgtctcccagccagaaggcatgggggttagggacccacttgaggaggctgtctgtcccttagcagtgctcaagcgctgtgttgggaggtccacggctctcttcagagctgacagccaggaacacttgagtctgctgaagctgcgtccacagccaccccttcccccaggtgctctgtcccagtgagatgggagttttatctataagcccctgactggggctgctgcctttctttcagagatgccctgccaagagaggaggaatctagagactcagtctggctacagcagctttgccaagctgcagtgggctctgcccactttgaacttcctggtggctttgtttactgaggggaaaaccgcctactccagcctcagtaatggtggatgcccctccccacaccaagctcaagcatcccaggttgacttcagacttctgtgctggcagcgataatttcaggccagtggatcttagcttgctgggctctgtgggggtgggatccactgagcaagaccacttggctccctggctacagccccctttcgatgagagtgtacacttctgtctcactggcattccagatgccactggggtatgaaaaaaaactccttcggctagcttggtgtctgcccaaatggccacacagttttgtgcttgaaacccagggccctggtggcataggcacccaagggaatctcctggtctgcgggttgtgaagaccgtgggaaaagtgtagtatctgggccagagtgcactgttcctcatggcatagtccctcacagcttcccttagctaggggaaggagttcctcgaccccttctacttcccaggtgaggcaacaccccaccctgctgcttaccatctgtgggctgcacccactgtctaaccagtcccaatgagatgaatcaggtacctcagttgtaaatgcacaaattacccaccttctgcattgatctcactgggagctgcagaccagaactgttcctattcggccatcttgcccacgtccagtccctttactttaagtttatgagcgtccttatgtgttaggtgagtcttttggaggcagcagatggttggtgaattcttatccattttgccattctgtatcttttaagtggagcatttagggcatttacattcaatgttagtattgagatgtgaggtaccattctattcaccatggtgtttgttgcctgtataacttggttttttaaaaattgtattcttgttttataggtcctgtgaaatttgtgctttaaagaggttctgttttgatgtgtttccagaatttatttcaagatttagagctccttttggcagttcttatagtgctggattggtactggccaattctctcagcatttgtttgactgtatctttccttcatttacaaagcttagtttcactgaatacaaaattctttgctgataattgttttgtttaaagaggctgaagataaggccccaatccctttttgtagggtttccgctgagaactctgctgttaatctgatcgattttcctttataagttacctggtgattttgcctcatagctgttaagattctttccttcgtctcaacgttaagtaacctgatgacattgtgcctaggtgattacttttttgtgatgaatttcccaggtgttctttgagcttcttatatttggataactaggtctctagcaaggcctgggaagtttttcttgattattcccccaaatatgttttccaaattttagatttctcttcttcctcaagaatgctgattattcttaggtttggtcatttaacataatcccagacttcttggaggctttgttcatattttctaatttttttttctttgttggattgggttaatttagagaccttgtcttcaagctctgaagttctttattctgcttgtttgattctagtgctaagaccttccagggcattttgcatttctataagtccatccattgtttcctgaggttttgattgttttttatttatgctatctatttaattgaaaatttctctcctcatgtcttgtatcatttttttgacttccttaaattgggctttgcctttccctggtgcctccctgattagttcaataactaacctcctttttcaggtaaatcaggaatttcttcttggtttgaatccattgccagtgagctagtgtgactttttgggggtgttaaagatgcttgttttgtcacattaccagaattcgttttctggttctttctcatttgggtagcctctgtcagagggaagatctggggctcaaggctgttgttcagatttttttgtcccatggggtgttcccatgatgtagtactctcctccttttcttaaggatgtggcttcctgagagctgagctgtactgattgttatgtctcttctggacctagccacccagcaagttcaccaggctctgggctggtactgaagtttgtctgcacagaatcctgtgatgtgaatcgtctgtgggtctctcagccgtggataccagcaccttctctggtggaagtggcaagggagtgaaatggactctgtgagggtccttaactttggttgcttaatgcaccatttttgttctggttggcctcctgctgggaggtagtgctttcaagacagcatcagccatgatagtatggggaggaacaggtggtgggtgccgtcctagaactcccaagagtatatgccctttgtcttcagctaccagggtgtgtagggaaggaccattaggtgggcgcagggctaggcgtggctgcctctactgtgtcatgcaggttgtcaggaaagtgggggaaagctggcagtcacaggcctcacctagctcccactcaacccaaagggctagtctcactcccaccatgtgcctgccccccacccccaatagcaacaagtctgtttccaagcaatgggcaagcagggctgagaacttgccccaggatacctgcctcccagctgcaaaagcaagtagggcttttgtgcttcccctacctgtgaattctgcacaccggattcataccctcccccaggttctggccagaagacttctcaatggcttcaaattgttacaaagttcagctggaggtttccttcttcctgttcccttttcccagtgcctctggcagcctgcctcaaggacccctgtgaggcaaggcagaaacgacttgctagggcaccaagcgagcccacagggcttttcccgctgcttcttctacgcctgtattttgctcagctctctaaattgactcagctccgggtaaggtcagaatcttctcccgtgacctagactttcaggtttcccagtgagggtgtgtgttcggagcagatgattcccctttcctactttcacagtttgggcactcacagtatttggggtgtctcccgggtcctgcaggagcaattcgcttccttcagagggtctgtgggttctctcagctttcccgatttattcctgcagtcattctggagcagaagttcaacaacgcgagcctccacatgctgctctgtccgtccgagtggtagctgcaattcctacttccacattctcacttgtcagatcaaaacttttcttggggatccacagttaagcagagcaacagaactggaaaccacttctctgatttccaaactgtatttctcctctttcttggtattcaagcttaaaataaaattaatttttcagtcattcattcacagttgagcactttataagaaagttcttagtaagcatctattgtattatccctagaaggacaaattattttatgcttacacaaaacttttttttagagatggcagaatggggggaacaggtgatggtagagtataatcccagaataaatccccatgcccccttttttctgggactctgatcattggatttccactagtagcggaaaattattaaatgatctgttctatgccagcttggggagagacagactctggggaatcctagtctaaaaagtgaaaagggcagttcttgactaagtcatttggcctatcccaggtcccgtgccagcttcccttctacacgtatgtgagattgatggtgtaggtaaacagcaatcatcatatcctaacctgcatgtctacttaggattcggcctggaatccaggaatcacagaagaaaggtagctattgtaccactctgtgcctcctagcaggcctaggcatgtgcctagtggcctgtgggtaattattactctttcatggaggtgctaatgtaaacccttctcattgcctggcagtcaggctttccttggaatccagtggtcaggaggaactgacactcatggaagatggccacaccgggaggtagaacactgaattggagtcactgcattctcagggccttcatttccttacttctaaaaagaagagtctccttggactcttttatcttagctcatgtagtcacgaggaacaaatttctaaagcacttatcttaagaggggggttaatatatagctagacagaaactggaggtagaaagtcagagagtgtggcgcaacttcaggaaccatcctcagcatctatggctgtatctccctctctgtcactgcgttggtctcctctctctctctctcctccagcttccaaggctgccccctgcatctcttctgtgctcagataactcctgcttgaacatggctttcagtggccctggccctgattccagtacgctgctttgttttactttgaactccactcaccaactgattagttctctgtgtgtttcttagttcccatttccaagaaaaaactttgattgacccactgctgggggttgaattgcgtccttcaaaaagatatgtttaagtcctaacccacagtacttgtatgtgtgaccttatttggaaacagaatatttgcagatataatgaagatcagttcatactagatagattagagtgggccctaaatctaataaaactgatgtccttataagaagtggtcaaattttgacacagaaaaaaagatgcataaggaaaatgccacatgacagcagaaacagagattggagtgacgcatttaaaagccaaggaaaaagaatgattgttggcaaacaccagacactgaaagaggcaaggaaagaatcttccctagaatgttttgagagaggatggtcctgctaatacctcgatttcagacttctggcttccagaactctaagagaataaatttctgtcattctaagccccccagtttgtggccatttgttacatcagtcctaggaaattaatacatgcagcttatctttcggtgtcaggccagcctgggaacttggtcacatagggttggacactcactctttacccactcagacatggccaagagcattagggcagtattttccaatcagggccacttaggcagcaacgctgtaaacagagcagtttccttagaaggaggcctgagtgtgggtagatgtttgttggtgtcatctctccattagcaacaaggtggcttttgagttacctttcatttctgcccaggactgtatgccatctctggctgtttcccatcccaaggaacatttttgttagccaatgcattgttttaaatattaattattttctcacctgtgattcctcagagagtttcttggaacaaaaggcttgttggctactgtccagacctattctagtccacaggtgagcccagtggcagtgccacccacaccaggcagctgcatgaggaagaatagttctgggccagccttggaggcatattcacctggcacagccagagacaactacatcttaaggagaaataatgattttacacagaaaattaaatagagccaacattcatgccaagtgaggtaaagaaatgaagagaagaaggtccatggcctaagggtttgagagcttgatggacccaggtgccaagaatgaggaagacaacagtttaaaaccaagactataaattatgagcatatgcattattttctctttctgcctaaatggtgtgtgattccagggtggatcttgtgtatctcagcacagagtagacagcctaagactctattcctatagatgctttttttttttttgtgggggatttaacttcttcttaatgaattaatcattttggtatattagaactctatatttatgatggtagtcctgaatatttgtatctttttttaattgatacataataattgtacctatttatggggtacatgtgacattttgatacatggaaaccatatacaatgatcaaatcaggctaattaggatatctattccctcaaacatttgtgatttctttgtgttgggaatatttcaaatccataataataattaataataaattattgttaactatagtcatcctactgtgcaatagaacacctgaacttattcctcctatctataactttgtacctgttgaccaacctctcctcatcctccctgcccccatcctccccagcctctggtagacactactgtattctctacttctatgagatcagcttttttagatttcacatatgagtgagaacatgcaatatttatctttctgtacctggcttattttacgtaacgacctccagttccattcttgttgctgcaaatgacagcggcaaggattttattctttttttgtggctcaatagtattccattgtgtatatataacatatttcctttatcttttcatctattgatggacacaagttgattccatatcttagctattgtgaatactgctgcaataaacatgtagttctgaatatatattcaagaaactaattattaatttaggaacagaatcatagactataaggaattggcaaggtttcctagggtttcgttttgtcacttttctagatatatgctttcttgtgaatttaaatattttgttttcatcaatgtacaagtaacctatgtagtgtagcgattcaggatgaaatcttattttaaagattttttcacgcctgtaatcccagcactttgggaggccgaggcgggcggatcacgaggtcaggagatcgagaccatcccggctaaaacggtgaaaccccgtctctactaaaaatacacaaaattagccgggcgtggtggcgggcgcctgtagtcccagctactcgggaggctgaagcaggagaatggcgtgaacccgggaggccgagcttgcagtgagccgagattgcgccactgcactccagcctgggcgacagagcgagactccgtctcaaaaaaaaaaaaaaaaaaaaaaaagattttttagtgtctgatgccagtagtgatttagaattcggtttttttcaaccaaatctctgctgaagttctgtccatcttagtgcatttttttttctttcccagaaactccagctttgctaagacttagaattgtcacttcttcaggaaagcattgtttttcctcaccctggttcctctatttaaacaacactctgtgaaatctgtcaaattataggaatatcttccattgcctgctcatacactcacgagaaaaccttgggaaagattcctacctggagccaaagactccttggcactcactttcagcgacaatttgtttatctggaaagcaggtggcattaacctacctctaattattgtctgtgattcttaagcaggtaccacaagatctctctaccacctcctagagatagccgcatatctacaaaagatgggagatggtagatctgcaaatttcctgttaagtcccactatttagaaagagtccttgcttcctttcaatgttttaacttttaaaatatgggaaaactggctatatgttgcccgatagatttgcatgattatggccctttggggaaggtaataagaatgattgcagcatttttctttctgccctcacctcccatgtagacttggttatgcccacagagatttgactatgagtggaggacaactgtggcacttggggttatgaaaatccattgttgattgttaggcttgagctgcatgtataagcccatgtctaggatctggcccatcactgcactgactataattctgcctccagtctacagaacctgagggtggcagatgacagcaggtgtgttccatcattggcacccacactccacaccctccacaggctctgcacccgtgtcagtcagttctctagctatagctgtacctatcttttccaagggcttttgagaccagtgacccacaataccagtaagcccttctgatggaggtcctctcttgtctttgatttcatcatcatactctcttggattgattaaatgagcaaaggacattccttgcatggatgaaactggtcctctagctttgcccatgggttcttctcctatcctccttattagtggtggcatgtggaaagaaaaggtgcagttaacattgaatgagatgatattctagaaacatagcaattacagctcaaagagttctagagaagacatgattggaagacatgttgttctacatttatggtataaaattccaagtgataaatttaacataaccagaaaatgagttttcattcactttttttccgcataatatgggtaagacttgtacctgtggtcattatcaacaaagcatgttaacctttaagagagactttcaaagccaatattcatgggcagcatgatggatgatgccatgtcatgagtaatgatgtaaccaatattacatcagtggtatcaggaaactgcaggagcaagaatatctatgaatctgtatttgcttcaatacaaacaagttctgaagagccatagcattgtaagaaattagccagtagtggtgcaggtgacagtaaagaacacaaagagatggttcctggacctgaacaggtagagacattacaataaatatttttgtgtgctgaatggacaataaacaaatctgatagtatctcttttctacctattactttaaatcttcattgatagataaataactacctcacatgggtccatgaattttataatatatttttaatcaaattgcttatatagactggaccttgcaaaaaaatttttgcctagggcctcacacaccctgtcttcattcatttttcttgagagaaagaagtgcaacatctgctttctaggagtaattctttgggctatgaccttgatctcataccatccctttactcattttgtgtgtgtgtgtgtgtgtgtgtgtgtgtgtgtgtgtgtgtgtgtgtgtgtgtatgcttggtctctccctctctattgcttcttttcctcttacatttatgcaaattctcctttttttcttgaccttccgatttcagtgagccaccataaaacgctctttcttttcactatcacacttattaaaagaataattcacagcttcttcacccatctgtattaagttcctgtaatcacaggttctacctccattaatgacccattttccctttctctctttaggctctgttcgtgtgtgttcttttatttacacttaattcagcattgacctcttttctgaacacattctgaagatatgcatttccacctgccaacctgacagctccacccttatgatctcatgatttatttaagctaaacaaacttaaaattaaatctaccattgagctccatttcttattactcccatctcccaccctcacctaaaatgctacttctggctttcttattttgatggaggttatggatttcttgggagcattttttctacttcccttttgagagctttttttgtatatgttttagtactcatttactactcttcttttgctctgttcttcaccaagatggctggctgataatattgatcgtacattaatcatcatttctgctttctctattagagataacggtgatacaggaaaagtttccattgaattctgagatatgtcttaaggaaaactcatttaaaaaaaacagcaaaaaaaccgcaccttttaatgtatgtctctgtagttcaaaattaacacaggattgaaagttgaggaaattaaggaaatccccagaaaataggaggaaaagataaagaaataaaaataggatgaaaaaggtgaggaacgtgagagaataatctaggagtccatgatatctctaacaagagaaaagcgcagaggaaacaaagggagggatacttaaatgaggagatgcaagaccctcctaggctaggaggtgacctcaggtttgggactattaccaacagctccctgagtgttgttgcgcttcacgtgccacctggatcaatttagtcacttggcagatgtcagtctctttttagagattatctctagaatcaagtagaggcagttcagagtcattaagtcaaccactaagtcagaaaactcactatgagatggtaaaagaatgaagacaaatctcagactaaatcttctaaatttaatgctatataatggccaagcaggcacaaatagttctgcaacaacttgttggagtttgggagaggacttgttgctatgccttgaagaacactggcagcatggctaatgaaagactctgagccaatgtgaccttgcaggatgagaggcctggtaggcgactcagatgtatggtgtggggaggtcatgggggagaatgcaggctgcatctcccgggaatcttccatttggagcccatgggcacactgcctcagattatgccccaataccacattataatgacattcataagttgtagtaaatttatacacttgtgcaatcatcacaattgagctttcgaatatttccatcacctccaaaatttccctcatgctcatttgctgtcaaccccccttcccatctgctttctgtctttataattttgctttttctagaaattttaggcaaacggaaccactcacaatatgtagttgtgtctggcttctgtcacttagcaaaatgtttctgaggttcatccatgttgctacaagtatcagtagtttgttctttcttattgctgagtactagttatttatttatgtaatttatcattttttttctttaatagatcttagtttttgtatcctatctaagaaatctttgtctatcccaagaccataaagatctttcctatgttatcttctggaagctctctagcccaagctcttacattaggtctttagtgcacagtgagttgatttttactgtatagtgtgaggtaagggtctaagttttgtttgtttgcatatgtatatcatattgtgctgcataaaaggttgaaaatatttttcaacattgaattaccttggtaactttgtcaagtatccattcaacataaatttatttctaagctctttattctgttcaatttatctatatgtttatccttatgacagtaccacattgtcttgattattgtgactttacgataagtttgaaattaaaaaatattttggctattctatgtcttttgcatttccatatacatttttggatcaacttgttatttctattcttgaaaaagcctactgagattttgattgggattgtcttaaatatatagatcaatttggggagaattgcagccttaacatgacagagtcttccattccatgagcataatatatcttttcgtttatgtatgtgtttttcttccacaatattatactgttttcttgtacagatcttgcagttttttcattaaatttattcctaagtattttattctttttgacgctattgtgaatatatttattttcttaattttattttcagattgttgattgctagtttatagaaatataattcatttttgtacagtgatcttgcattctgtaatgttgctgagctcagcagttacaatagattttatagattccttaggattttctatacacgagattatgtcatctgtgaatacatacaagtttacctcttcttttccaatctgtatggctttacattccaatcagcatgcctttacattcttttcccctccttttgcactagctagaatctccagtacagtgttgaataaaagttgttagactggatatctttgcctttttcctgatcttacaggaaaagcagtctttcacatttagtatgatgttagctgtaggctttttgtagatgtcctgtgtcagattgaggcggtttcctgtattcctagtatgttaattgtccgatgcttttttctgctactattggaatgaccatattttttatctttattttattaatatattgtattcattgatttttgaatgttagcttaacttgtactctgggatacatctgttcgtttctaatgtatagttctttttgtattttgctgggtatgttttgctaattttttaaatcaaagatatttgtacctatgttcatgagcctggttttcttttctttattttatcatactttaagttttagggtacatgtgcacaacgtgcaggttagttacatatgtatacatgtaccatgctggtgtgctgcacccattaacttgtcatttaacattaggtatatctcctaatgctatccctccctcctccccccaacccacaacaggcccccgtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaacgcttctgtattcatttttatgaggttagtattagcctgatcccaaagccagataaagacatcataagaaaagaaaacagaaggatatgaacatacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggacgtggagaaataggaagacttttacactgttggtaggactgtaaactagttcaaccattgtggaagtcagtgtggcaattcctcagggatctagaactagaaataccgtttgacccagccatcccattactgggtatatacccaaaggattataaatcatgctgctataaagacacatgcgcatgtatgtttattgcagcactattcacaatagcaaagacttggaaccaacccaaatgtccaacaatgatagactggattaagaaaatgtggcacatatacaccatggaatactatgcagccataaaaaatgatgagttcatcattagctatcccagaagcattgtatattacaaagaaaataaatgtaaactagtagaatttcagatcgcaaccacagatagagaagatattttgttctttggggtaaaacttttgaactccttagctcacacaaatagatgatgctgtaacctgcctatttataaataagtctcatcctgaatcaagaatggcagctagtcaggcaagccagagggagaatgtaaaaggaacatttaaaccccattacctgtgcacttagacaatctgctcatgtccaattattctactattaaatgactgtgcatccaaccaaagagaaagcttcaaagtagataaatagattaattcacagacttcaagggtaaagaagcttgtttgaaatggggttttcttacttctcaccatcctgtttggagtcttattcacactgagattgacatataagggaaccatttatgaaactgcacaccagcagaccatatgtcctaggaaacttgcctggatgtcacattgtgaggggtcttccacatgtctagtgatataagcactggaaaaactgagcccaagaacaagacttggttggaaataatttggcgtattaattgtataattctttttttttgagaagggatttcgctctgtcacccaggctggagtgcagtggtgcaatctcagcccactgcaacctccgctttccggattcaagtgattctcgtggctcagcctcctgagtagctgggactacaggtgcatgccaccacgcccggctaattttttgtgtttttagtagagacggggtttcaccatgttagtcaggatggtctcgatctcctgacctcatgatcctacctctgcctcccaaagtgctgggattacaggtgtgagccactgagcccggccaattgtataattcttattctgtccatatttttgtttcttcttaactcctccatcccccattcctgctcatagtattctctgtgtgtcattgtttcagagaaggtatgtggaaggttggagactttatgcacttcctagaaactgaagccaactgagtagattaagatatgagggaaagaggcattgtggggagatagactgagaagatcaaggtaagaaaaagataccccttggcttgaagagaagagagacctatggtcttggatgagcagagccatgcttctgcttcagaacattgccctaagaaggtgatgaggtctcagggacttactgctctttgccaagtctaggtggaagaagtcacagtccctaggattttgagccacagcaccagaaagattgctatggtctaagagtagaatggaagtaaaccaaaagcccaggcgtgaagctgccatacccccagggacaatggataacattttcttggacataaaattgataaaccaaagtttatgcagctccctctacactaaatcagcactggaaacttgacattatccaggcaggaggactgggaggtgcctcaagtaaggttgaggtagaatttactgccaggttagcttcatgggaactcagaatgaaaggcaaatgaatatattttaaaagcagatgaggtttcttgtctacttgactttgtggctaaggtttatttcaatgggcaggtacattcttctctggacacaaactgcaaagcttgaggctttgggagtacagtgggtttctcactggaaacaattttgatacaggcaaggaaaggaggcagtctacaatcagggtatacttttaaggctactggccagtcaattaaaagagcagttccatcttaaggttttgctacctttggagtaggtagtggttgggctgctgtgatggacaggatgcatggagagccttctccccgtcacatatgttcaccacctcctgtcctagtccctcaaaactgctcacaagaagttcagacatgtggttcttgcttttaagcttttttaaaagatacttataaatccagatcctgtacaattttaagcttttaagatctaagattcaaaatataaatcattaacaagatcttaaccacagcgggtggtgctttctaacctcccatcccaccgcaagaatgttcccttggaatggggaggggagggagcagaggaaagcctcaccagaaaggacaggtggggtagacgtagcatcactgaggctgacatggggatgccaggtggagtgacaaggaagaagtcaggccttagccagagctcccagagcagtgactctgtagaagaagcccctgacagaaatctccttagaaaaaacaaatgaccagtgccctggaaagctggctttggccatcttccctatggaaaccaagaccaatcagtgttaaagagagaagtgataacaaccaagagaatctgcccggcagaagcgttcctccctgctccttaccagtcacagggcagaaaaaggggtgtagaccattcctggtcaccaagctagcctgtgctggagggggatggggggaatatgaagtttcataaattaaggttttcatcaaataggagattgaaattttataaatgaacaagactgaagtataagaatgtgaataggattgtcttaactaaatacttgtggagctaggttgagatactaagttatctgactgttaacagctatagatggggaacagagggggtgagggtgggtcgagagagcacagttagcagcaagttttagaaaaataaaaattagattttgcatatatacccgtaagttgagcttcttcattcaaaattattatgtttacaagcaatataatttcttttctgcccttgtctgtttttttcttggcatgttatctgtatctattgattaattaagggttctttacagacttaggaaattagaatttggtcatatattggtaaaatatttttcccagtttgtcattgtgtgtcctctatttgtcattaatgaattttttcctgaagtatttttttatgtaattaatttgtcattattctgtggattctggagtttgtatctgatccagctaagagctttcctcaccctaaaataatagcaaaaacagttgttaattgtaatactttcttcccatgtttgtaaatgccgttttgagaaatccgaacaaacctttaagacagagcatcctctgttgctttgacagcaatgactcttttgtaactttttcttccagcatttttccactcatacttgggtatttttctccctgtcactgatgttctgacttgctatggatcactgacatttcaaggtcttcttcaactactgtcatctggctaattgcctatttctcactttgccatttgaatacactggttcctactatatgcatgaacacttctcacaatcactccaaatctctgttcaagaagtggcttggtcagaaagtctatcgtatcttcattccacctgcaagagttggtttgatgtgaagaacccagtctgttcctaaaattcaagatcagcagcagcctcagtgaacataatgtttcctcatgtttcttgggcttagacttgcattatattttcaatgccattttgaagatgaacaatgcctttccattccactttccagaattttcatctcctgctggatagggattatattgctgaaagtcagcagtacttattgtaagatgtaaggaattagcattaaaataaatagggcatgttatgtctttcatcagaggatttctattagggtattgccagcttgatccacctgtctcttgggatttctctgtgggctaaagaataatgttccaaagcactatataggcctctctaagaaagactcaaaaactatgtcataattactgtctcctaaaggtttttttcctctattatgaattcactcattaattcaacagatctttactgagcacctactatacaacaggcactggggataaagtgttatacaaaattaaatccctgctttcattgagtgtacattctcatggaaaagacatgccaaaaaaaataagttaaccaatatgtgccataatattagacagtgataggtgctatgaaaataaaatcatgctgagtcagggggtgaagaacagtaggcctgacagatggtcatcagggaagacttttctgaagagacaacattggaggcaagacctgaatcaaccgagggaaagagcaatgtggagatcatagggcaaagcattccaggaacaggaaacagcaacgcaaagttctttgcagcaatatgcctggtgtatttaagaaacagcacgtgggcccgtgtcgctggagaagtatgaacaagggaaagaatggagacacagataggataaggaagatcttataagccagatgccagtcttcaagaggactatttcgtatgattaaaataaagagatgattaaagtatgacttcacaaatcacatttattgttacacaaatagttttttttagaacaaatctcacagggaatactctcaaatagatgaggtatgttaaccctataatcagtgagttccaatttcatttagagttgaattctcatagtctagttgctcagttaggatggaaacaggcctttgtggatgtaaagtctgatcagttttgagacatccctttctctaagaggttcttgggagacacagcctgaccaacacaggggagatccatggaacatgcaaggttcctcaatgctagagagcagtgacagcgtagatggggaaggctcagatgttgacagagatggctcagatgttgacagagatgagccctcccacagcctgagctgtcaaacttctgtcaaaaccttgggtatgtatgtgttttggagtccagtagttaaggccaataactcacatatgtggtctgataaggtgtgacacataacattcttgcagggaatgggattgcactccattcttttttctttttaattgtattcctcagagatccttgttctgattgacttccattttagaaggctcactctggctgtagtgtgaggaattgaatgcagaagggcaggaatggaaacaaggagagcagttaggaggcacaggcccggcaagagatgatatgacagtggcttgggccaggaatgcagtaccggacggggtgagaggtggtcagattctggagatagtttgaagggcttgcattgggatgagagaaaacgaaaaaagtcaaggatgacactgaggcttttggcatgaacctgtaaatagtaatcatattatggagatgaattacagtggcggaggaatccgtttggggctaaattaaaaatttggcttttaacacattagtattgagaggccgattaaacagctaagtagagatttcaggcagacagtaaaatgagactagaaggttgaagacatggctagagataaaaattggggcatataagaagtatataggctgggcgcagtggctcacacctataatcctagcactttgggaggccgaggcgggtggatcacaaggtcaggagttcaagaccagcctggccaagatggtgaaactttgtctctactaaaaatacaaaaattagccgggtgtggtggtgggcacctgtaatcccagctacttgggaggctaaggcagagaattgctcgaacccaggaggcggaggttgcagtgagccaagattgcgccactgcactccagcctgggtgacagagtgagactccatctcaaaaaaaaaaaaaaaaaaaaaaaaaaaagtatgtaaagccgtggggctggatgagagctccaggaagaaaacatagattgagaagccatctgagacctacatcctaggtttctctggtgctagaggtcaggaagggaaagacgatgtagccaggactgggaagaaatggccagtactgcaggagaaaaccagatgatttcctggaaaccaaggaaaaaaataggcacttaagaaggagggaggggccaggcacagtggctaatgcctgtaacctcagctttagaaggccgagatgggcggatcacctgaggtcaggagtttgagaccagcctggccaaaatggtgaaacgccgtctactaaaaatacaaaaattagctgggcgtggtggcatgcacctgtaatcccagctactcagtaagctgaggcaagaatgcggaggctacagtgagccgagatcataccactgctttccagcctggatggcagagtgagactccatctcaaaaaaaaaaaaaagaaagagggagggatcaactgtttcaaaggctgccaagcaattaagtagaattaaacctaaggattttccactgcatttggctcctctcctccctgtttcctctcattcgatagaatagatttattcctagtggctcttagggccagtcttccccagtttggggagactactattgcctatagaatattttttccctcttccctactcatagaccctacttttatccagagtgctcacatatccacctcctctgaagctagaaataaccatatggcacaggcctagccagtgagaagtaaacagaaggcatagagcgcggaatttggaaagttctttaaaagggagtaactcagtggcaatgagagcttgcttcccttagctcatcctttttgttccgcctggaacatggatgtgacaactggaaatacatcctgacaacaggaagactatggatacttcctaatgaaggtgagcagggaagctggaaggaacctgaattattccatcatggtgtggagcctccaggacagtcctgaactatttaccttttgattcttttttcatggaaaaaaatacatatccccaatttgtttaagatactgtgatgcatttgttttctgttatgtgacaactgaacataatcccaagtgacaatgctagttgtgtggtctttacccatggctctcctggccaaagcactcctgtcatcccacaaaacagaaataacgtggggttggagatggcaggccatgattcctgggccatctctgctagtcctatacagcggtatgccttggtcatgttgcttgaacaatctttaaacttggctttctttgcctgtaaaatggctgtgttagaaggaccaacccttgaccttcttttatgactttacattttttccttacaattaattctcttgttggttatcaatgaattgctccggtcatgctgcttgagcctggatgaaatcaagactgtaaaaagaaaaaaaaaaaaaaaaaaaaaaatccatgaactacaataaaaataagctcctacaaaacttgatctccaaaaatggaaggcttcattccttttagtgactgcctggtaaagcaagaaaacacaaaagcaaaatttttgatcataagtgaaaagtaggcttgacacatttaaaggcctaaatttgaattacaaagtctaaaagtatttcaacattgtgggtaacttgtacaagtgtgggttcgcataagacttcagccataactgctggagacactggtggaaccccccagccccctagagagtgggctggcagaatcgtgcaggtcaacgtggatgagaactgactgcctggctcaagacccatgcctcgggtcagtgaggctagctttggaacccaggcagagggtatgtgtgtgtgttgtagagggttaaaggaaggcaaaggagaaatgaaaagtctaagaggaggaaagacgggggaaagtgttgcctctcaaagagaatgactttcaaagtgtcatctacaaacactgatagttagatctaaaatgccagcacagaatgtgctggttaagagtagtgtcaattcagggtccagtgattttcctgctggaaaccctccaaaggaatttgagacacagaggaagaacagtcctggcccgggcagaactgcttatgtcaatgtcaatgttcatatttgcatgaccgaaaacacacccagggcaggttagtcatgctcggggctattgtctgatccagccctgtcattctcacactgtgaaagagaagacttccacaacaagttcactggggcgaaacgcttaaagttggttgacagcttcagctggggccacttgtgtaggagcccagtcagtttgatcaatgtagctgagttggctctgggctctgtcatagccccagctgggttctgtttaccatttacttctgtgggatatcagcatatgcctcccaaaaatatgaaggaatgttgagctgaaggccattaacaggaaatggacgcaggcacactctctgcctttcctcttttttcctaaaagcaggatgtagatttacaaagacatgtatatatgaaatatacatgttaataaacttctgtttgtttttctcttctgaatttgtcttttgtaacaggggtcagtttcaataagaacctgttgagggttattatttttaccctacagttcaaacattttggtttttttatacaacgatgttgtaacttattgggttttttcttatcattaggggaggaatggtgggctcttgggtctttctatatctggtaaaggagagccacgtggttatggttcagtcccaagcaatatcatggagtccccgggacaaagcagcttgcaggcatgctctgtgggttcatggttgggagcttgtgacagcttttcttgtcaaaccctgcccagagctctttccacttcgaaaaagaggccccaggaggcagtgtcttagctcaaaggcataactggtcaacctaatggaaggacttcagataagtggcaagtagatggaatagatattttaaggtcacagaggacttgccaattcctttatatcagagaactgacggggtttgggacatgctacccccccccccaaaatatgacaccttgtgccagtttattaccattcgatcatgccattccttcatcctatcacatttcctccccattattcactcttcctcaaacctaccataaaatacactcagatttaataaaacttatactcagctttagtaaaactcatattaaataaatgtgttgcttttttcttcgtataggagtctcagccattaacctagggtgagcagagaaaaaggtacttttcttctcctatagaaccttggaacctgcttcatttctatgcctgaactttgtaccagctgctgatgttaccttgggctcagaaaaataggtaaagggactagagacaataggagagagggaaaggatggccctactgggagaagaatgaggcagtaatgtttcagatcaccaccatcaaacataggcctgaagatcctacccttctcccatcctatccctgcccccatcctatctccccctgttaactgagaattttttattcacccattcaactgatacaaattcattggagcacctgttatacacaaaacaccatactaaattctgggatatagtgagcaagacatataaggcacttgctctcagaagagatagtaaaaagtaaataaataaacattgtggtaaagagtcactgcaggagctcgtcacgtttgagctgagatctgagaggtgaagagtgaaccagtcatgcaaagagctgtgaaagggctttctagggtgagggaagagcaagtacaaacactctgaggtgggaaagagccttgactgtggaggcagagaaaggttgccagtgtggctggagttcacgggagctgaagtgggaggcgtatgaaagactcaggtaggcggcaggagccaagtcacattgagccttgtcttgcaggttttatgagaggccatggaatgattcgttgtaggagaggggctcaatctaatttagatgaataatggccacagtggtagctgtgggagaatgtattgtgtattgggcctggagggaggatactggagcataatgttggaaattgaggaattcctccctcagccttgctctgtggggcttcaacagctgaggagaaaatcaaagattggggaagcatacattcttttcttccccatccagaattctcttcctagttcccaaagatcttgaaggcatttattttcctcagtggttattgtgtcttttctgctggggggatgtgcccacattcttttcactgtctgttgaccaccatctgctgccgtctggactctcataactcccctcctcccattgctgctactttctgtccaactgctgccaagactgtctagggatgggagtgctgggatggatcttacctcatgattggagagatttcccttgacaagactgtctcagactcaggccagagggtgctttaaggtcattactagttgccatatggaatacctctttcagtgttctgctgttcggttgtcctgtctccagttctttgagtggctccaacccaagccatcttctacttccttctaaaaaccaacaccctagagttacctcagcaagtattatattccactcacttattcccatcctgctgtcaacctgatccagtgtgatgctgacctgagaccctgtggacttgacttttatccttggaaatgaacatttgtggaaggtgtttctgctatttgagcatcagcttttcccactgacccctgacttggtctgtccctcccatctctgccactaaaacagcctacagccgatccctctaattggcccctgattccctgtgagaaaggcttgacaacttccttggatgcatcctctgcccaggtgagtgaccccaccctcctggaatctgaccatctaatctaaagttgcctttgccctttctcccaggagtctgagaatgtcctcatacaaactggactcacagctggccctgatattctagaatttctaggcagacatgaaaattagattgaagctgtgaccttcatttcacacatataaaaagaatgtgtgaggacctatgactaatgaaagcagcctcatttcttcacagtcgttttccaaataccactaattgccctatgctttcaacgcaaacacagagtattactcaaactgccacagaaatgaatgagtagagagtaccacacctgggtcactagcacatcttgaatgacaaggtttctgttctgctctcttgacatcctacccttggaagtgacaagattggagtagacactggctcagggatcgtttcctccctatctgccctctacatgtatcctatcatctagatttccagcactttcttctttgctacctgaaagaatctaaccaataacatgagtaaaaagaaccagactcggtagaagcaaacatgactatcttgctctttacaaagccaaatggttgatagacttccctgtatgtgggagagagaaaggaaattctgacccaaataagttagaccttttctgtaggatgccagaagaagctgagattccaagcacatagtgttttggtttcgattttggaagaattaaagaagactcagttagtaattggaaggggacatgaggaaattgagaatagaaaaccacatggataaggttaaaacaaatcccaaatccatttaaaaaaaaaaaaaaacacaatgtcccattgccatgagaaaatgaatgtaatgagtgtttcagtgtattgtctatgtacgatgttgttgtaaagccattttaatgtgttaggaggtattttactctcttcttgattgggtcactgaagtaaccgtgaatagcaatgtggtgcatagaggcagtgtggaaagggcgctgggcccacagcaagaagacctggattgtgtaccatgtgaggacaaaaggccacataggtctctaaccaatgatataggttagatattatgtaggaggaagacaaagacctagagactgtgcagcgttctgagcagtgagcacttgaagatgtgccccactccagagatacacactgatacatttgtgatattcaggggactaaaactggtcttacgccatggcaatcctcgtctcttacaggacattccttctcaggaacatccaacctactcctacacagagaaggcttttggcccctcactctgcaaccaggtggaagtggcaaaacacttggtgggccacccatgcccaccgtcaccaattacattaattcttacgaaggcacttgagttccatcttttttttcctaatatattgatgtgctgtcattctcaaacctaattcttaaggggtctgaaattactgatgaattagaagaaattgcattgtgaaaatgacagatgagattcagtattaacataaagaagaaatggtgttttacaagtaacagtcaatgataattgcaaaacaattcttacagcattatgcatggaaatgggtataaatcctagtgaatcttatcttggatacctctacagttacggtttgcaacttgagaacacaggactgaagagggcttatctggatcttaagattgtggaaaagaaagctaggattttgatgaagtgtagatttaaaattctaagccacttggttctaggtcatatccaaggtctaggttacacattcaagagactgcgtgaacaactcttgaatctcaactctgctttaaaggacaccctgttaaacagtccaaaagtaaacgcagtattgcgagtagctactgctatctgatgcatatttctgaaatatttcctatatgaaaagaagttgagtttctgtttcggtaatttggctggctggagtcaaccaaacccataggtttgactcatagctgatctacctttctggatacctgtatcccaggaatgaactggaaccaaaaaggctggaagttattgtttcttcactattagactctgaggatttaacaaaccacagaatggtcagcaccctgaggctgaaccagaactgaccagcccttgggagtgggctctttgtgaaggatcctacctggtcagttaccccattcccagccaccctgaccaataactttggcagttaaaacaatagcaacctatttattgaaattagaactgttttggggtagttactttcctttataattagctgtgtgactagttagattaactcactaaagtgactagctgaaaatcactatgagcaaatcattttaacttcaggaactaagttctgatatttgtaaaataaaagccttggactcagtaacaattaataaactataaacttctattaagatttatggtaagaaacataaactttaaacaatttaggatattaaccattaggggaaaagtctaggtcttattcatctaaaactccctatttcttaaatgtttctactaagtcaatcttggagttataaagatgcctaactgatagagcaacttttttggatttccttaataatagggaatacacatacttcatgaaaatccccaatattgtttacattagaataaaatttaagtattggacagaagagtttagattacaagaagaattcatttaaatagcacctgacgttccctaacaacagtgattttatgaaacattgtaattgatttgccacctatgtgtggatctatcctaaactgactcctttagtttgcaggttcgttggggattcaatgtcttttacttctttttcagtctcaacaacagctaattcagtactctaaatatagtcagcattcaatacaaatttaattattgactgaatctaggctgtcaggggaaaaaaagatttgctacttgtttggacatgtctctctgattcaatgccacttttgccttaccagctaatcagtcagtagactaagggtggtgcatttttgatcttcccccttaaagaaggtcagtggctgaaaatgagatccagagtgattacattagaaggattttcatgtgtactccatcagggagattaaatgtccaggtgcctcccacgtttccttttaggacttgttcttagtcttcatacttcaagggctcaagagcagcactgacacgcaacatattcattgtccatccccaattacgttctcaaaaggtaactgttacatattgtattagagttctccagctaaacagaaccagtaggatggagagaaagggggctcgagaggaggagggagatgggggagagagagaaggaagggaagggggaaagggaagctggtaaatctaaaatttgtagggcagcctggcaggctggagacccagagaagagttgatgttgcagctgaagtgggaaggaagataggaggcagaattccgtcttcctcaggagacttcagttgtttctcttaaggccttcaattgtttggatgaggcccacccacaccacaaaaggtaattggctttactcaaagtctgctgattgaaatatccttagatctaaaaaacatctttatagcaacatctagaccaacgtttgaccaaacatctgggcactgaaatctgggcaagttgacacaaggaattaaccatcacacatatcaaaatgggacattttcatcattccagttatcttttgaaagttctctgatttctttcactatttaaaatattctccaaataacaaacagttcgccaatgctgataattcttttttttttttcctttttctgtttttttctctctttcataagacagggtctcacttggtcacccaggctagagtgcagtgatgtgatcatagctcactgctgccttaaactcccgagtgcaaaggatcctcccacctcagcctcccaagtagttgggactgtaggagtgtgccctcatgcccagctaacttaaaagaatttttttttttataaagacaaggtctcaccatcttgccccggctcgtctcaaactccagaggtcaagtaatcctcccaaagtgctaggattataggcgtgagccactgcacctggccatgattttctaattacagaaagaaaaaaactttctatggtctttcactgcctccttccaccaactcctacttcagattttgttcattttctccataagtattatacattggtgcttaggagacaaagaagagacatgggttccaaccctcaaaaagcctgtagtgggagaagaatgtgcaaatgattgcagtggtgtggggtttctgctcaggtgtttgatagaacagtagaggaagtaaaatttaataagcttattagcatataggtggtgcttgcatacacaagccctgtttgggctgcacataccctcattgtacaatggttagaagtatgatttccccaggagctgagtctaagggcatgtgaccataaaggtttataaacaaactcatcatctcaaccccgtcgcccccgtatacactcagctgaattagtttagtctctcagtaacatgtgttgcccaaggagatgaaatttacctcaatggcaacttctctttatgtctgcttaaaactttacatttctcttctagcattttgttcattaaactccagattttaaaatagactctataggtacatctgtagttgatggagctgagtctgaggatggagtggacaagagtgctgacctgtgtcactgagaccaaagcaaagcctcttttctcacagcaccatggggatgtgattatacagctctggcactagctcctcagagccagcaaggtattaaacaagcccagacttttcactaagcctttgtcccccaggcactgctgagaaaccactgccaacaggaattgaattctaggaaccagcatgccaagaaacacacctcctggaattttgagcatttgacggaggtctggcaagccctccttcttcttattgatattagtagtagggagggggcagaggggcttgtggatagagactggaaattttcaaagatgtccagttctagaccacagatagcatcttctgtttttagaactgagagccaataccatcaatggaataaggaaagttattattggttttgccccttccagatttaagagggtcctgtcctcttccaacccaaaagcctcctgccacttctctttttttctttgctcccaggtatgagccccatttattgtctcaggccaagatacaaaggtggagaaatcctgcattctgcccaaagtgtgaagggctctgtgttgtagatggtgctgctgtcagtgggctgcttcatgttcttgacccacatgaaagaatttgagagtgagtccaaagtaaaagcaggcaaagacatttattgcaaagcgaaaggacactctgcaagccaggtcaaactgggttccttgagaataagacagtcccctctgacattaggaaatctcatttatggaaagcttatgtgattattcataagagggtgggaatgagcctggctgttggcttaagcatgttgcaggtggtctcctgggcgtgcatgtgcaatgctatcacatatatggcatgtcttcttattagcatcttaattctctacccaggagtgtgttttttactattataatgagcacaggtcatggacactaatcatggtcaaggacactaatcatgggtttctgtgcttgtgcataatttggggattttcccttctgctcttcgtcctgtctgctgcaggatgtcctaaccaaagctgcagatgccgtttctgcactctcaagcggtttgttttctccacctgtttggcaagtttgtttcccttcaagtgactctatgaccatcttatctaacctatctctgtgccagatatgtctgtaattcctctctgaaatattggaggaaggaaacagaactaagtttctcgattatccacttcacatgcttaaaattccagtgcgccattagatcctagaatggttcagagtgagagttccagagaaaatggaataattaagcagcaaagcccaggcatataccatttaataaagctacaaaaaatcctgagattctgaaagtagaagaaaaacatttggcataagacttattctcctgctttttaaaatgatcctcacattttcaatatattctgaaattaaatgtttcattccacttaaatgacttctgcatattaaccatcagtctggggcaaattttgtgtttcttttcttatgttttatcctcccagctcctgagagcaattacattggctcaagtatttgaaaaatcactcaaattaaggaattgcagtccctcctattcttcagtaggcaaataagaaatataggatcagatccatctctccccataggcacatctcatgggaatcataatcagaaggatgcttccggagtctttaatctgagcaaggggtcctggtggggtgatggaagtgtccactggcgtcagtctgtgacagcctgatgtctctgtccacagcagggatgaatctggacaccagatggggctgtgacctggtatgccccatcctcctctgccagaacaggatgggtgccaccatgtgcagttttaaagtaaactgaaaaccagttagttttacagatatttgagaattgtgaattatctcttgaatcaacataattttgcaaagccatagttaataggattgagttgctgcacaagtgcttctcagtggtccggaatcaacttgtgtccaaaatgctgcttgatgttgatgcaggaggcagcatttcattaggccagaaggaaatgctgcaggtggtatcatgtatatgtagatttaaatcataagaattagagaaagatgaagtaggaaaaattgatatgggaaaaaacagaattagaaggaggtgagaggcaggggagggaagcaaatacgtcttttaagaggatctgtttttgctggaggtataaattgcctcccaaaactatgcctgtgaccacaggttcctgacaaccggttaggcaacacaagcatctgagtggagaaacaagccatgcgtcctaatctgagattaactgaacagtaatcccttgggcaagttgcttactttctgtgtatttttcatccataatcccaagataacaaatatttgcaacgtagaatgaaaataaagatcaaactttgtggctcaccatgatggtatccagccaaaattactagttgttattttctcagctccattctttcttctccttttttctttcccattaggtattgaaaactacccatttatttttcttagtaacaccaaaaacttaatttcaaattggagtcagcccctaaagcaagccaaccaataaccaactaaatacaccaaaattgttcagaatatgtcataacattcacttgtgaatttcttcaggctcaagcattttggtcaaagaattcggaagtaaattatattaataagtactatgtcctaggttatatatccacagcctggcttggatttagtccaaccttgctagataggtgttacttatctcatttcacagataaagaaagcattttggtgggcttaatggcctgcattcttattgctagtaaatgtggaattgtgatccaaactcacatctgtctaacttgaacctccttcctgtgtcaaaccttcttcccttaatgcctgataccacttcccaatggggaggagtattctttgaagaatcgatttgggaacttccttagaaaaatgtaataacttccagtaaacttgctctgcagacacatgtattatatgattaacaggttggactgtctagttatgcaatctagggcaaatttcttaactgcacctaagtttcctcatctgtaaatttaggttaataatggtaacctcacaacaacaaatgaagcaataaaacagaagagaatattcagaaatattctacccatgtcggctcacctcttttgggacagtcacttcaataaatgggactcagttaactggatagcaatatggaaaaaaaatcacttaatctctactttacaccatacctcaaagtcaattccaaatggattgaagatttaaatatgaaatacaaagcaataaagtttttaacaagaaaaatatttaataccttagaataagcaaatatttctgatttcttatttattttatatttcggggtacatgtgcttgcttgttacatgagaatgttgtgtactggtggggattgggcttctaatatacccattagccacgtagtgaacattgtacccaatagggaatttttcaaccctcatttccctcccacgctcctcacttttggagtcactaggtctattgttttcatctttatgtccatgtgtacccattgtttagctctcacttataagtgagaacctgtggtatttggttttctgtttctgagttaggataattgccttaaactctaactatgttgctgcaaaggacataacttcattctttttatggctgcagagtattccatggtgtatatatagcacatattctttatccagtcagctatcgatggacacgtaagttgattccgtgactttgctattgtgaataatgtaatgatgaacataagagtacaggtgcctttttgatataataatttcttttcctttgggtagatacccagtagtggatttttagttctttgagaaatctccatattttttccatggggatgaactattttatattcccaccaacaatgtataagtatttccttttctctgcatccacgtcagcatctgttgttttttgactttttagtaataaccattctgactggcgtaagatgatatctcattgtggttttcatttgcatttctcttacggttagtgatgttgaactttttttatatttgttggcttcttttaagcaaacatttcttttttttccaacttttatttcaggttctggggtacatgtgcaggtttgttacatggaaaaattgcataaaatgacaaatgatcctgtcgtgcaggtagtgagcatagtacccaatagttttccaacccttgcccccctccctacctccctgctctagtagtccaccggtctgttgttttcatcttcgtgtctgtatgtattcaatctgtactcaatctgcagctcccacttagaagtgagaacatgtggtatttggttttctgttcctgtgtcaattcactaagaggatggcctccatctgcatccatgtttctataaacaataagatttcattcttttttatggctgcatagtattcatggtatacatgtatcacattttctttatccagtccatcactgatgggcacctaagttgattccttctttgctattgggaatagtgctgggatgaacttgcaagtgcacatgtctttttggtagaacgattttttaaaatatatacccagtaatggggttgctgggttgaatgggagttctgttttaagttctttgagaaatctccaaactgctttctatagtgggtgaactaatttacattaccatcaatagtgtataagcattcccttttctctgtaacctcaccaatgtctgctgttttttgactttttcataatagccattctgactggctactggtgtgagatggtatctcattgtggttttgcttgtaagcaaagatttcttattcttaaacagaagaggaaagtgctataatacaggaaaaaactgacaaatcgctctataacataaataagactataagattaagatcatgaaaggcattattaacagactgaacaggtaatccacagaatagaagaggatttttgcaatatatatataactgtttcaaatccaaagtctatagcactgtttaaaagcatactgttatgaaaattaaataaattaaggcaagtttagagtaggatttggcacataatatgcattcactcggtatgtgctattattattattactaatcagaacaaaagtctaggaccctcctgttttgaatttctgttatactgccagcctttgtgtgtcaggtttttggtttggaaaacataatcctatagtaatgaggcaccaggaaggcaaatctgtagcctggaattcaaaatacaggattgatttaacgacaggatttgttttcctgatttaaaaacaagaaaaataacatgttttcccaatatttcagtaatttattattgctaccaacctctatgtgctgataaggcataaagtaaggagttatgttaaaatctgaattcagctcaaagagcaaagcgtaaggacctcatgcctactcctgcatcctttccattggcatcaccaacatctcccagttctcttggccctataggacctccaagccccacagaacccgccatccaggaggctcttccatgaggcctcactctcaagccagtctgaggctgactcctttcagaggcaccagagtctccccatacactttatatttgatatatcctaagtatctctggaaggaggacctttaagttctcatatccaccaaaggtcttcgaggactgattctcttacagtcttgcagtccccataagccatctcctattatcagcaccctctgccccaagtacttccttaactcaaatgacttccatttctatgtgaaaactcctccagaatgctaccttgttgagctcatgatcactctttcctcttcaactacccactctcatggccttgccttaaacattgtcatcacccgatgagcaactgttcctctgaagtaataaatttaggcatcccactcttaaaccacaggctcatgttcttccaattgtctattactcatccaacccaaatttatatattaaagtcctaagtcctagtacctcagaatatgactatatttggagataagacctttaaagaagtaaattaaggtaaaataaggtcacacgggtaggtcctaatccaatatgatgggtgtccttataagaagaggagattaggacatagacgtgtgtgtacggagagactgtgtgaggacacagtgataagacagccctcccagccaaagagaggcaccttagaagaaggtaaacctgttgacccttggtcttgaatttctggcatccagaattttcagaaaataaatttctgttgtttaaaccacccattctgtagtatttgttacagcagacttagcaaactaatgcaaccaccttccatagttccttctctttcagtctgatttgtgttccatgatgcatgcaccactctttctgctttcttgttccatcatccttccagtttgctggcctggcaaaatctcaacctcacatgaacataacatttgatcttgtctaggcctgcatttaagcagctgaatgtggttggagaaaattacaacagcatgttagctgatgaaacgttaaagtcatacgtgaaatctcaaccaggcatgctacttccctggttaggtttctttccatatccatagacatcctacctttcctcctcttctcttgctcttgacaaattatcttgcctccttctcaatgaaaaaggagccatcagacaacaacttactccacctcttaccatcaaatcaacacacggctctgctctacacccatcttccacttttgctgtagatcatatgctttccctctacctcaggaacttccttcttttgatgatcccctctgtcccatatcttcaacctcttcctctatgcaactccttctgaggatcatttaaatataagcaagtctatttcaataaaatcaaatataaaatctaaccttcattccatgtagtacattgattgcaaaaaatggccccaatttttttcttttttaaataatttcaacttttattttttatttttaattttcgtggggacatagtaggtgtatatatttatgaggtacatgagatattttgatacaggcatacaatgtgtaataattacaccagggtaaatgagttatcctcaacttttattttggattcagggggtatatgtgcaggtttgttagatgggtatgttgtgtgatgccgaggtttcacatatgaatgattctgtcactcaggtagtgagcatagtacccaataggtagtatcttacccctcggcccctccccacccatgctaggagtccccagtgtctattgttcccatctttatgtccatatgtacccaatgtttagctcccatttccaaggaagaacatgcggtatttggttttctgttcctatattaatttgcttagggtgatggcctctagctacatccatgcttctgccaaggacatgacatgcttctgccaaggacatgattttgttctttttatggcttcattgtattctgtggtataatgtatcacattttctttatccagtccactgtagatggacacctaatcgattccatgtctttgctattgtgaatagtgctgcaatgaacatacgagtgcatgtgtcttttttatacagtgatttatttacctttggatatatatctaataatggaactgctgagtcaaatggtagttctgttttaattccttgagaatggaattgctgagtcaaatggtagttctgttttagttccttgagaaatcacagtggttgaactgatttacatttccaccagcagtgtataagcattccttttcttcatagcttcaccagcatctgttgttttttgtcattttaataatagctattctgacttgtgtgagatggtatctcattaaagttttgatttgcatttctctgatgatcagtgatgttgagcattttttcaaatgtttgttgaccacatgtatgccttcttttgagaagtgtctgttcatttcctttgcccattttttaacttgttttttgctttttaagttccttatagattctggatattagaactttgttagatacatagtttgcaagtattttctcccattctgtaggtttctgtttactctgttaatggtttattttgatgggcagaagctctttaattaggtcccattgtcaattttcatttttgttgcaattgcttttgaggacttagtcataaattctttgccaaggccaatgtccagaatggtctttcctcagttttcttctaggatttttatagtttgaggtcttacatttaaatctatcttgagttaatttttatatatggtgaaaggtaagggtccagttttattcttctgcatattcttcagttttattcttctggctagcaccagaagaactggcattattcaagcaccatttattgaatatggagtcctttccccatggcttatttttgttgattttgttgaagatcagatggttgtaggtgtgtggctttatttctagattctctactctgttccattggtctatgtatctgtttttgtacgagtacaatgctatttaggttactgtagccttatagtagtttcaagtctggtaatgtgatgcctccagctttgctcttcttgcttaggattgctatggctattcaggctctctttttgtttgtttgtttcatatgaattagttttttctaattatgtgaaaaatgatgttggtagtttggcggcaatctgtagatagctctgggcagtatggtcgttttagcaatattaattcttttaatccattagcatggaatatttttccatttctttgtgtcatctctgctttctgtcagcactgttttgtcgttctccttgtaaagatctttctgctcctttgttagatgtattcctaggtattttattctttgtagctattgtaaataggattgtgttcttgatttggctctcagcttgaatattattggtgtatagaaccgctactgatttttacacatttattttgtatcctgaaactttactgaagatgtttatcaggtctaagagccttttggtggagtctttaggggtttctaggtatcatatctcagtgaagaaagataatttgacctcttcttttcttatttggatgccttttacttccttctcttgcctgactgctctagctaggactttccttattctttacatctacttatgtgctttacagtgagactgtgtagtttctcctaccaagaggtcaatccccttctctttaagctgaattttggctgactttgtgacttgctttggccagcaggctgtgacagggtgatatgccaattcatgatgaggcctcaagagatattgcagacttctgctctttcttagaaccctgccattgccttgtgaactagcatgctggattatgagagaaacatggcccagttacctgaaacacccaagccaataaaaaaatcaacttccaaaactctgagtaggctcatcctagattagccagttctaagccgactccaaatgcacgagtgagcacagccaggctcagactgacagaaacaaccaactcattcgtagatatttgagtgataataaatgctgattgttttaaaccactgagttttgaagccatttgttatacagcaatagctgatacaccccatgtctactttcatcgaatccaatcttttgcctcttaattcccagctaaattaattgaaataacatactactcttggtctcttcacttctttacttcctattcactcccttaagtatcctagtcttgcaccagccctaacactcctctaagactgtttttgctaaggtctctgtatctgtcctgttgttcaattaagtagacacttttgatataaaccttaccaaaccttttagtagcattatcaaaattgactctcctgttttggctttcgtgctgaggcagaatactgttctgactctcaagtcactccctctggggatcctcggcagacttctctttgattttcaatgctctgccattactttactgttaattgggaaatgtgtcctagagttcttctctttccactttacacacctttcctgggagatctcattcattcattttcttgcataaaacttctcttttacaatctgattactattaaaaaagaaaaaaggcacattatttaatgaccacatgagaatcaccatgctgtgttgtccaccaaatttgactacttcataggtggttaagaaatagtacatactggacgagaacatgtaagaaaattaaataaattcttctgggcttgataaaattaggtagacttttaggtcatacaaattgtttctacatgatgatcaggactagaaataacatttgtttatttcatgaaagtctgaatgtagttaagagaaataacttgaaaatcctgcacaaatgttgatttgatagtccttacattattgtttttgtttttgttttcattgagacaaggtctcactctatttcccaggctggagtacaatggtgtgatctcggctcactccaacctctgcctctcagattcaagcggttctcctgcctcagcctctggagtagctggtattacaggtgcacaccaccacgcccagctaattttttgtatttttagtagagacaggtttcaccatggtagcatgagctaccatgcccggcccattattattttttggtaatacaagttttaaaaattatccatcccaatatttttgaaaaccatatcaagaaaactcctgtttgaactttccagtgttcctggtgaagtcaattgtgctagagtacataggaaaacctgctaacctggcccaggtcaggagtgtgctctcatctgaatgaaattcttgggactacttaacattgttattattgatgtctaaactttccagctcactgtgtcaagattttcttgatcctttcccatacatgacagcctcttcagtgagctccttggctttcctgaaaatgtaacctcttagcagggaatgatgcggccgtaggcaattagctcaatgactcctcactggctgccttattaatgatttgcacttagaccaagcactttgtactaggaattgccatttcccatctttttttttccccctaagcaagatcttgattcatctctaatctgtgttttttatacttatacctgcattactgccggggtactttcgggctcaccttgacatacagacgacatatcctttctctgaggccatctataatcatttgcaaactctggggaaaagaaaaaaatgtacatttgcacaccaactgggcataacctcttaccttggtaaatatacctttataatgactaggaagacctggtttgaatttagaattcttagactcttcagagttccatccaaatgcagccacatggggagagatgaccccagctccaggctaaggtccaagcccttctcttttctaccacattctgtacttacccatacagagccatgtgcatgcataggtagacagtcatcacctctgtgtgctgtccacaatccttgcaacactgccatttggccacttaaggccagaacaggctctggaaacaagcttcagaccatttcaacagaaattatacgactccagacacccagtgtatgatgtagaaggaggatataattatttgtgcccgatctctttttttcctctgctcagcatcaccagagatgtgtcaattttattagtcttttcaaagagtcaacttcactgatcatatctattcatgttttctatttcattgaattatgttattttcaatttactttttagaattatttttgctgatgcttttatcatctcattattttcttttttaaaatgtatttccctttttaaattttttagagacaaggtcttgctctgttgcccaggctggagtgcgttggcatgatcatggctcactgcagcctcagcctcgaacttctaggctcaagtgatcctcccatcttagcctccggagtagccaggactacaggtgtgtgccaccacacctgacttcttattaattttcagccttttttgctattatacagttttaccacttaaactatccttttaagcactccttcaattatctctctctaggtatgtagtattgattttctaatttgtatttgaatttttaatgactcatgaatattttagaaatgtgtttcttcatttatatatgaggatattttagtgaactttttgttgatttctagtttaactacattgttgtcagagaaaatgctttgcctttgaaatttgttgaacttgctttttatggaccagtatatggtccataaatatttacattttgtaaatatttcatttatacatgaagagaatatatattctgcagctgttaggcacagtgttcaatatacttccatttcatcaaattacttaatcatgttatccaaatattctattgccttaaagatttgtgtgtgttattctttcagttacaaagacagaaatctcccactgtgattttggctccgcctatttctccttatagttcagtccctttcactttatatcttttgaggttatgttattagatacatacaagtttaaattattatatcttcttggtgaatcaagacttttatcattatgaagtgaaatctctatctccaataatgctcttttgccttcgtatcactttgtctgacttcaatataactacaccaacattcatttggttcgtattagcatgttgtattttgtccatatttttatttttactcttcctgtttgcctgttttagatttgtctctggtaaaagaatgtatagttagatatttttatccaatctattactctttgcctcttaattgcaatgcttggtctgaatacatttaatataattatgaatacgttttggtttaaatccaacattttgtgttgggctttttatttatctgataggactaacattttgttttgcttactttctttttttagattaattacttttatctttttcctttctttttccatctactagatttgaagctatgtcctctgtttctattcttgtattgcttttcctagaaattccacatgcatatttcacatatcaaagtctaaagttaaccaacatcttcatcttcagaccagaacattagaatatcttacctccttttactcactttggatttatacattaccattgttttgcattttaattctttttaaaacatcatattatgattattaatattatttgggcaatgttcatttatttttacatacatatttatcaatttgtttgtcccttaatttttcaggttttccactgggaatcattttccttctgcctaaagaatccttttttttatataacttatttagagttttctagagttgacctcactctttttcatcagtaaatgcctatttcaccctcataccaggaaatacaattctaggtgggcaattactttcttccaaaacatgaaagatactccttcactgtcctttagtttccactgattttattaagaagccagttgtacatctaaccgctccttcttagaggtaatctctgtctgattttaaaatttggtctcgtctttagtattctgtagtttcatattatatatatatataagtgtagatttttcaaatttatcctacttaagattcactgggattcttgaacttttaaattgatatcttttatcagttctgaaaaatttcacatggtatcacctttttaaaattgtctatgcctcatgcccccttttttccttctcaatctaaaattccaattaatctcagactgctcactctaacttccatgtctcttaacttttcctttatatttttaatctcttcatctttttccttgctgcgtgctagacaaggtcttctgaatgattttccagttttctctcttccactgcacataatcggctgttaatttatgtgttacttattttaaaatcaatttcatggggtataatgtacacataaaaaaatgcactcacttcaagtacgtagtttatataagttttggcaaataaagatgcagaatattataatatatgtgagtacgtccattccagctttgttatgcttattctttgccttgtatatttttctcatctttttactctgaacatatttctctttctatatttaaagtgcatttatgggccaactgctgtgattcatgcctataatcccagcattttgggaagccaaggagagagtatagtttgaggccaggagtttgagactagcctgagcaacatagtgagacttgatctctacaaaaaaatcaaaaattagttggacatggtggtacatgcctgtagtctcagttactcgggaggctgaggtgggaggatagcttgagccctggagtttggaggctgcaatgtgctatattgtactactgcctccagctgggtgacagagtgagaccctatcttaaaataaaaataaaaaaaaaaataaaggtgcaggtgcatttcttaatttcttacattcatgtttcttacattacatatagtttagtcttgccttttaaaatccagcctgacattctctgtcttatgattatttagtctacttgtatttaatgtagttatctataagtttgaatgtatgattgtccttttactatttatgttcttattattctcattttgtagagacagggtctggattgtaagtgggagccactgcacctggcctattgtctcattatttgtcttgtctggtttttgttcattttttttcttcttttcctgcctccttttgtattaatgaagtaatttttagtgtgccagggtaatcctctaatggctttttagttatatttctttgtattattttttaatagttggtctagtgattataatatgcatttttagtttatctcaacctacttatagttaagattgaattacttcagataaaaaacagaaaatttgcaacaatatagtttcatttacctccatccactttctttgtgctattttgtcatatatctatatagatttaaattccaaaattacagagaaataatttttgtattgtttcacatcatctgtcttttaaatgcattaagaaaagtaagagaatttttttctaaaatgtgagaaattagcatctagtgggtagaagctagggatgaggctaaacatcctataatacacaagacattccccccagcaacaaagaattacgcaaccaaaatgtcaacagcaacaaggctaagaaaccctgcattaaactgctgcaatctgctggaaggctgaacgcttttttctgacaaacctgtcaatacatcatttagatgctccttttcatttttagtcagatataatcagattaggcaaaattgagttattacagcgcaagatcaaattgcaggtgcacaaccaaaagaaaatggacaggagaaatgagtttggccaagaaatacacatacacacacacacacacccctttcgcctgaagaggtgtctgtgtgttggcgggggtggggggcgttctcttttgtgtgatatacttgctgaatttgcaaaagcagcaccatattatgttattttattaacaaccccttaataaagtaactagaaacagcaaaataaaataaaatgtgagaaatcagaaaatggaaaagctctacctattaaaagttacatgatgttgtttgtattgagagaaaaataaaagtttctcatgatggaagcagaaactttaaaaaaaaagcatacagaatataatggaaacctattcaaggcttttaatatgttcattattatcttgtgtttggtggctcaggaaatcaaattataaaatccaagatcctgtactacttgtatattatttttacctacatagttaccatttctggtgttcttcgttccttccagtagatccaaattaccatctggtataattttcctttaggtaaaaaacttcctataccattttttatagtacctatctactggaaaataattaccttcagtttttgtttttttgtgtctttttttaaaatcttcattttaaaagaacagtttcactggtatcaaattccatcttgacaggtatttgtcattcagcattttgaaaatgtgaaaatgtcttccagtctccattgtttttttacaagaagtcagttgataatcacatttgttggtcccctggatgtaatgtgtcatttttctttttgttgcttctcagattttctgttcattcttggcttttagcagcttgacaatgatgtggctatgtatgttttggtgttttggtttttgtttatttagcatattcaccctgcttgagattcttagctccttggttgacttaatgtttttcatctaatttgagattatctctctgttttcacatatagactatttttcatcatccacaagctccttgatgtccctttgcagtcattatttttttggtagaagggtaccctattaaactcctcatttcatgtgatcctgagctttaaattttgccttttttatattcagaagctactaaaactaaagtttaagacattctgaaataacaagtatttggtggcaaaatcagctctagtgttctactatttgctctaatttcccattttcccttagattttagccttggaaccccttaatatctcattagctagttttaatcattttttttttaagatttcagagatcttttaagaaatgtattcaactttcttcaagaaattagttgttttcagcataaggatttgcccaaataaagtagtcctgcatatcgctaggaatagaagtctctaattttaaacagattcaaaatgtgtgtattaataagaatctatatttactaaagtactcattctaaacattctctctaaaatgaagataatctagagaattagaaaagccctccctcttaaaggcaatacaatgttgtttgaattagaatgaaaataaagatttctcccattgtggaagtagcaactaaagaaaacatacagaaaataccagaaaatgactcaagccctttaatatgttcatgtctattttatattatagttgatggttcaggaaatcaaatgataccattgaatttcctatagtcattgatctgagagatctttttcaaaataaaataatgaaaaattcattcattttggaaactcatttaagctcaaggtaaaacaaaaataagctgaaggaggggcagtatttgtactaggaaaagggcttaagaaagatattcattaatttgaactaagttctgggaaaaggaagatagcaaatatatcacgagaaaaactttccaaattgttatgccaacattccacttaaaaattatttgccagagccttttgatactggaaggataagtattatctatagggtcaagtttcaaagctttattatcttaagatatttaaaattatttttctttatcaaaccagataaatcaattgcaacattattttagcagacatgaattaagaaacctgactttcatttcttaataccagaaggcttttttccatggagtgatggatcttgattcagatgaattataatgtccacactagcaaaaaaaacaatgtatatgagctttcaattagtatttggccataccaggcagtgtaaggaaatgactgatctccttcttgtccctggtgcatgagccctgacttaaaatacctgttacagcctcctttgaatgacacagctccctttgtcattaagcaaatcaattctttcccagtgggtgggttaatataattgcaagcctctaaatacccagaacatagctctttcttcttatgtctattctaagaaaaatggctgttcatattttattgctatatttctaaaaatgttctcagtctctaagtggctccaagaaaggggaatactgcagtgtccaacctaagcagttcctctctcttctggctacctcctttttgcaccagcatttcagtcatttctctcagcccaacttcactgccccaggttgcagttagttaacatcttatttgtgctgttagtaaataccactggagcaaaaccatttgggagtcaaacaaaagggagccatttctggggcaaagatgaggaagactttatcaaagatattttaactaaatcttatatagtctgtaggagactgccatgtggagaagagacagaggaaacagcaggtacaaagacacaaaggcaaaaataccaaaaacaagcccaacctaatatgtttgggattattaagcgaaggctggagctgaaacataaggtgtggaggggatgctgaaacaggatgaaggctggattgtgaaaggcattatcagccctggtaaggaagttgagcctcctcatgtaggcaatgggggaggggggtaatattttaatctgatatgtatcttaggaagaatatttctaatgattctatgaggcattaattggcatggcaactaataaaactaaggagaacatttaaaaatagcagaagtcaacatatagaggaggaaatagatttgagagatttctgaggtctaattgacaggactcagtgagttatagaaagggggaggatgataacagctgaaggtaagcttgggaaattggatacattttgatgccgttaactaagacgaggacaatgagagtaaagttggagttcagaaggacttgcaagtatcattggagcgattctagctgctctatgagttacgtagtgtaagggggaggtgaagagctccatccatctctcaaaactccagcttctccccttaagattaggagatgctaatatgataatcagattcaggtcaccaaaggagacacatttacccctaggtaggggcagtgtcaattaaaatgccaagctcataagagatctccagtctctggtgagttctagcacactctcactcgctcactctccctctccctctcctcctacaagatacttttaaaaacatttaaaagctttattgagctataaatgacacacaataaactgcatatatttaaagcgtacaatttaagaagttttgacatgtatatatctatttattttctgcttcctatttcattagtttctgctcttttttttttattattcgctcttcttttctcatttcttaaggtggacgcttaagtcattgatttgagacctttcttcttttctagtagacatttggtgctataaatttccttctaagtactgctttagcagtatcccgcaatattttttaagagtggcacaatcatagtccactgcagacttgaactcctgggctcaggtgagccttctgtctcagcttctccagtagctagaactacaagcacctgccgccacacccagataattttttaaattatttttttagagatggcatcccactatgttgcccaggctactcttgagctcctggtctcaagcaatcctccctcctcagactcctaaatagctgagattataggcatgagccactgtacccagctactaattttgatatgttgtgtccttcttttcaatcaattcaaaacattttaaaatttcctctatggtttattttttgacatatggaccttaaagtagtctatatagtttagaaatatttaagagttttccaaatatattgtttataattgatttctattttaaatccattgtgataagagaacatactttgtatgatttgaattcttttaagtttattagcacctatttacggcccagaatacgtagtctatccaatacttcatgaatcttgaggttttccagtctggctggtgtgacaagcactatttctatcccagtattagcacctgctccctctaatcctttcagttggttctgttactggctttgggtagtttcctcacttgcatgcacccctcagtacttagctgaatgctcaaggtgaaccctctgcagatctcctaagttttctttctgtgaaattcctttctttacagtactcttccttcagaattctagctgccttagtcttcctggactccagtattttcccgtccatcctggaaaactgccaggctctgacttggtgtcccctttctgtgctatggcctggaaactctctcaaagcagtaagctggggccatcacagggctcacctcactttctttcctgcctctcagggatcactgctcttccttgcctgattttgcaaagcatcttttcatatattttatctgtttttggttgtttcaggcatgagagagaatttggtccctgttacttcttggtaagtaaggaagtaaagaagagaaagaaaatgcgaggtagggagagagtaagggagggagtgaagaagggaaaattccaaagggaaatgaatagtgctctcaaaaagaagcaaatagttcagtgtagctgaattgaagaacaaatttaaggacatggagagagataacctggaaatataagtgacagagaggtcctgaaaaaccttgaatatgatgctaaaaggtttgccctttatcttaaagaatatggagggcccttaacgcatttgaaggaggaaaataattggatcagaattactgtaactccacagtactgggcagataaagattggagaagaggaggccaatttggaagccaggtgcaatgacagtctcagggtggagaggaacaggaagaagtaagatagaccagacccactgagcaattggatatgaggagtgagggagatgaaaggttcagggatgtttctcagaggccagctgcagtcattggctgggtgactgtgccattcacagagagatggaatacagggactcctggtgtacagtggaggtggagagtgagacaagacatatgtaatagacttggcctctaatctttagtataaggaaagctaagataatgctccaaaatttgaagaagcacaattttagtcaatctcactgtgtttgtcaaccttttctaatagtaaaacacataatacctcagaggcaaagtctataccaattccaatatttatttcttagaagattaaagatgagataattacttaaaggcaagagttgtttttgttttgtttcattttccagcagggagatgttctgttttttgttttctttcctttttttttttttttttttaaaaccgctgaaggcaagtctcagcagtgatttattcttaacggaatcagtttgagaaaaatcccaagttgcagatactggcaaaccatagcactccttattaagacgtacaaaaaaaaagtatccaaatgatactttggcataataccaacagatatgccaagaaggaaataactggaacattccattagcatttacaaataatgtcaagaaactgagtgtgaagtttaagggcaaatttgaagggtggtgaaaataaaatttaagcttctagtcgatttcagagaaaaatagagaaagtctttgctgtttatgcaatccacaagtctcaatttacttattgatttagaattctgactatgtaatttctcagttttgttctactgccaaactagagggatattttgtcttttattgacgtggaaaccatctgaggtggaatccataagagtataagaattagaagaaggaacattctggtttgttcttctcccccactttagtcaccgaaaacatccttacaagccagagggcacgctcagaattagaggataggatggtaaaagagccatggaaacaggagaagctgcagcagcagccagaatgagaaaggatatattgactgtcttacaataataacacaattattatgattggctttacaaggtcagagtaggaggccagaagccacagaagacatccagctccaattacagcaacagaaggcagtgttgtctaagaatgagctgcccttggcagagataataaccttcctgaaaccccaagaatgcccagttgcttggggtgtttgtctaaaggttacaatagcaatagaggggacataggattggaagactccaagatttcttggtaattctaagagcccatattttcttaacttgattaaaacaggctttagggattcctaatttttggagtctgatgtgactttaaatgaattagttcatttaaatgaaagattttttcaaaaattactaatttatgtaaaatgatgagtacatatagacattaaatcagtccaatattttaaaaattaaaaaaacaaaatgtcatgtgtgtgtgtatgtgtgtgtatgagtgagtgtgacatatgacttggggctataaaccaaaaataaaattccaaggcccccctctaccatctgaatggacactcctctcagtcaagggcattccaaagttaacctgaaaaactagttcaggccatcatgggaagagggagccatacttgtctcattctactctctttccttttggaattactgatagaacacactctttaagtctgaaaggaaatatttacaatctattctctctgaagcctgctacctggagacttcatctgcatgacaaaaccttggtctccacaaccctcactcattgatatatcccttctctcttagtctccttttaaactagtgtgggttgttttttggtttgtttgttttctgatctttttctattcccgtcttgcaagtagctcattatttctgtaatgacttttatacaatgagttcaatttttaatttattgagttcttcttaaatgtaaggaactagggatacaaagataaacaaggcatgtcttcgctcttaagtagctcaaagagcaggcagaggacacagctgttgtggcagattgaataatggccccagagatgtctgctccccaatctctcctgtatatatgctaccttacatggcaaaagggactttgtagatgtaactaaactgaaggactttgaggtagcaagattattctggattattcaggtgagcccaatctaatcacatgagtccttaaaaggagaaaatcttttccagctctgctcagaaaaccagaaggatggcagaatgtgaaggacccaacatgctgttgctggctttaaaaatagaggaactatgcgccaaggaatgtgggtggcctttagatgttggaaaagacaaggaaatgaattatccctcagatcctccagaagaaacacagccctatggacactttgattttagcccagtgagaccttcatcagacttctgacctacaaaattataacataacacattgttgttgtttaagccaccaaatctgtagtaatttgttatagcagcaaaaggaaattaatgcagatgtgcctcaactaagagcaaagtagctcagcctgacgtcagtgtgcagaatggaggcataagccaagggctttgggtccttagtgttgggagtgagtggaccacgtaagggaaaggaaaaaaatctcgggacctccccaaattcttatgcaaaaggaaaggtgaagcctggggctgagtcactgtattactctcttccaaatgaatagctgttacattgtgcatcagccagatccccatggaaaagtaaaaggcattaggtacctggagagcactgcccccaacagatcattcataggtaaatcctttcctggcctcccacaaacaaggacatgccagttgtaactataggtctacaatccaagtctagttcctaaactgaagtctgttcaattccacactgataacattgattacaagtttatcttcccaggtgcagaacaaagacaagagatcaatctttcctccacctacccagagacatctacataattggctcttgcttcactctctttttctcttcagaccttcaacttgtcttgtgtaaaatgtagatctactgggcactaatgaaagacacacaggaatataactatttgcctttctgcctagctgcccctcttcctgcatgccttccccactttacagaaatgtataaatactaaaccttctgaaagcctcttcaaatgggtgttttccctggatttgccctaaagttggcttaataaacctcgatcattgagacctgtgcctcagccactcattttggttgccactcaattggtagagatgagagggtaccacaaagaaagaggccttcaggttgtccttgcagtattaagatgtggtcagtcagggaagaaggagaaggacactgcagacaaagggacaaacacccaagtcaacatttacaacatgcttccatatcagttttctatgtgggcaaaattgtgaaaagcttgaacaagaaatgtaagtactttttctcccgtcaaaatagcagcctagatactctaaagggtccttctactttccaacaacaatatagtgactgatacctatgttttaatgcactgtgggcatccaggaaatgagaaaatacccatagctctccatcctacaacaaaaaatatggtaaaggctatttctataactcatacccattttcatgcggaggacaactaaagaagataaaggagaaaaaaaaattttttttttttgagatggggtcttggtgtcactctgactgcaaccttgacctcttggactcaagtgatcctcccacctcaggctcccaagtagctgggactacaggcacccatcatgatgtatggctaattttttaaattttttgtagagatggagttttcccatgttgcccaggctggtctgaaacttctgggctcaagcgatctgcccaccttaacctcccaaagtgctgcgattacaggcatgagccaccgcacctggccaaaaaaaatttattttaagcacctagaaattaccaatgttactggaaaaggggtgtcaacccagaccacaggagcaggttcacagattgtgtgcagtaaagaattcagggcaagtatcaaagtatagtgaaattaagatagtttattagaggctactcttattacagagtagggtgtcctcaaaaagcaacaggaggaacgcccctacctaaaacttaatacttgcttatatagggtattagagctaaaaataatgtgctttattataaaggcttgtgatcagcttgtgacaggctattagtattgttattctcttctgcaactattgatttcagcaagaatctatgagtatattattatttctaatgtgaaactctaaaactaagaatgctttttgttcttaaaatattgggacacttccataacttctgagtcttacttaattaattagcaccattaacttgttcccttaaccataaatatcttgtgaccaagagtacctgacttcctgggaatgtaacccagcaggtttggctttatgcagccgttattcaaggtggagtcactctggtttggatgcctctgacaccaaagagctaataggctcctaagaagttacctggcacgaagatggttatctagtgaggtggagccagcactcagagtcacttttgtcctaaggacatttctcacccaagaaagatgactgagatgctgacaggctgagcggaataaagaaggaacaaaagtgccagccacaaaaggaaagatgggtaaattggactgcattaaaattgagtttgttaaaataagaaaaaagtaaaaagacaaactatgaagatattagcaacacaaataattagcaaagaattatatttcagatacataggaattccaagaactcaataaggaaaagacaaacaatccaataaagaaaatctttcctaattataaacaggtatttcacagaagcagcagcacagagggtaaataaacatggtaaggtgtcaccagagaaacgtaaataaaaataatatactggccagacacagtggctcacaccccaaacactttgggaggctgaggctcatggatcacttgaggccaggagttcaagaccagcccggacaacatggcaaaaccccactcctactaaaaatacaaaagttagcttggcatggtggcaggcggctgtagtcctagctactcaggaggctgaggtgagaggatcacttgagtccgggaggtggaggttgcagtgagctgagattgtaccactgcaacactctgggcaacagagcaacactccatctcaaaaacaaatataaaataaaataagataccattttatacctatactagcaaaataaagaaatctgataatactaaatgttgataagaatatcaagcaatgggaacttttatatgcaactggtgggaatttataataaattggctcagacacttcaggaaacaaatgggtatgatatactacttttgaatgtttacatactctgcaacccagaaatcctacttttggggaatataccccagaaaaacactgatgtgtgtgtaccaagagacatgaataagagcattcacagcaacagtggcagaatactgaggaaaatgaaataggagaacttaactgatcatagatgaggcatattgtggtatattcacacaaatatacaaccgtggaagtaaatgaacatgtatgaattataatgcaataatctagtgagttgtagagaattacaaattatgatggaagttttttaaagctcaaaaaagctaaataataaattatctagagtacatttatatatcataaaatatatggattagttataccattgaatgaaaatagttagttgcagaagactagcgtatgacaccattgacaccatttttgtaaaactgtaaaataagcaaggctaaatatttattgtttggcaacacatagagatatatagagttttacatgtaaaattacctataaatgtcaacagcacattgacatggtaaatacgaagttcaaaatgggatatccctggcatggaatagagagctgggatggcggagggccacacgggaagctgcaatagaatttttgatgtttgcttcattctctaggtgatgtgttcactggtgttcatcttatcatgtttttaaattgacaagcatgttacatatacaccacagaatactatgcagccataaaaaatgatgagttcatgtcctttgtagggacatggatgaagctggaaaccatcattctcagcaaactgtcacaaggacaaaaaaccaaacaccgcatgttctcactcataggtgggagttgaacaatgagaacacatggacacaggaaggggaacatcacacaccagggcctgttgtggggtggcgggggagtggggagggatagcattaggaaatatacctaatgttaaatgacgagttaatgggtgcagcacaccaacatggcacatgaatacatatgtaacaaacctgtactttgtgcacatgtaccctaaaacttaaagtataataaaaaaaattgacaaacatgttgcattatcttttgtagtatcaaatattacataatacaattttaattaaataaaaaaattatacatatcattatttctgccaagatggctattcttccatctccttcttccgtgagtgctcttttttgcactgttgaattgaatgagggtagacctgatagaaggagaaagtattttgttttttgtttttgtttttgttttgagacagagtcttgctgtgtcacccaggctggagtgcagtggggcaatcttggctctctgcaacctctgcttcccagggtcaagcgattctcctgcctcagccacctgggtaactgggattacaggtgcacaccaccaggcctggctaatttttgtattcttagtagagacggggttttaccatgttggccaggctgttctcaaactcctgacctcaggtgatccacccacctcggccttccaaagtgctgggattataggcgtgagccacggcgcccagctgagaaagtgttttgtaagataaaatatgtggccgggcggggtggctcaagcctgtaatctcagcactttgggaggccaaggcaggtggatcacgaggtcaagagttcgtgaccagcctgaccaacatggtgaaactttgtctctgctaagaatacaaaaattagctgggcatggtggcgcatgcttgtaatcccagctacgcaggaggttgaggcaggagaatcgcttgaacccaggagcgggaggttgcagtgagctgagattttcccactgcactccagcctggatgacagagcaagattctgtctgggggaaaaaaaaaaaaaagaaagaaatatgcaagtgctgtctgaactcagctcagaactaatgctcttcccagacaggatcttgcaaaagtattataaaatgacagagtcaattctccgttactctccattactcgcatttcaatttggtggctcacttttcagtgtgaatcctgtctttaatacacactgttcaagagtggatgccaacttcaagtggttcctggctgtcaagggccttcccattccactccataaaatggaagggcccactgacatattttaatggaagggtataaaaaccttctttgttttaacatacattaaacacttgttaccaaacatgttggaggaatacaaagtgacagtctgtgatacatttaagtaattgtaattcagattggtttctccctattaccactttcagggcaagtgaggcaaaaatctaactaccctcaccatcccgactcctatcccagcactcctgcgtaaacatttacatcatttctaattctcacaccgaagtccttcctatcacctacatcttgctactgcgagggacataaggaggttagggaggtgagtgggtggaggtatgggcagggacaggggtaggggtttgagctgacatagtacatacaacaggaattaaaggaatcagaatcacattgcaggttgtgaagtagatagagtctgtgtattgaagttacacagctctaagtctaaatcctcagctctgaaactttttagttgggtgacagttgacaagttactaaacttctcagagcctcagctttcttacctatataagtggttaataatatgtacatcctagggctgtagtgagaattcaattacatgtataagttgtaaatactcagtatacactcaaatatagtgctgtatttgtattgggtgaatatgtggaaattagggagttctatgcttttgatagagacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatctagagtgagaaaaggaaaatgtgtcacggatttttcttatactgaagacatgaaaaataaaaactgtataaagttatataaataaactttattcttcatgcacactaacaaaccaagaaaatatggttctaagtaagtgaaagaaggattccctaaaacccaaaatatttccctcaccacctgaaactctgctactagatattaattcttttgaaaacatgaaagtttttgatcctcatgaaaccacattaaaaatgtttatttccctgaaagcctaagtgagacttcattggctaatacttttgtggggattagaaagacaggacttctttcatttacactggatttgatttacaatcaaattaatatttggaataaaaaatatttccactttctgtacacatttcctcccattctgttcacagaaggcaccactatgatcacatgcaattgcccactatcaaaggaaaactctttaagttacaaaaaaaaaaaaagtaaaatgaaggactgtctttatattacaattatagttttaaaagagcagctcttgcaggacactaaaaacgtgatacaactttctaacgtcatattgtcttatcgtagaaatacacctactataagaaagcataggacagctgtaacaataaagccacattgtcctaataaggttcctttaattatggaactcctcatttgctaaatccctttttattgtttggtactctggagtgccttgattagtatttcctacttcaggaagtgatgccaaggtgggagaagccaaaaaacacacaaaaaatccccaaatagataattgctatctgggacttatatgtgataaactttattttgcaatagctaaaccagcactttctcttccttaaacattttcccagatttggggtatggctcggttcatttattttctcaaacttacctctaaatctacctctactatgaagactccctagaccaaatggaaatgagccatagatttctactacctctgcccttaaaaacaaaaccaaataatatatattgtgtaattcattttaaagataatctaaacttttgagcacaaaaattgtctctcatgttctgcagaaaatatgtacataataatacattttctatagatattaactccatagaaaatatgttaatgaatcagaatctagattttcgcttgtttctctttcctgtgcaataaaaggatcacaaattcaaatgcctacatgtgtgaagggcacatgtaagacaatagggagcagtacggactacggtaaacaggagaatgcaatcccctctaaaggcattcaaattaaaataataaataagaactttgaaattcttcatagaccaaatttactccacagttttcaaattctacatatagtccagtgaaaactatattttgtcctgcttgtttagaatcataacattttctctctgggtaaccctgtgccttcctcacattgtagatacagtagcagattggcagatctctctttcctttgtgcaccaaatctgtgcacaagactgtagaatcaaaatgggacttggagttctggtttacctaccctctgccccatccacaggggtgctgagcagtggcctgggggtggtggtggcctcagatgaggtagtggcaggcagatcatcagcccacgttggctctggagccttatcatcttcatcctggtctctggtgacactcaactacacaaaaatattcacattttgtgtttctgataatatcaagtaaaaaaaatactagtttgcttttgggaacatataaagactagttcagccatgctgtgtttccctagctctctgatactaactatttcaaataaaactcaggaaataatgcccctcctctgtgtcatgcatccctcaatacccaagttgtggattttcccaccacttggtgtgggtgtatttctgtgtacacacacatatacacacatacacacacacacgcagcccacctccaggcacagatttttgggtgctgggacatccaaagcagatgtgaaagatgcaaagttgagaggagtttattttcattcttagccactgctatgagaaaataaccactcatttctttaacatttttatggcctttctccatttcctaacactagacgtcttaacaatatattccaaaatatttaccatgaactcagtcaattttgagattgggaattagggtagcagaagacaataatacagctgaaataaaaacaatagtggccactttttgattgcttacccaaatctcagctgcagacacctttgcctgctctattatcagaccccagctaataccaaatgctgtaggatgcttaacatataagatgctctaagaaatgtttgatatctaaagaacaaaggatttttgtttcaaaagcaaattttctggactaaaatttccaagtttcatccaaatttatgatatataacgaaacaagaaaggcattttactttttttttaaaaatagtgcctttatagtagaatgatttataatccttgggtatagacccagtaatgggactgctgggtcaaatggtatttctggttctagatccttgaggaattgccacactgtcttccacaatggttgaactaatttacactcccaccaactgtttaaaagtgttcctatttctccacatcctctccagcatctattgtttcctgactttttaatgatcgccattctaactggcatgaaatggtatctcattgtggttttgatctacatttctctaatgaccagtgatgataagcgttttttcatgtttgttggctgcataaatgtcttcttttgagaagtatctgttcatatccttcgcccattttttgatagagttttttcttgtaaatttgtttaagttctagtataaagacacacgcacacatatgtttattgcagcactactcacaatagcaaagacttgaaccaacccaaatgctcatcaatgatagactggataaagaaaatgtggcacatatacaccatggaatactatgcagccataaaaacatgagttcatgtcctttgcagggacatgggtgaagctagaaaccatcattcttagcaaactaacacaggaacagaaaaccaaacaccacatgttctcattcgtaagtgggagttgaacaatgaaaacacatggacacagggaggggaacatcacacaatggggcctgtctgtgggtgggggcctagggcaaggaaagcattaggagaaatacctaaagtagattacaggttgatgggtgcagcaaaccaccatggcacgtgtatacctatgtaacaaacctgcacattctgcacatgtatcccagaacttaaagtataataataaaaaatcatgtcagtcattcttgacaattaccaggagctagacaaatcttttatgggaataattatattcttttgcaaatttttccttggattccagctgtatgcaattgaatcagtcattcacctgagtcctgacacttggttatttatccttgcaagagtttctcttatttgtttgtttgcatttttatttatttaaatagtcaaatctgtgactgagatagttttttatgcttttttacccagggatcctggtatgctgtcatcattaactgccgtctgccagctaagctgttctattgcttttgattttttttgtgtgtgcatgcatacatacacacacaagagggaaaaagtaattagtactattactcatgtatgcgtattttttacagtgattaaattactatcaggtgacttagagcaaagatttttccatttggattggtcattagccctatataaagggcacacaattcaaatacaataggaaattttcactgtcccctaaacacaacttttggtacaagtggagacaaaactgtggattacttgaggttcctctttctttcagaatgatcctgtatgcagatacagcaatttgaatgtgaacttttaaaaataatcattatactagagaatttaaagctagaggaaaactttcttggtcccttattttcttttttattttttatagagatagggtctcgctgtgttgcccaggctggtctcaaactcctggcttcaagtgatcctccacattggcctcctgagctcagcaccgagtcccttattttctactggggggaatacaaagctataaatgattaagaaactttccaaaagttattggtaagctagtgacaaaccttcaggaaaaaaagtactggttttttttgcctgcatgtatttggttttaagcaacaaataaaagtttgaggagtaagtttatcaaacataaaagccaactgacattagtctacacttcagatatacggtctagaaggtgagactgttccattgaagaggcgggctaagcagcacagttttcttcaaagaattaactcagcctttaaatctttaccttgttcaagtcctgagtcctcaaaagttatattttacctcttctaagcttaggaatgtgtgtttccattctcaatcacataatcatttggaaattttgatatctgttaacattactccacagattccaagacaagcaaaattaactttaataaatgaaaataatttcatcaattttctggctcagtgagatgtcagattatttcaacaaatgcataattattacggcttgctatttttataatttccttaccacaaaagcaagcatgttaactgaaaggaattttagaaaatgtggatatcaaaaaaaagaaaacagaaatcagaagtaattctacctcctaaagatagtcattgttggcattcaggtatatttttccctagtcttttttctaggtgcatatccatttttttgttgttgttgttgttacaaaaaaatactgtatgttcagttttctatgctctatgctattttaaaaaatatactatattatgatcattctatatatttcaccatgactctataacatttattattattattttgaagacagagtctcgctctgttgcccagcacgatctcggctcactgcaacctccacctcccagattcaagcagttctcatgcctcagcctcccaagtagctgatattacagaggtgagccaccacgcccagcctcctccacatttttataaccttgtcttccactactcccagaatatctggtcaggacctttcattccttcttcctctctattctgcctcaggctctcaatatcaacccttccaccacagcctaggaaaagttggtctccatccgcaaaaccttctccaataacccagtcagtactgattctccccttctagatgatgcacagtaccttctgactcttctatactcagtgctgattgtgtagaatttaacctttagtcctatcctattgaagagtaacagaatatgcctcccaaaatatgccactttggcacattgattattttgaactgaaggcaattgagaatcagatataagctcatttgtctaaatgcaggacatacattcgtaaaggaatccctcctcagaaaatcagggtaatgactcgagaggagtctagacccttacttagcccagagatacaccagaggactctacataaaaaactattcactaatccttatcttccattaattcacccatatgtttaccttcccaccatctgctgctgtagaaagtcctttcccattgtcgtcactcctctaagctctattgttctttcgttaagatgctatataagaccaagttctaaccacccctttgagctactcatctccatgctcctatgtgtatatgctacatgttaataacttctgtgtgcttttctattgttaatctgtcttttgtcagtctaatttacaaggccttacctagctaataaccctaagatgggtagaggaaaaaaaaatttcctcccctccactatcttgtataatttcttgtttcctatatataaataccacttccctgataaaagaaattatcttttttctttcttttcttctttctctacctctttttttccatagcatagaataggcaaaaagtatccattaaataaattcacaatgggttaatctttctgttacactcgtcttcaggttgaacttaataaggatatgcaaagagcgaaagagaaagagataaatttgcattatttaattcctctagactttaacgtcatcatttttcaaataaaaaaaattaggccctaacatgacttccaactctaaaagttggatttaaccaacacaaacgactggcagaatacacacccaattcacgatagtgattgcctctggagagaggaggaaaaagagctctggagggaaaaagctaggactttatctgaagcaagagtgaatgaacaaatggaaacattggttacttctgggtggtgagtacgcagtcaaatgtttgtttctattcttgttaataaatcttaaatctgaaaacacaagcttgcctgtcaactctgcacatttctactccagccacactggcctgccttggaaaagaaggctagctccagctctaagcagggacaccatagtaaaaggcacaaatgagttgtctagggacacctgagagccgacacctggagtccagggctgctccgtgtagctggacaagcagacgtgttatcaccattctctttcagcctttgagctgatctttaaggggaggaaaacagactcagtgcagtatcccaagaacatgtatgcatgagctaagaaggattgctgaccaggtgccacatccaaaaggtcttttgctttctgatttccaaacattttccttgaatttattacccagaattttgcatatattacaaagtcttcaaatctgaacacatgtctgctctggatgaatgctaatgatcatctgcattagtgtttgtgttaagacttagcatattcccaggagtgtgggtcaaaatttctccaatttggctctggggattctactgccactgggctccacagccagcatcttcaaattgtctggcttctcaggagtccttcttgattgattctccccaagaatcaaacacacttctttgtcaggtctctctgcactcaaatacttaaactgaaggttacttatttgcattttaaagttactggggcctttaggaacaccttgagtttgggctgcacctctctggattcactgtggctttcaaaaagggtgtaatgcaggattttgttctgtttaaacctctcatacattagtgcagtaaaatagcctgcattctggctttacccagtaaacatttttgacagctgtaatcatatacttttagaacaggaagaacattctagtaacattctttaattttacagatgagaaaactgagacctcaggaaaataggtgattcccctaacatcaggcagctatgagatttcatttctaagatgtcattcatcatgagatataccataaattttaaaatagttttgaaaaaagaccacacacattaaatagatgcatcccaatttcagaaataataaaatcgaaaaactacagactttggagtcaagagaatagtccttagcttcagcaatgagaccacaagccaggtttcctgacttccaggtctagaatatttcttctagatcagttaggaatatgtttattatttttgtttttttcctcttccataacacaggtgcatgttatattctgagggtaacaagtctattagaagcaataaataatacttgtacagcaaccttttgtagtgatactaataattagttgttacgcagggttttatgaagaatttgaatgtttttcacgatcacggtgagagaatgctaattttatttttcgctaagaacatattttggtagaaagaagaagaggaaggaaggacagagttaggtgtcttaagggagtgacagaagggacaacagtgaaaaggaagagacaacaaaagggaaatggtacttctgagatcattgtttactagctttgcagtattgcctagggtaggctcaggaaggatctgagaataggaaggttgtaacagattcattttattttaaatgtttggatactgtaattatacttattaaaggtgggtgtgcatgcacagaggcataaatatgttcttgtatgtgtgtatgtatatactatgtgtgtgtgtgtgcgcgcgtgcatgtctgtgcagtcaagtgctgcataatgacattttggtcaaccacacacatacatgacagtggtcccatccgattataatactgtatttttacccttttctatggttagatatgcttatatatatagatacttaccactgtgttacagttccctacagtagtacagtgatatgctgtgcaggtttgtagcctagaagcaataggctaaactatctagcccaggtgtgtagtaggctatactatctagatttgtgtgagtacactctatgatgttcacacaaaaacaaaattggctagcgaaacatttctcagaaagtgtccctgtcattaaacgatgcatgactgcatgtcaaagatttaaatgtgaatagaaatgcacgtttgttcaaactaaatatcaataaggaaataattgtttaaaaattcagttttgcattggtgcttctttaaaaagagccagaatgagaaagcctagagacaagaggcactatccgagaaggtcaagttcattgcaaggtcccactatctgggtcaaagttcccctagagagacctagctgatgttcagtttcccttcatgtggctcttggtgttataaatccagagtattttggttgtatttttcttacgtcctcccctccccagctactagaaagcttcatatgtcctagtctgttaatgtcatttgtctctcaaggccatcaggcttcctgggatgtgatacagagggatctgttcttacttttcctcattacgtgtcataactgccttggatgtccctcaggcacctccactttacatggtgcaaactaaactcactattttcctttaaaaaaaaaaaaaaccaccctgccttttatattctccatctcagtatatagtgtttcaatccatctcatctccatgctagaaacctgacagtcctacccaaacccctccctctccctcacctccaatcctttcaatcactatatcctgttaattctaccctagaaatggcttttcaatctgtgcctcctttttattcccagtgcccctgccttctttcagggcctcattatcattttcctggactatcacgcctcatatctcagcctccagtctcctcacctcctcctcctaggtatgtttcacacagcaatcagggttattctttctgtgaaccaaatatgactatatgattcttgcttttaaaactcctctgctgtctctgcctgcctggcctatagatgaagttcaagctccttgccttaatacattaagacatttataattagtccttaaattacctgtccagctttagctctcatcactctgccacccacaccctaggctacaattagactgaatttgttcaactttcttgaaatgccatggcactttaaagactccctttgcctactgttttttttgttttttgctaggaatacccttccccctgctcttctcttgaaaaactcctagttattcttaaaacttgactcaatgtcacctcctctgtgatgccttatgtaatgaactaaatgtttatgtccctccaaaaatcatacattgaaacctgaatccccagtgtgatggtatttgaaggtggggactttgggaggtgattaggtcatgagggtggagcctttatgaatgggatcaatacccttataagaagtgatgtgagagatgagctgtctctcagccatgtgaagacataacgagaaggtggctgttcacaagccagaaagcaagccctcaccaaacaccagattttagacttcccaacctccagaactgtgaaaaataaatatttgttgtttaagccactcagtctatggtatttttgttatggcagccccaacagactaagacactttcccattactcttccctgaaattaattgcatcatctctgtgcttccttcatagctctggctaaaattcataatgcatcttgtacttacctatctccctgaaaaaatgtgagcttctctcaggcaggagccatgtcttaagagccacaccatctatcacagcagttaataatcaatacatgctattggaattcattggtattaatatagcaaaaaatgtgattcagtgattataaggagggctcagtttaagcatcaattcctggatgaaacctgagcttgctcttgtttaggaaggctttagaaagggatgttgattgactaggagagggacaaagtggtaagtcacacaaacaggagaggccccagtagcggtccatgctcaggaggagatagactgtgtccattattgtctggaatttactttaaaatgcacaatatagatcagggttggcaaaccactgtgggccaaatctgagtcactatctgttcttgtgagtaagtttcatcagaacttattcatactcattcatttaagtattatctatggctatgtttctacttcaaacgcagagctgagtaattggaacagaaatcaaattacctgaaaatccaaaactattcagtatatggccctttacagggtttgctgacacctggtatagaccatggagtataaatgtttgtgttaatttcaatctgcaatttagtagaatctattgccctgactggaattacccattttgcagttggttactatttaatcaaatagaaatatgttagaggcctttctgcacttttgtgaacaggatacgagaatctagtgagttctatagcctgtgcccttaggaatggtatcctaggcctgattcctgaatggccctgagtccaactactgatccgaatgttccttagggccttagtctaagtagactgttagctgaatcctgatgttagaacactgttgcacatgctcatgatcactctttcatgtacatgaaggcttcagaaaagggcaatgcaaggactttactgagcttacagaacaggggcatgactgttatgtgcctgcttgccagaggatgtccatggggttaatagaaatgggtctagacttgcccaagttgcaacttggtggagaagagactatagcactcatcggtaactaaaaaaggctcccccattttctccttaaaaaaactaatatttgcccataatctgattggctgaagtcagttcccagaagcttgctatgaggacagtcacatttgtttcaattgattcaggaggtggttcttcacatactatgtgattgaggagctctgaaacagagcatctactttgcaccatatgcatatatagcctccctcacagtcctcactcagagcacaggaggtggaagccaaatgagcaaacacatggcttggagtgtgggagagtggccagttgggcatatgcgtatttagaaaagacatgagagggtacaaagtgggaagcagatgcacagacgaagagggagagttgtggcctggtatgaaaggcactgcacagcatggcaactaggtgaattcagagtgttgtgttaatctgtttcagcatacatggttactttgatggtaataggagtataatataaaaatattatcagcaacatttaataaatacttataaaatatgcaagtttttaaaaatatcctacaaaacctaatgctatttcagaactggaaatctagagtcaagatactaacatttagagccaaggacctaaaaatacacgtgcctcagctgattcttgacaatgcagggcagaatgatctttgatatgaaacagagagaatacaccattttaagctcacaaagtaagtgagacagttacttactgactcagaaatttctttttgaggctctggagtagattcactgagttcttcccctgacatcccaaatccaggttgaggtgacgatgaaccaaaaatttgaacgagataggaatcaaaatcctcacaaattttttgaaacaatttttgcttcagggtgtcttttaaaaaagaagtagaaaagagagatagtagaagcaatgaaacaatacttaaaactcatttaaaaagatctgcactctccttaaaatatgtaatttcccattacttgaaatcaactgctaagttaacgaacttataaaagcatttttacatcctgtgtaagaggtcatctaaaataatatatatgacacaaagaggcaaaagaatgacttgaatgtatgttcatccaaagtgtctctgttcaacgtgaatcactccttgtcaagagctagcctcacccataataagttgaattggcagctacctctggttttaaggagagcaaatggccagccagttgcaaatattctttacaggctgtaacaaattactaactccagatataatgataaagctcttcaaggattaaaatataagttggctctgaaatgtctttggctattctgacacattcacagctgggtgagattgaatatatcagataaacaaacccaccagtcagccagcagggtactgatgaagtagaaccctaggttagaaagctctggagaaggtgagaaatagcaaaaaagtttctgagaatggtatgctttccttagggccagtgtgctggtacacggcataggcagggcatgaggcactgatgggctgtgcccagccacatcagactccactcccaggtgggtgaaggaggaaggatgaagccaaactgaagcctttcacttacttcacaaacttgccaggtacaggcctgccagaatgaataatcggtttccaaagaattgggataaattttattataaagtcatactgaccataatttaatcatagcttaaattagatcaatgtcctaggatggctcattagtaaatatcagttaatgtgaaaggataaacttagcatagagaagcccatcagattagcactggctgtacaataaattctatttattttttatttattttttgagacagagtctcgctctgtcgcccaggctggagtgcagtggtacaatctcggctcactgtaacctccgcctcccaggttccagcaattcttccgcctcagcttcccgggtagctgggactacaggcacacgccaccatgcccagctaatttttgtatttttagtagagacgaggtttcaccatgctggccaggctggtctctaactcctgacctcgtgatccactgtgcctggcattgtacaatgaattttaaaaggttgttctttggctgggcacggtggctcatgcctgtaatcccagcactttgggaggccgaggcgggtggatcatgaggtcaggagatcgaaaccatcctggctaacacagtgaaaccctatctatactaaaaatacaaaaaattagccgggcatggtggcgcgtgcctgtagtcccagctacttgggaggctgaggcaggagaatcacttgaacccgggaagcagaggttgcagtgagctgagatcacaccacagcactccagcatggtgacagagtgagactccgtctcaaaataaataaataaataaataaataaataaataaataaataaatggttgttcttttgagataaattcccgatatcaacctgtttattcatcattatctgctttcataaaaacagagaatagaacatcccctctaattaatcccagttacttgcatttctcatctctttagatgaccataacttttttttcattcagcaggtacttcttaattcattttgatttcctgactgttttctgccttgctgttggcttgctcgatcccttattttagttaggtaactttctgaacattaaccaatgttagcaatactcccaagtcctattctttctctccattcctgtctgttgaccatggactctagttaactccaaggccaactcagcatttattaacccttaataaagacaagggattgtaccctccaaactgaatgatattaaacatttttaatcttctggagtttacgtgttaccatttaatgttggcataagccttattagcctccagatttttctatttggtcaggacaaaccagtgatatggtacttagaggaacaacataaatgcctttcccctgggccagatagccttccttaccttgcagggtaaagaaatcatcaaactggtaaacatgctctgggtcagtagcaattagattcatttctttgtggaatatttcaaagttgggatcatttttcttcaccacccctatcacaaatatctccacattggtgtcactggcattcttcaccacctctgtcagtttctctttatcacgagaatctgtctgtccatcagtgatgaccaaggccactttttttacacctggccttgcatcttcaaacatgtcgttggctgcttgcagagcagtggctgtgtatgtgccttcccccagatactgcatgttgtccacagccaacttgaagtcatccttgctggagaactgcttcaaattagccaccttctccaccttatggctatagttgattatgcctatgcgggccgtggcaaggtccagagcaacccggtcagccatagtcttcacaaaatttttaatgatctgaaagttctctggccccacgctttctgagctgtcgatcacaaacaccagctctagtggagtctctttgcatttgggcccacaacctaaaagatgaatgttgagagagaaaaattgtgggaatgattgacatcagattgttgaggggaggggagaaaaagtcaatgatgaacctgagacctaaactattctcttccttttctgtgattgtgaaaatacctgacagctgtctccattctggtttctttttttttttgtgagacagagtctcgctgtcgcccaggttggagtgcagtggcgcgatctcggctcactgcaggctccgtcccctgggattcacgccattctccagcctcagcctcccgagtagctgggactacaggcgcccgccacctcgcctggctaattttttgtatttttagtagagacagggtttcaccgtgttagccaagatggtctcgatctcctgacctcgtgatatgcccgcctcggcctcccaaagtgctgggattacaggcgtgagccaccgcgcccggccccttctggtttctatacttgactcttaaaaaaaaaaaaaaatatatatatatatatatatatacttggaaaaacaccgtagttgataaaataataaatacttatgtgctcgtttcttggattataaaataaaatatttttaaaagagttaggatgccctgtggatgccgtcccaataacattcctcttcctctcccagagaggtaaccaccatctgacatttgctctttatcatcccaccattgtatttaatctgaatctgaaagctgatatttcagtcttcaaccatagccttatgtgaaaattgaaatttgctcaccaggctggccaatggatgaagtaatgggatgaaaaattgtcattgtggtagaaggattgggaccttaaatgtacacaggaacagctatccctaactactctagttgatgtctccagtcacccacaatgacaactatggcagctttcacgttatcaaggaggccagcagtacatccatgctatgaaagcttttgaggggagtaatccccgagaacactagtcaatttaaaaaaaccttccatttaggttgataaacaaccacttaaagcagttgccagagtcatcaggaaatataaattatcaggattctgtttctttattcatatcttcctgttgttcaacaagcctgccacagaaaaccatcaggaaatcatgtgctatttttatagggcttctagaacccagaagccatgtctagattggtctctcactagagagactcccaggctgcttcttaggcccagcagtcttttagggaataagctggttctgggattctctgtatagaaggacaatatgcctgcctctgaccactttaaacccagaagattctcccatcattattccattagtctcttgtcttttggctaatttctttacttcctctttctggtaattctaagtctaccattcagtcatggaagcatttagtagttgtgaagcaaggtgaatacctgactctgtcctcccacctttgggactgagtacaactcaaaactctactcagaaagaattcatggcttcgggaaaaacacagacattctaatcaccagctaggctggactcaaataccagtttggctcttgtagtcatatttcctttgttgagtttttcgtctcagctcaggtaaatgtcactgaatacaaacgagcactgtgctaacaaaaggcccggctgcctacataccctaggctggcaccttcacatgccttaaccagcctgggaagatgattttatttccttacatcaggattcccacagtctctcttactgcttcctttcagtttccatcgacttttcaaatgagcttcacattttcccgctagctatataatatacatctggacgaacacattctgtcaccagcacagtacatagtggggctgatgctttaaagtgatgttttttccttgatcaaatcttaccacatatttctgtaataagtttgataatttcttctttctaggggataaaaagaaaaatgtattactatatgtatgactataatatttttcctagagccataaaagatatctcattacaatcagcactggaccatttgatttaatccttccactgcagaaaataaaataaacaacacagaagtcaaaagctgactataatagaccataactaaaatgcgtttgagctgtgaaacttaacagctgagacttttggaattcaaattgcaactgcagcatttatcagctgtgtgacctcgggcatttggtgccctaacagtatctgtgtctcagggctatggtatggattaatcaatgttatgcacacattagcacagggtctggcaactttaacatacctacggtgctgtggtgctatatatacattcagttatacaatttaaaccacatgtgctgagcaaccaagacaagccgcaatgcctacagagaattcattctatgctgtattttctcttctttttctgtactagttcctgatttttcaagtcctctcttcagcttcttaacaccctcactttggctcttctgtgacatttccccatgttcctgaacgcccttttcttgtcctgctgcccacaagctccatcagaagggcctgaaatgagctgggtactagaaataaagctgccaatgcccttccctgtgcagtgtgtttataagtaactacaatgagactagagaaggcaggattccacatttgccaaacacttaaagctaaaagagatgattaacagaagcctagatctcaacaggaaggaccagtggacccaatctaagaaaataaagtttaacaggtgcaaaagtaaaatttttaagaacaaatctataatgtcaaatcgaggtggaggtgatgtagcctgtaacatggcttaaaagtagaatatgtggggaatattcatagtattttaatttaactttttaaactgtaaactaagtaaaagctaacgattccaagtggctatttaaaaagaacatctactgcagtgctgagttatataatacaattctacaaaatgagagtcaacagtcttctttttttctaggccttgtcatgcttttccgcatttaaaaaggcatttaaaaaaatccgaaacaagaacatgtacagaaaggtaaaatgtatgtatttatatatttatattaagtatatctagaaaggggaaatatatgtatttatatatttatgtttaattttttataaacggagaaaatacaccaagttttatggttataatttgtcacctaatactatattataattcattttccacattattaaggattctgaaaaacttgattactgaaattgaatgtgcggccatttaaaggctctgcgatacacactctcacactgtactttagaaaagttgtgctaactgacacctccaacagcagtatataagaaaatctgttttattttagccacacaatactggctattattattatatcatcactgtcaattggtagagcaaaatctctcattgttttaaattacacgaattaaattattcatgaggctacatttcatttcatatgcatgtttccaggttgtattctcttgtgcaatctgtgtatgttctttgtcttatctttttctatgggaatatttgctttttattcacttataagagcaatgcatgtatcaaggttagattttaattttgcaacatattttgtggcataatcaggtttaaaatgcttgaagttaccatatatgtaaattttttcttcatgttctttgcatttaagtgactggaagagttcattccttccactgaaatcactgaataactaccttggctacttggtgccaatgatgaaggcatcatatttatacccctcaaaggattcacagtccaggaagaagcagacaaacgaagactttcataagtgctatggagagccaaggaaccatctcgatctgctgggaattcctggggcaggaaactgaggatgggactgtggtccaaggaggcagactctgaccaggctgggacagggaaggggagcgttcaggcaaggtggtcggccttctgtcagagcatactgcattacagtactcgagtaaacttatgaattagggcacatagcagaaacaatgacaagaaatgttggagacagatggactcttgaagacctttgtgtcatgttgaagagtgtgaactttctcctgggcagtgggactcacatgatccctaggcagagaagagctctggtggaacttttatttaagagagatgatcatagcagccagtggaggggtttgaggttcctcaataattcacgcaaaaaaaaaaaaaaaaccagacatcagaaggctgtggtagtagtaatggatgaggaggacaggcctggagggacattccagaagaagaatgaggggcttggtgaataactggaagaaacgatgagggaaagaaggagtctaagaggaggcaaatgacagtggggccatactctgagagaggcaggagtgggataggggcaggttgggagctcatgaagatgactgagcccagcttgagtctggctgagtctcatacgtctataagacatccacctagagatgtccacgggcagccaaggatgtaagatctggcgcttgggagaattgtccgggcaggaggcagatttaagaaatgccaatgtacagttggctgttaaaacagggactaaaagtaagattgcctagaacagggctgctcagcctttttgaaaccggtgtgtttctccttccccacatttgataaacacattctttctgcttaaaataaaaacactattttttcattcactatatgctttcactgtactatagaattagccttttcaaactatatgtccccctgcctttagtggctacattccctgagagtttgaagacagggaagactggggccagacaccgggaaatgctaacaccgaagtgacatgtggagaaacagagtcttttcaaataattttatgagatgtattaaaacatttagtgccatcaatggcatttgcctcttaaaagaggagtttgttagtctgaaatgaatctgcacaattgatagctattgggggatacattcgatcacagaaaggataagagggggagaggaaagaggccttctgagaacagctttcatgggggagcagcctgaacttggtatcagacaggccacctctagctataagggctctgctacgtgccagctagatgactttgggcgtaatgtccaacctgacttgtgtgtctccatttgatgtggagatactgtctacctcatggagctgtcatgcagattaaaggtgggatcttaggtaagagaaggttatggccatcagcctgtcaccgtcttcttgtaccacaacccactagtcctacactgcatgggggtttggccagcattcatgctgtgaaccagtcctcatttccaagctctgtccaaatcccctgaaaccacctgctgtttggccacttcttggctgggcccatgcatccaggccagtgcttcagctctccaaacctgtggccatttcaactgagaattctggaattgcatgcatccagagtgtggcatagaggaacatatgtgcatgccctttggccccaaggacttctaacctggaggaaggagcgcagctggagaaggacgagggttccagagcgggggcctctaaaacaccctgcagtactaggtaaggagcctaacatgtactgatgtacaggagcctaacacagagcctgtcacacactaaattctcacttaatgcaaattctcttttccttcactcttctcgtcttgctagtctcttcttccagaatctagaaaaccaaagtcagcagaatgatgtccctacttctaaggtctctgcctcttggttgaaaagcttccactcaagagataaagcctatcctgccctcaaacaccatcatacaccattttgtctgctctggaccccgagaccacatcttctatcatagcatttatcactccgtaggtgaacatctttgttgtctttctctccaccaggctgtgagctctctcagttccaagaagtagcctcactctccactatttccccagtgcctattttggagcctgatccagagtaaggtttactggatacatccaataaaggttggtgaaatgaatgaatgaataaatgaatggagaaaggaaaccagtccctctccccacgttgggacagtagggcaggtataaacctacagggaacgttcctctgctcatttacatacactctcccctgctacttttggggagaaattgtgcatatgtagctacttcatctactatgggcatctttcggggtctgacttgtggtggggaacaacaaagagaaaaaggcagacagcccgcagaacacatgtgcagttctgttggtcacatgcccagctctcagctcttgccttcaccacctgaactgccactccctcacacttggatgttcctagtacatcgaatcagccccgctagaccacaaccctggaaaagtctaacaggaaaaaaggaaaaggtctgtgattttcctcaaccccagaagacagattgccttcaaagcagaaaggaagaatgagactttgccttccactcatgagactttaaagagtcagttttctgttcttaatggtgtggggagaagaacagggaaacgtttatagatgctcagaaaatacttattgaataattgaatcaatatataactataatctcaattttgtgattgctgctcttctcagagcacttctaaaggaactagttcaggaaaaaagagtcctcattctaaaatgagacgaaccacataaattaaagtcatttggtaatctggcttttttgaaacagctcacctccttgttggccagtaacagcagtgtgatcatttctaccaagcatccgagtggagtagtcacacacacccaccacaaggcaggacaaggttttatctctcccctcatagtcagattcaattacctcatgcatctaagccaacactgggctggtagtagttgatctcatttaaatagaaactgggattctgcatccaaaaaattcataattctaaagctaaagcatgaatgcaacaattttgcaagcacaaaaccctcaattaccctctagaatggatactcactgtaagtcctaggtctcctttgggtccttgtaaaccctacttagtggaagaagagtaaaagtcaatataggttggaaccagttagagtataaaatcacagtgagacattaaaaactacttgcctgttttcctggagatccaggctctccaatttctcctttatcacctttctttcccacatcgccccgttctccgtgctctccctttacacaatagggtaaaatgataggttcagaatgtgaatctaaaagccagataagaaaagctctataatttggttatctgcaactggcatctcttgaagaccttcagttcttgtttatacaaatgcagtatttgaaaaaaaattgggggtaacttatttacatcccatcagataccataatctaattcatgatgaaccagaggtctcagagtgaagagaccttgagatataataccatctaatcggctcacctttcaggacatacaattattacacaatttaccgggtacctgagttatctggtatctcctacatggtatgttgtaagtatgttgtaagataactaataaatcctttattagttatcttctgagaataaagaaaatgagatttttttaaacatagagatgggatctcactatattgctcaagctggtcttgaactcctggcctcaagcaatccccctacctgaagctctcaaagaaaaggacattttataaagtgaacctatttataggtagacaaagcaatgcacgaggattttattttgagtggattgtttttcttctgagagttgtaaggggaagagtgacacatatatgagagttcttccaaagttaaagttaagctattgcgatcctaagcctaagcatttctctaagatcctgagacacttaccttctggcctgggaggccatggcccattgtgccctttgggcctgggaagccttgtggtccttgttccccctacataggatatgagaaagagatgttctattaatttcccaggatagcttggctattctttgggtcagaaacacacttacggtttaaaactgcattatagtattatctaaatattaggggaaatatatatatatatgtatataaatacatatgtgtatgtgtgtatgtgtatggctcaatggtttgctagtaagtgtttaacaactaagactaggataggagtgagggctctgatttatgccatttgcctatttctgtggtgtaaatactttcactgtggctaattcaagctatgaacacatcaaccagttcacacataacagatagctgctatttcagctatggtagtaaaggtgggttccatcttctttacatttttccatgttttctggtatgttaaaaaacacatgttattggctgggcacggtggctcatgcctgtaatcccagcactttgggaggctgaggcaggtggatcacctgaggtcatgagtttgagaccagcctggccaacatggcgaaatcctgtctctactgaaaacacaaaaattagctgggcatggtggtgcgcacctgtagtcccagctatgcaggcgggtgaggcagaagaattgcttgaacccaggaggcagaggttgcaataagctgagattgcaccactgcactccagcctgggcaacaagaatgaaactctatctcaaaaaaaaaaacagaaaaaaaatgtcattttagtaacggggaaaagagtatataacagcatccatccacaattaatgccaagttattgtttatgtaattccctttatactgttagttccatctctcataatttgtagcaacattcaggacttgtttccagatttctccatcacattttaacattatttcttgccccacccaaaccacacagtttccaaggggtttcatggtgttgagcatgaaacagaaacaatcactagcaagtatacaaagtcatagttctaatgctccttggatcttatactcaatccttatttgactctggataattattagtaatgagtctctggcaaaggcttgaaggaccacgggctcctcgggattgatctgtggttttcaaaactatcctgatcatccccaccaagatcattggcatgcttgataaaaattgcatctcccaggcccaacctcaaaccaactaaatgagaatcacaggtgaaggtaaaggcaaaatatgcattttgccataagtctgctaaagcttgagagccactactccaggaggcatgatgggatttacgaggcactcctggaaggggccacagaggtttgcttggagaccattacaactttgggcacctcaacatccctaagcctcctttaccttgttcattggctgtcaagctgtttcaaatcaaaagggcctattctcttttaaattgttataatgaaatatttcaaaacaaaaatcatatagaataaagtaaacacctatctaccacgttaaaaaataaaacagatacaattcaaacctcttaggtactcatccccaatcctatttctctgagagaaaaaatctctatctgaaattcatatttatcattcatatccatgtttttatgctttaactacatttcaaaataatacatcttttttttgttgtgtgtgtgtgtgtgtgtgtgtgtgtgtgtgtgtgtgttttttttgagacagagtctcactctgtcaaccaggttggagtgcagtggtgtgatctcagttcactgcagtccccacctctcaagttcaagcgattctcctgcctcagcctcctgagtagctgggattacaggtgtgtgccactatgcctggctaatttttgtatttttagtagagacagggtttcaccatgttggccagtctggtctcaaactcctgaccttaggtgattcacctgcctcggcctcctaaagtgctgggattacaggcatgagccaccacacctggctgatatttttaatattttaaatttccaataaatgatatatttatgcatccaattttttaaaaaaacctcaatattatctatttgaaatttgtgtgtgtgtgtgtgtatatatatatatatatatatgtatatgagattctaatttgttgatcgtctctctgctataaagtatttcattaaataactgaatacaacttatccattagccttctgatgcacatttaggttatttccaatatttctgtattaaaaataatattttaagaatatccttttatatgcctttgcacacttgtatacattcctaggaggaaactcttacatcgaaacaaatattatataaaatggtacaaaataaaatgaacacagcacagattctctgaagctgaactaaagggctccatttttcacacacccatccctaacctctcacggcacattggcttgactgaactctaaggttctttttattctcttacatgtgtttctaaactgtttgtaggtatggtgttatggtattgcctccccagttcaacaccagaggacttaaaataagttctttacaggggtgagattacagagaacttaattcactgaatgtcttttcactttggtatctcttgagccaaacccagtgcagtaacatactgggcccactggaaatgggtatgcagtgttgcactacaatgtcttgggcccacctaaggaggctcacccagaagaggagtgcttcctctgttagttgcttagagggaacaagtagggatgattggtcttctttattcagtttaaagtcagaatagaatacagtagtccccctttatctgtactttcatttcccatggttacacttacccacagtcaactgtggttggaaaataagtgagtatagtacagtaagatattttgagagagaccacattcacataactttgatgacagtatattgcttatagttgttctattttattatgtgtttgttaatctcctactgtgcctaattttaaattaggccttattataggtatgtgtatatagaaaaaacatagcatatttagggtttggtagtatccaaggtttcaagcatccactgggaatatcggaacatatctcctgcagataaggagggactactgtaatcttttcccaccaggaaacttgatatcattgggagccccagaaccctggataggaatttgtaccagttaaataaaccctaaacattaaactgacactggcattccaagatgaaaattcaatcaaaaaaaaggagaggagaaaaatttgtcctgtttccaaagatggcactcccaacataggtgtcatgaagatgaataggtgggaaagtgtagataacacagaacagcctcatgaggctccctgcaaaacatgctctaataggagtggatctgcagcctgcttctgaacatgaaggttagtggggtctgcctacatacagactagcagccagcccccagagtgatatgcaggactgcaggcagctacctgcctgaggttataccatcttcttctgttcaaatcaaaaggaaaacaaacgcaaatagtataggaacgatatctcttaagaaagatgtcttggtaaatcacactttggtataaatttgttttctcagattttttgtggaggtgaatgaggacattttcattcaatgaggtacctggtagaaggtttgggttgcaagggagatgcgtcagaccgctgtacctaagttagggggtacagttggccagggataagacagactaaaggctcatgggagaacactaagaggaaatccatggttggctttgtctcagcctgaaaggacagaacagtgtgataaacagaggagctgagactgtggtgtgatggtgaattatcgctaggagttatatgtttagacaaagtgaatccagaaagaatgccatacctttctgacaattactcagaataattatttcttttgcaatatttcagattcctccagaagatgtccaatacatgttcatgactaactagctgcctttaagaaatgacacaatttcctaatatagctaaaacctactgttgtaaggggaagcatgacacgtgcctgagggaaaaaacattagagtagcaaattatcttgttagggtaatgttcaggaacttcttttgcattacttcacaatgtaagtattttctatataactgttaacactatagatattccaggcagctagatttccctataataaaggcaattcattttctttttaatcactagtttcccttcaaaatacttaaaggcttcctataactttcagagtagactatctagctaaaagcctttagcaagtaaatccatgtctgatcttggcagaggtgaatgctatccaatcagacttttcaatgtataagtctcaggaaaatgataaacaatgatttgagtgtgggtcagaaacaactgcaggaaacaacctattttattggaagctataattaaatctaaatttcaaaccctggttaatcactatatcaccacattagatgggtcctgataaagaagtgatcattttcatttttcagatgactgcttgttctctgggagagaaatttctaagaataatgcacatctacctgaatgtttccattgatttatttgtgcattactgatacgtcaggaaacaatgatttttctttcgaaatgttttctcagtaaggtgtggtaagaaaaaaatcaaatttatagatgatcataaaatgtaaaatggacatctggcttctgccagtgtgtagaaaagtggaaaaaaatgctactctcattcttaaagccccaacaacaaaaaatgagaactaatctgtgaagtcacagcttttcttgaatccatcatagagctgtggttgcagggcatcccgccaattcagcatctaaggaaagtcaagatccttcaaggagacacaggcttggaaattcacctacctggtggaggtgccacatgttatacaagctggtgagaatttagctaaaatttttaacaggatgctaaaggctgagtgtgggatagcaggaggggataggacccctgggagctgcaggcacaagagaaaatcacagctactcacagactcttctcagggactttgctggtgctcaagagaaagactggggccaggactagggtcaggagtaggcttcccttgtggtgctagcctgggaagggaagcacaggtcccacaggtcgcagtctgtttgtgctgctataacaaaataccatagactgggtggcttataaacaacagcagattatctctcacagttctggaggctagaaagcccacgatcaaggaattggcaaattcagtgtctggtgagggtccatttcctggttcataggtggcaccttcttgccgtgtcctcacatggtggaagggacaagacagctccctggggcctcctttataagggtgctaatcccattcctgaggacagaggtgacctaatcaccaccccaaggccccacttcctaacgccatcgacttgggggttaaaatttcaacatatgaatgtggggaccatatgaattttcagaccacattctgtttccttttgaaggaaacagaataaaccttgcaagaatgaatcctgggcccagatctttagagatgccctactatttgtggagggtcaggaaaccacgcccagaccattagatgcctcctcgtacgggtttgctggaacacataaaactgcatactaaaaagagtaaattttactgcatataaataatcctttactaaagaataaaacaatactttaaaaagttaaaaagaattagataaacacttggcaaaatttaaatgagttctatagattaaatagtattatatcaataattttctgatgtttattattgtactgtgttatataagagaatgtgcttgtttgtagcaaaaatactgatgtattaggagtaaatgggtaccaaatctgaattttactctcaagcgttgcagaaaaataatatgacacagacatatatatatatatgcaaagtgatatagcaaatgtggtaatattaacatttatagaatctgggtaaaggatatataaaaattctttgtattatctttgcaactttttttgcaagtctgaaattatttcaaaataaaagttaaacattaatacataaaatgaatgcatgaataaacgtaccaagtggttgcaaaaagatgtcagctatcactgctgcagcggctaaagcatatgagtatacaggtactttgcctactcaaagtttgggagcccaaaggctaaaagaaaatcaaaagacctaaaacaaagctgcaggtgtggatttctccctacgcagaaacagcttctgctgtttgaattcaggaggcttctactgttaccagaagcctctatacttccctaggatttgtattcataccaatttcagttcaatttttttaaattataatttctggggtacatgtgcagaacatggtttgttacataggtatgcatgtgtcacggtggttagctgaacccatcaacccatcatctacgttagacatttctcctaatgctatccctcccctagccccccaccccatgacaggccttggtgtgtgatgttcccctccctgtacccatgtgttctcatttttcaactcccagttatgagtgagaacatgcagtgttcagtttcctgttcttatgttagtttgctaagaatgatggtttccagcttcatccatgtctctgcaaaggacatgaactcatccttttttatggctgcatagtattccatggtgtatattgccacttttctttatccagtccatcattaacgggcatttgggttggttccatgcctttgctattgtgaacagcgccgcgataaacatgtgggtgcatgtgtctttatagaatgatttataatcccttgggtatatacccagtaatgggattgctgggtcaaatggtatttctggttctagatccttgaggaatcgccacactgtcttccacatggttgaactaatttacactcccaccaacactgtaaaagcattcctatttctccacatcctctccagcatctgtagttttctgactttttaatgatcgccattctaactggtgtgagatggtatctcattgtggttttgattggcatttctctaatgacagtgatgatgagctttttttcacgtttgctgactacatatatgtcttcttttgagaagtgtctgttcatatccttcacccactttttgatggggttgtttttttcttgtaaatttaagttctttgtagattctggatattagccctttgtcagatggatagatagcaaaaattttctcccattctgtaggttgcctgttcactctgatgatagtttcttttgctgtgcagaagctctttagtttattagatcccatttgtcaattttggctttggtcgccattgcttttggtattttagtcatgaagcctttgcccatgcctatgtcctgaatggtattgcctaggttttcttctagggtttttttttaaggttttaggtcttacttaagtctttaatccatcttgagttaatttttgtataaagtgtaaggaaggggtccagtttcattttctgcatatgactagccagttttcccaacaccatttattaaataggaaatcctttcctcattgcttgtttttgtcaggtttgtcaaagaccagatggttgtagatgtatagtgttatttctgaggcttctgttctgttccactggtcaacatatctgttttggtaccaataccatgctgtttgggttactgtagcctcattgtatagtttgaagtcaggtagcgtaatccctccagctttgtcctttttgcttaagattgtcttggttatgtgagctcttttttgattccataagatatttaaagtagatttttctaaatctgtgatggaagtcaatagtagcttgatagggattgcattgaatctataaattactttgggcagtatgaccattttcacaatattgattcttcctgtccatgagcatggagtgcttttccatttgtttgtgtcttctcttatttccttgagcagtggtttgtagttctccttgaagaggtcctttacatcccttgtaagttgtattcctaggtattttattctctttgtagcaattgtgaatgggagttcactcatgatttggctctgtttgtttgttattggtgtataagaatgcttgtgatttttgcacattgatttcgtatcctgagactttgctgaagttgcttatcagcttaaggagattttgggctgagacaatagtgttttctaaatatacaaccacgtcatctgtagggacaatttgatttcctctcttcctatttgaataccctttatttctttctcttgactgattgccttggccagaacttccaatactatgttgaataggaatggtgagagagggcatccctatcttgtgccaaatttcaacgggaatgcttccagtttttgcccattccacatgatactggctttgggtttgtcataaatagctcttattattttgagatatgatccatcaatacctagtttattgagagtttttagcatgaagggatgttgaattttgtcaaaggccttttctgcatctattgagacaatcatgtggtttttgtcattggttctgtttaggtggtggattatgttacttgatttgcgtatgttgaaccagccttgcatcccagggatgaagccaacttgatcgtggtggttaagctttttgatgtgctgctggattcagtttgccagtattttattgagaatttttgcattgatgttcatcaggaatattggcctgaaattttctctttttgttgggtctctgccaggttttcatatcaggataatgccggcctcataaaatgagttagggaggagtccctctttttctatggtttggaatagtttcagaagacatggtaccagctcctctttgtacctctgttagaattcggctgtgaatctgtctggtcttgggctttttttgcttggtaggctattaattactgcctcaatttcagaacttgttttggtctgttcgaggattcaacttcttcctggtttgggcttggaagtgtgtatgtgtccaggaacttatccatttcttctagattttctagtttatttgcatagaggtatttatagtattctctgatggtagttggtatttctgtgggatcagcagtgatatcccctttatcattttttattgcatctatttgattcttctctcttttattggtccagctagtggtctattgtgttgatcttttcaaccagctcctggattcactgattttttgaagagtctttttgtgtctttatctccttcagttctgctctgatcttagttatttcttgtcttcttctagcttttgaatttgtttggtcttgtttctctagttctttagttgcgatgttagggtgtcgattttaaatctttcccactttctcttgtgggcatttcgtgctataaatttccctctaaacactgctttagctgtggctcagagattctggtaccttgtatctttgttctccttggtttcaaagaacttatttatctctgccttaatttcgttatttacccagtagtcattcagcagcaggttgttcagtttccatgtagatgtgcggttttgagtgagtttcttaatcctgagttctaatttgatttcactgtggtctgagagattgtttgttatgatttccattcttttgcatttgctgaggagtgttttacttccaattatgtgctcaattttagaataagggtgatgtagtgctgagaagaatgcatattctgctgatttggggtggaaggttctgtagatgtctattaggtccagctggtccagagctgagttcatgtccaaaatatccttgttaattttctgtctcgttaatctgtgtaatattgacagtgctgtgtaaaagtctcccactattattgtgtgggaatctaagtctctttgtaggtctctaagaagttgctttataaatgtgggtgctcctgtattgggtgcctatatatttaggttagctcttcatgttgcattgatccctttaccattatgtaatgcccttctttgtcttttttgatctttgttgatttaaagtctgttttatcagagactaggattgcaacccctgctttttttttttttttttttgctttccatttgcttgataaatatccctccacctctttattttgagcctatgtgtgtccttgcacatgagatgggtctcctgaatacaacacactgatgggtcttgacttgttatttaatttgccagtctgtgtcttttaattggggcatttagcccgtttacagttaatattgttatgtatgaatttgatccggtcattatgatgttagctggttattttgctcattagttgatgcaatttcttcagtgtcaatggtctttagaatttggtatgtttctggcattggctggtgctggttgttcctttccatgtttagtgctcccttcaggagctcttgtaaggcaggcccagtggtgacaaaatctctcagcatttgtttgtctgtaaaggattttatttctccttcacttgtgaagcttagtttggctggatatgaaattctgggttgaaaattcttttaagaatgttgaatattggctcccactctcttctggcttgtagggtttctgcagagagatctgctgttagtctgatgtgcttccctttgtgggtaacctgacctttctctctggctgcccttaacattttttccttcatttcaaccttggtgaatctgactattatgtgccttggggttgctcttctcgaggagtatctttgtggtggtctctgtaatttctgaatttgaatgttgtcctgtcttgctaggttggggaagttctcctggataatatcctaaagagtattttccaacttggttccattctcaatgtcactttcaggtacaccaatcaaacgtaggtttggtcttttcacatagtcccatatttcttggaggctttgttggttccttttcattcttttttctctaatcttgtcttcatgctttatttcattaagttgatcttcaatctctgatatcctttcttccacttgattgatttggctattgatacttgtgtatgcttcacgaagttctcgtgctgtgtttttcagctccatcaggtcatttatgttcttctctaagctagttattctagttagcaattcctctaaccttttttcaaggttcttagcttccttgcattgggttacaacatgctcctttagctcagaggagtttggtattactcaccttctgaagcctacttctgtcaattcgttaaattcattctcgatcagttttgttcccttgctggcgaggagttgtgatcctttggaggagaagaggcgttctggctttttgtgcttgtttttcctcatcttcatggatttatctacctttgttctttgatgttggtgatcttcagatggggtttctgagtggatgtccttttgttgatgttgatgctattactttctgtttgttagttttccttctaacagtctggcccctctgctgcaggtctgctggagtttgctggacgtccactccagaccctgtttgcctgggcattaccagtggaggctgcagaacagcaaagactgccacctgttcaatcctctggaagcttcgtcccagacgggtacccaccagatgccagacagagctctcctgtatgagatgtctgctggtgggaggtgtctcccagtcaggagacacagggttcagggacccacttgaggaggcagtctgacccttagcagagcttgaacgctgggctgggagatgcactgctctcttcaaagccagcaggcagggatgtttaagtctgctgaagctgcacccacagtctccccttcccccaggtgctctgtccgagggagacgggggttttatctataagccccttgctgggctgctgccttttttcagatatgccctgaccagagaggacgaatctagagaggcagtcaggctacagcggcattgctgagctgtggaggattccacccaattgggacttccccgcaactttctttacattgtgaggggaaaagtggacctctttctccacaccaaatttgagcatcccaggtcaacttcagactgctgtgctggcagtgagaatttcaagccattggatcttagcttgctaggctccgcgggggtgggatccgctgaagtagaccacttggcaccctggctttagccccctttccaggggagtgaacagttctgtctcgctggcgttccatgtgccactggggtatgaaaaaaaaaaacactcctgcagctagctcggtgtctgcccaaacagcctcccagtattgtgcttgaaacccagggccctggtggcgtaggcacccaagggactctcccggtctgtgggctgtgcatactgtgggaaaagcatagtatctggaccagagtgcaccgttcctcatggcacagtccctcatggcttcccttggctaggggagggagttccctgaccccttgtgctttccaggtgaggcaatgccccaccctacttcaactcaccctctgtgtgctgcccccactgtctaaccagtcccagtgagatgagccaggtacctcagttggaaatgcagaaatcaccagccttctgcattgatctcactgggagctgcagaccagagctgttcctattcagccatcttgccagcctgcaatcctatataagctttctataaatttgattttatagtatgggaaactaataatattctgcactttgatattcttacttttcgtaaggtttatttaacttattcttaaattcatttgaagatgtgttgaaagctgtattttctgctgcagttgctgaggttggccatgacaataaggaaattcaggatgctatagctatggagggtcagttcaatcttttaaaccagcaggattgtccacttggacacagccagtttgtaggtctgatgctggttatctaccccgagactgtgaattctatctacacatggataatataaatgctaatggagaagtaggacaccagggctggacagcaagaaaaggaatcttttcccttcctgtttgagttcatgccttcccaaggttcctttgtcatctcataggtaataatagaggtaattatttataacacactacttatttctaagaagagataggtattttacatttacaaaactgtactaggaggttcactcttaaggagaaaaaggaatgagctgttcttggatttcggcacttgctcattgcctcagactgaaatgtggaagttgagagaaaaaaacagctatgggctgggcatggtggcttatgcctgtaatcccagcactttgggaggttgaggtgggagaatcacttgaggccaggagctcgagaccagcctggccaacatggcgaaaccctgtttctactaaaaataccaaaaattagccaggtgtggtggcatgctcctgtagtcccagctacttgggaggctgaggcaggagaatcacttgaactcaggagacagagttctgcagtgagccaagatcacatcactgcactccagcctgggcaacagagtgaggctccgtcttaaaaaaacacaaacaaaccagctgtggtacctgaatgggattttggcccaaacccaggcttaattcagtgaaaacatttcaccttttaatctttcatctttgtactcttttcattttactattaagttgctttcttccttatcattttccaacttttgcaaaacgaaaaatggctaactaaggccaataataatggccagcatttctagctcaaacagaagcttgggtttctcctccattaagatttgcagtcctgtgtgataaatcagagagacctggttacacattacaaacaaatgaaacttctggctaaccatcagttatagtcaattggaacatggttggttgagagcacttgctgtaaaagctctgagaagaggaagaattttactttagcacaaaattttctttgctgggatgcaatcatgcaaccatatcaaaagtttaaacccatccccactactttttcatggcccccaaaacatcccagaataaataattttaccattctttcctctacttctcttctagtttgcctgtcctcctttctaattacgttattgctaattaggaaccgggggaactgtacattttgaaagtggtgtgtgaaagccttctgctaggtcaaataaaacagccaggattaagatgttgacttagtgggttaataacagttaacaagacgcagtgacctacctgaatagtcaacaagtatttggcctggaatccacgaactacctttgttttgaaagggatcattttctgctttgtgagtacagctaattcacttgagaaggtaaaggtatttctcattagcctttctagtacataaaattatacatattgatagaaggaccttatccagagaccccctagagcaacccagtggtctgccatttgggtattgatctccttccccctgaagttctgatcctaattctcctactgtaaccagcaactgccatttattgtgtgcccatgtgcaaagaattgagctcatatactcatttaatttttgtgataaccctgggagcaagtatatacatgataaaaccaaggcttcactaatactttcactcaaatacaaagctggcagtccctccgaacaaaggctttgctggttttcattccctaatactatcttggtgtagagcagaagccaggcagtttccccttctctgacttgataatcagcagcttccagtgttttaaaatccttttcctttgtgcaattcaatccctctaacttaatgtcccatatagatatgttaacattctctaatggggactaagacggcctaatgcttgttcaataaagcaccctatttggttgggaacagaatcaatgagtaagttacttgttatcaggcaagccatttgttgaagtgtaggcctggctcatttggtacctggccagaatacaatcctgatgggcttaatggaacaaaaacatggcttcattatatttgattttcattcaaatggtgatctagttccattgtgtctggtgaaaggcagagaaatagttgaccttttatagatgcagggactgattttgagtctgttcctaaaaacagtttaaaacctgcaccatttgtacctcttcccctgtctccatggccctcaatgcagggcttttgttaataacctaagcactgtcagccatgtacagcaagggttttcagaacggctcccatggaaatgtccctgtgctggaccaagatgctgctgacattaatactgatggctatctgttttctattgctgttgtaatgaattgccatgaatttagtggtattctcttacagttctggaagtcagaagtctgaaatcaatttcactgggctacagtcaaggtgtcaacagggctggtttcctctagaggctgtaagaagagaatctatttccttaattttttcagctgctggtggccacctgtattcaacagttttcctccatcttcctgcactccagtctgtttccatcatcacgatgcatcttccatagtctcttctccttttgcctccctcttataaaggacattcgggccttatattcaaggcccacccagataatccaggataatctccccaactcaggattccttctgccatttaaggtaatatgtactaattccagggattcagatgtggacgtctttgagaaccattatttagcttaccacggtggcttttgctctatttatacaaaaagtaagataataattatattgtctgtaatttaccttaatacacttccatttagatcatatcatgaatatgtgtatgtgcaagttaacttaatttgcactctagggatgctaagttaacacttgaaatagcgtattcagtagtccacacttctcaggcgtgagcttcaactattgctatctggatttgctccatagggataagtaaaacaatttatctttgatgaaataaggaatgtttaagacatgtggtagctagaaatgttgtacaggtaccttaccccctacacaaattgggcataagagtgaggtccacccaccagccaaacagagcacctaattcttgagctccattcaaaacaagtgcctcctactctcatcgcataatgaagaatcccttcacctgacgtaactaaaaggttaattggtcctgtcatgagaatatttttgcatttgcctcagagtgttcatttcatgcaaaatgctttaaaatatattgaattggacctttgaccaatcttttagtaaaagtgtttatgcctgcttataataaatagctgaacacagggtagaattctgtgttcttataataaatagctgaacacagggtagaaatttgttttaattgaaacatgccatctgatagcaaagctgtctaggaggaagcagatactcctactgaattctattcttcagaggccattcttctgatagtcatcaaacagaatctaacaaataataaatatccaaattggcttagctcagctctcaatacttacagtcaaatgttctccatttggagattgtttcctgcaatcattttcttaaacttttagtccttgcttccattttttctgtttataacgactagcaaatgataaagtgattggacaagtagcaaatgaatatttgccaataatctcagcaacagtcaagccacttaactatgttgattgcttcatggatacatgctcacaattttgattttctatccaattcacagaatttagtcctgttttctgacaatgaaattgttcttagtttaagtcctagagttaaatacatggataggtcatagtgcaaagggtgccatggctttgaggggcttttccagttggactcagttgcatacattaacttgtcctgccctcctatctaaacagctatctgtaaaacctgccaaatttcatgaatgcctcacatggcatttgaatatattcacactacaagtgataaatacagagagacagggttgcctttatgacagttgactctgctagagacaaggatgtctcgaatgctgtctttgctggccatctgcacgatgcagtctccttgtcctcctgagtgtttagtggtttgtgtgtttagatgtcagtttgcctttaactactccgatgcctccgttggtgctccctgtatcctcgaggtaggtttctgccagggtcccttacttttaccttcatgttatccttagcaatcttgtccacttctaagaccttagtcatagaatctccaattctctagtccacagtctcagccctgtctcttagatccaggtgtaacttcatatctactttctacagttttccatatgctagccatttcagaaccaaatccatcaaaatacaccttagccacatctgcttttcactcttggctttcctttctccactcacccctcaggctcaggattctttttgtgttctgacctctgtgcttcctgaacaccctcatccagtctgtgggcaagtcccagcctcccaaacacatccaagaagtcttccctgatcctccctgacctcagccaagagtgacatcttccatatcaacccacaactttcttagagcgtgtgtctcataacaggcttggatgctcacatcctatctgtcctacttattataaactcccaaagtggaggcatttctccttattagcctttctaccttcagagtgcctatttcagggccctgcatattgttctgagctagaggtaatggatgtggaggttggccatctttttggtagaagatgcctagagatggtgcatcctaaattttgtcttgtttagcctgggttcctctcaggttgataggaagcaaatttcatgacaaatttttggagttcaatatggaaaagaaataataaaatagggatacatggaaaaatgcgatccaagaattcgttatgtgggtcaattgaaagaagtgtttacaaccagattctctgggcctggaatctggagctgagtctagggccactttattaaaaaattctgcggcactgtcatctgagacagttaaataaagcagataagggagtaaccgcaagttagaaaaatactacacttcatttaagcagcattctgctgactgcataggccacttcagcagagctgccagtatgcaatgccagccagaactgctgacctgtgtggccacagctgctacaatagcagcaggaatggggcctccaagcaaagcattcaatccctctgtatatttttctgaatgaaaggattccataaaaggttgtatgcttttcagattactcttctcttttccatttatcagttcattaacagacaagaatggacccagaagcagtgaaagggcaaagcccccttcatgctgatttaatacttgagtaggctaaacagtggcccctagatatccaggtccccatccctggaacctatgaaccctattatccatggaaaaagttaaggattgtggcatgggtgattatcctggattatccatgtgagccctaaatgtaaccacaagtattctaagagcaaggcagagggagatttgacagacaggagagaagaaggccaagcaatagaaaatagggtgaagcagagtcagacagaaaagatggaaacccttggctttgaagatggaagaaggagccacgagccaaggaatatgaggaatgtgtctatagaagctggaaaaaactaggaaatgtattctcccctagcagagtctgcatggccaggtgcccttcagaatgttgtagaacgcattctcatgtttggtgggaggggatctgaagaatccctttcttatttgaaaaatcaagcacatgcctagcaactccttcctctttggcattacagattttttgtctgctggattgtttccagcagcatacaacatataataatatctcccagcttaaaaaaaaaaaaccttccttaatcacacatattacttcctctataactccatttctgtacttctttttcacaagtgttgcctgtatactttgtcttcacttctttcttatcattttctctttttaaaatttcttattttaaaatcatttcaaacttacaggaaaaaattacaagaataatacaaatatttcccatattccctttaccctaattcatcaattaagactttccattttttttatttctccctccctctcccctcgtcccataggacgtgtgggtatttgggtgtgtgtgtgtgtgtgtgtgtgtgtgtgtgtgtgtgtgtgtgtgtgtgtacagctcttgtgaaagtcaccaatgacttccaggttgtcaaatctaatgatcatgtttcagttctcatctaatcagcagcaccaaaattagctctctgtgaaatatttcctcacgtggcttccaggacacctctttcttttcattctgtctaccccactggccactccatctcagccttctttgccaggtcctcttcatcatacaaacttccaaatgctggaggacccagggcccagtccttggatttcttctcttctatgtatactctcactctccacacgtcctcatccagtctcaagactttaaataccatctataaattgttaaataaaatttatatctcttgtcctgacctctcccctgaactccagatttctatccccaaatacctactcggcaggtccatttaaagatttagctgtacatgcccaagtctgaatttctgatttctcaacacctacctattatataaagtccattcttcctattatatagagtctcccatttcagaaaatggaaatttcacctttccagtcattcaggtcaaaaaccttagttatcctcgacttctttgtctatattataccccatattcagtccagaatgcaaccaccccttatcacttccaccatcaccaccctgcccacaccatctcctgcctgcactttggcaatacatttctatcttacttatttgtttttgtccccttatagcccatttgtcacatactgccacagaaccatccttttaaatcatgattaatatcaggtcactcctctgtgcaaaacccttcaagaacttcttatatcacaatgctcactgcattccaaattgtcactgacgttcctcaaatatggcaggcatggattcttattccaatccctaattgagaacccccaaaatttattctatccattgcctgagcttctactccacttctaaacatgcaggattcaatgttaagagccaggaatgcagagtacagaaggacaaataacaatgctcataagggaggctttttgaaaaaataagcaaaagcgtgtagtgacgggattctcccaatgggtgaggagttgccctaagtcttcctttaattcatactttaaaatctaccatcaatacagctggctactctgggaaactgttttgcacattgactgagattactaagattagttccagctcacaatttcatcatttgaacatcaaggttaaacatcagaacatttcgcttcttcccgtcaaggcttgttgcaatgtcattatcttatgcaataagaagagataaattataaatacctatattctatggctcagaaggagtggattcattttagtgtgtggtatatggattcaatcttactagttcccaatcccacctcatatattactctttgttcaatacttttatctcaaatacaattcattgttcaattagcaaatgagagactgcatgtagtaattgtatcatatttaaagaaaattgctttgtacaggtatttagagaatcaaactagggagatacagttctcactatgagatgagatgaaaacgttgacaccagttctatcaggcactaaataaatatcaaggcaaaacactaaacaagaccaacttatcttttataaagtaaagggacaacagactcaatccataggtccttattttctcccccactgtatgttttgatattttcttgccaaatggatttaagggaatgtggatggagacttcatagaatctaatctccatgcgtaggggctttagctgtgatagtcccttctatcttcagcacttaccacagtacccagcacatagatgctcattaatatttgttgaataaatgctctggaagatgggcaagattataaatactgaggaagactacagacaggactcatgttttttccttggatagctactgtgtatccaggtgtatgttaggtgctcagtatacacaataaacaagacatctactatctcacagtctggtggttagataagaaatgatcactcatggtgtgagaagtgctatgatgtggactagtcagtgtaccatgggagcacaggcttcaagagacagggaaggcttctggaggacagactatctaatatgagccctgatatgtaagtcaacctgttgaagttggggtgaaagggatctttccaagaagagggaacagcacgtgaacaagcacctggcccaggaaacacagctttcacggggaagtgaaagactttcagtacaatcagatcaaagccgaggggaggagaagacttgaggatgggtacctagatcatatgtgtatactagtttttgaagctgatctctttgggtatatgtcataaacttaaagaggcttctcaacgcctcttttgacttgttttcttgataaatacagaaaatctttttaaattataagatggattttttattttatactcacactcacattttactgtggatgaaggtttagtttattaaaaagtacattccagaatgtttgttaatggccaataacagacagacacttccttactggacattggtaaggaagtcagtaaggatgagtgctacttttcttaaatgtatgtactaaacctggtaatgtgacttataatgtctcagcacgtaatatttatagactaaggtgatagaaaggatggattccaccattgttcttgctaaatgcataatgaaaatattcatctagggacaggattgctacatatgctacagtccagatataaaatacagttttgtatggttcaatagcttataatttagtgggtagatttgcaattagatttatatacctggcatcaattttgtcataataaaatgttttccattccaggtctcagcttttagacacaagccactagataaaaaccttttcctaagaagttaaatgtatgtgaactagacttttgaatgccatttgtaattgcctggttgcctgcaatagctttcttggtgcaatcctggccctgttgcagtgtattctcagcccaagagtcacagtcatttttttttaattgcacatcaatcttttattagaccgatcaggaaaaaggatttagtaaacttacgctcaaatgaacactgggcccatgtggcagggccaagcaaatagaacatggttcagaaatcagtcagtgaaagacacaaaacaaggtgggggagggattctaaaacacacagcaggagacactcctacccctcagaggtcaaggagcttatatgtggtctgacttactctttgaaagagtgactgcccccaggagacagttactctttcaaagagtaagtcagaccatatcatgctgttggtcgaatcccagcaaatggctccccatttcactctgagggaaagccaaggacctaagaaggcctatgtggctataggcccaccccaaattcactgctgttacctccctgacctcatctgcatccacactagtctcttttctcttctttgaacatgccagccaccctcctgcctctataggacctttgcacaagctcttccctcttcctgaaatgttcttccctaagaaatccacaaggctgtctccctcacctcctccggtctctgctcagatattatctactcataaggccatccactaaaattacatcacacacttctaaccccctaccgtgctctccttgatttgccatagcagttttcaccttctaacatactatataatgtttgtatttattatatttattgctaatagaagcaatatccacaaagtctcatttttgtctcttttgcttatgatacatcccaagcacctagaagacagactggcatacttacatatgttcagtgaacattcatttactattttattttaatttttttgacacagagtctcactctgttgcccaggcatgagtgcagtggcatgatcacgactcactgcagcctcaacctcctgggctcaaacaatcctctggcctcagcctcctgagtagctgggactacatgcatgtgctaccatgcccagctaatttcaataatcatttattgaataaatttctgaaataaaactttgtacaactagcaaggattgactagtggagccagtatccttcactttaagcagaaagaagatctgattttaaaacttgtatatgaactaatttcctttatatgtaaaacaaaagcagattctattttgaaggacatattagcattattcatctcacaaccctggcaaagagtgtgtgtacaccgttatttaagtatatacatagcaggaaaatatagcaaatatgattgttcacaaaatcaccacagtatggtaatttaagatagattgacgtctgtggaagatttatttctttctaaaactggcataataatcacaatgggaactattaatacatcaaatttcatttttcaaaaccaacagaagccagttggggaacttttggaagactagtattctaatggattaaaaatctattttctgctttgaaatttaagaggtaccatttaaaggcataattgcatatgccttttataaagtcttataaaagctcactgtctttatgccaacaaagaggaattgtaatgaatgtgttaggactactctctaaatgtcatctcctcaaatatgaattcacaggaaaagctgtccatttccaagacaagcttccttgtagaaaccacaactagaaagcatcaagtgtctcatttatttctaatttaattattaatctaagagggccatggaaactgtaacaatattgcataatgattggctgatctagtgacaggcaatgatggagtaaggctcctccaccttagctctttaatatattaatatgagtctttaaaagtaggacctagatcagatcaatcaagaatttactaaatatataccctatcatggggcaaaaccaaagcatataaaagaaccaacagacacaatacccttagctttattcatgtcaaacaagtacattcacttttattgcattcattgtgatcctgctgctttatagtgataatttgatcacaaaggtatcaatttaaaaaaatcaaatccagctgtaccaagtaagtgcctacctgctaggccaaccatgtataccaacctgtgagtgaacactactgaacttccactactgaacactaggatttagaaaagaatcacttcacaagtttagggttctctttaataatggaatccaataattgtttgttgaattaaagtatatatgaatgaatcattttgtgggtctaacagtattactgcaggtggagcttggtcatcacccaccaagtagcctccatacattcattcaagtgttccttactttgcttattcattcaacaaatatttattaagtgcctactatttgccagatactctgctaggtgctgggaaggagagggggataaaagaaacacagcctctgtgctcacagaatttctttttactttgagaaggcagataatcaacaaagaaagaaatattttcagataatgatagtgctatgaaaacaataaaacaggataacatgataaaatgatggagaatggggtaggggcaggatagtgtggtcaagggtggtctctctaaggacataatatcggagctaatactgtcataaagagaaggaaccagccatgtcaaatgccaagatagaagaaacaataatgcaaaggctcaaaggagtgaatattgtttttgaggaacaggatgaaagccaatgtgctctgattgtattgagtgagataaagtgagatgcaagataaagtcaacaaggtggacagcatccagattacaacataccagattagtggttttctttctttttttttaatctttaaaaaatattataggaataccttagaagctttttaagcaaggaagtgatatggactgaattctttttctaaaataatattctacctatacagaatgactatgtgggttttaaaaaatcaaatagaacttctggaaatgaaaaatgtaactgaaactaaaaactcaatggactggttaaatgacagatttgatacagctgaagaaagatttaatgaactggaaaatagaatagaaaaataacggccataatgtaactcagaatgattagattgaaaaaatatatataaaaaagatatgtatagattgtagagaggaaagaactaaaacgtttaactaattgaagtttcagaaagatggttagtggggcagagggggaagaagactaggtcagaagcaatctttgaaaatataacacagagaattttccagaaatcataaaatatactagtccacagaatcaggaattctaatgaatcttaaacaagataaataaaaagcaatctacatctaaacacataatagtaagaatgcaaaacactaaataaaaagagaaagtatcaaaagccaccaaagaaaggataaattactgtgaaaggaatagactgacagataacttctcgagagcgataatggagactaaatgacagaggaaaatctttcatgccctcagaggaaaaactgtacttgaaattctattcttaggaaaatatcttttaagaagatattaaggaggaaaaaaagatactttcaggcaaagtaaaatggaaaaaaattgctctagtagacttttaccaaaaaaaattctaaagaatacaatgcaggcagagagtggtttcaatctgggatgcaagacggattaaagagaaagagaatagtaaatacatgaataaatctaaataaacagtgactatatccaaaaataatattttgggggcttaaaaactgattaaaatgtaaaacaacaatatcagggtaaagtaaacagaatttaagtgttagaggattaaaaatagaacaccagtaaaatttaaccaaaggacagtaactacattaatttcagataataaaagactttaaggccaaaagcattactaaacacagggtcctaacgaagtcatcacaaccaatatcctattctcttttcttctatttctttttccattttcttcttaattccatttctgtgtctctctgcctccatttctcttcattttaatactgtttgttcttctcatttggctttcttagagcagggtaggcactagttcctacattacagccgtgctcatgattcccgctctgacaatgtgaaagttgttctgaagaactgccgctgaagaatttttgcaagatcaaagacaaattgctctggggctaaatatctttatggactgccaatttgagccacaaatactcaaaccttcattatctttcctttgttagagattctgtaagtaaccctgagcaggtaatttacttcatttcccctcacttcttataattaaaacaaaaagacttatctgcaactaggtaaggaaaggtgctgatgataaaaaaccaacaattgtaaagttcttaaggtgtttgtaagagcaataaaaacctgtttagattacatactatgcactaatttgtcacagaggattgcagtacaaaaatacatgtccttcaaccagtcaaacaggaaagaacttggtaagtctttgaatgtatgagaagtgattattacagccccacccaagtgcagctacacatgccagcccagatcctgctgttgtttttccttgtaaagctagcattgatttcaaaaggtcactaaatgcaactcctggattctgaagaactgtacttagggaaaaagaattgctctttatgtaatacttctatcttataaaaaaaatagattatcaggaaaaaaagacctcactttatatacctcacatctccatgtgtcaactttaaatttcaagatgcaaattaaaattttgagtgacactttgtttttaagaactcaaattgattagttttctctctctaacatttattctgatttgattactccctaacgcatgattacttcaagtaggtcgtgtgaagagcagctctgagtgatttgggagatgttgtttaacatctctgtgccttacttttctatagcctacctcacaggatggtgaggcttgaataaaataatacatcatatttagagagtataatatttccctacctctcatcaggagcccaaagctctaagtactaaaaatacctcttaccttgctaaaaggagatggagaaaaatttatactagtaacttacttctgaccaaccactgatgggtaggaaaaggataaaatgccttttataaattttcaacaatgaaattcatgcgctataaaggtggtaggagcagctaagagtaacttattcatgtctttcacttgacttggttttatatggacagaatctgttacaagaatgaaaaaataaatatatgatgtctacatctttatatattagacagatatgagtaggtgggtaggaggaagggagagagaaagaaagaaatgaaggaaaaggagagaaaaaaaaccaatttaaaccagcagcatgtgtaccataattataaattatggactactatagcatgatgagtagttttagtatatgacagttcaaatgaaatctttcacatgattttctaacttttggtgatattttcaaatctcctttttaaatattcagaatcagcacatggtactgaacaatgtcttatctttattaccaagtcagcagccatttttatttttcttttggaatttggaaactatagtaaaccttgaggtagggcaccctatttaattcaaaaacgtgatttcaaaatttgcttttcctttttgtttcatggcagtgtagggagtgtggtatttcagcaaatctgtgactgtcactgtcatcacacagggccttgttcatagcaaataggcaagaaatataagccggtaataatgatgattcaagccccactcaattgagagcctaaagttttcattccaaatctgatttggagaattggctattaaaaaggaaaatttaataaggagattgaaagaggaaaacagcctactatatcctcagattctgatttaggaattattttttaaaaattatcctttttcttaactggcttgaaggaatgaaagcaacttggtccaggaggaaaatgaaagcgtgaactagtaagtgaaaaacacaaatggccacagatccagcctcagttaataaatgcaaatgtgccctgatgtgtactaccctacagagaatactgtggacttttgattttggtttataacccaggtaattgtttacaatttggttttaaaaataataaaggtatagagacgctttcaatgtctataaccaggtttgtagattttgatcaccaagataattttaagccacaccctcgaccccctgccacaattgacttggcaggtataatcctaaaacaccaaactattcaaaacttgaggcctctcatgtggtctcgactcctcctttttatgaagtggagtcatcgtgtgaatttcaaaattacaataagagataagtcacagaggttaattcaaagagagtttctggtgcactcaaacacatcgtctatgctatgccgttaagtggataacttattgtttctattactttctgaggtgtgttcaacttgaatgcagtgattttactactaccaagattggttttgtcttccttttttttttttaaatgctgttgtttatttgcagtcaagaaggagaaaaaaacctttaagttcaaatgccaaagtcataatattaaaatatatgtgtgttgctctcttcataattaacaccattgtacagcatggttatgagtttagaagatgaaggaaaaattcctcatgtcaatactttttaacccttctgcaggtacttacaacttagtgtacttcaaacccatctctgacttttttaataaatgagattcctttttcccccttaagttagttaaatttcaacgaataaatcgtttctatttggccttcaagcatggcaattttctgtgctgtaaaaggttcattctaaccacaaatctagtcaagtggattctggaaacactttcaaagcaatcaggtcacaggtaggagccaggcagaaggttggcaggctccatgtgagatttccactacagaatcctgacattctttcaaacattatcttttcttgtaaagggaagccagaggtagcaaagacacctgattctattaaaagagcccttggagtttacagaaacacagttactgtggcacaactgagacaaaccaaaagaaatcttcctaagaaatgacattaatcttaagcacagagtcaagaatcttataacgttccacattatgccccaaattcctgaatcagagagctttggaggaagaagcaattttctggctgtgcccatttatgctacactctgcaaggtgagctgacccacccatcttcacacccctgtttggtctcaaatgctgctggcatcccaagcaatcacccaggactccaaaccttcccttattctccttcaggagcctaactgctactcctctttttctcctgaaatcaggctctttgtgccagctttgtccccctcccctgatcctttcctgctcatctctccccagcctttgaatcatggtgctcctactaaattccaggtgtccctcattctctggccctggctttgctatggacatgaatgaactttcctggtcctaccaaaaaccccaagccccctccagctctttggcgagttctcagcctgtctactgacaatttctaagtcatccatgagtaatactgatgctgtttgaaataagaaagaagattatcaatgctctaagcttctctttttaggataggataaaataaatgacgggctaaacccagtccttataagcccaggtgtctgtgcccacagtatcaggagaatgacggggcattctggaagttgccatggagaccaccatactttctgttctcttctggaggcaccaatatacttcagagcaaaaaataacttaaaatttccatccttcctagaaacaggctaaattatgaatggcaatgattgttgactcttcaccaaacctctggttccttttcctcctgggcacacagcatgactacctttccaagccactttgcaattaagtacagccatgcaactagttctcaccaataaaatgtgagcagaggggatacatgtcaagtcctggccacgagtttatgaagcaggtataccccttctacatgctccctttttgcctgctgggtgtaagtgataaagaggcccagccaacagaagaaccataaatggaagacaaggttttctaaaattctgtgtggaagaaaatcacccaccaaccaggaacacacacattggacggttatgtgagcaaaaccctctactatgtttgaaccattatacatttgggtgtctgtttggtattggagcaatgtctacactaactaatgtaaccaatatattatgcttaagagcattaaatcacttgagtattagaattctaggccttgttcctggaaaatacaagagggactagcgaaagggaagggaagcaggtggaaataataatgtgaatagctgcaaacattttccatatatataaccatgtattacatgcattacacatactatctaatttcaatcattcctcacaacaactttaggaaacagtactgtattatcccattactcagatatggaaactgagggagagatgaaatactcaggaagtggagaagccatgattcaaatctgttgactccatagcccacactctggtggaatatcaactctgtgtcctagacattttatacaattttttctttttaacactgtgtaaaataagccttattagccccattttaaagattagtaagctgagattcaacaaagataaatgatttgtctaaggttacaactagaaaaaatcgaaacccagattcaggccaagatctgactggctctaaagccactgagaaatgagtccctcattctctttcccttacaccacagaggtcagaatacagatggggggagatatcatgcagaatgtatttcactctatttatgggcttcagatgtctcagaggttgatctgttaggcctgtgactgtgtgaccactgcagtcattactatttgccagttttggggaccccagggtttctgttggatagaggtcaccaaattacccagcctgtcattgaggctattttttaaaactgataacaaacttgttaggcatggaatagtcagtccctcctttgctatagccccataagaggaattctcagccaggaagttgccatgtagaccaccatactttctgttctcttctggaggcaccaatatacttcagagcaacaaatgacttaaaatttccatcctccctagaaacaggctaaattatgaatggcaatgattgttgactcttcaccaaacttctggttccttttcttcctgggcacacagcatgagtacctttccaagccactttgcaattaagtacagccgcgcaactagttctcaccaataaaacctgagcagaggggatatgtgtcaagtcctggccaagagtttatgaagcaggtataccccttctacatactccctttttgcctgctgggtttaagtggtaaagaggcccagccaacagaagaaccataaatggaagacaaggttttttaaaattctgtgtggaagaaaatcacccaccaaccaggaacacacacattgtactgttatgtgagcaaaaccctctactatgtttgaaccattatacatttggttcaaatgggtgggtgggtcagtcatattcaagcctacaggaagagcaaaaggcagtggcatagaagctaattctctcaatgaataaagcatttatgcataggaagagttatagtagagccagtccacaaatctacctcacaaagtctttaaagtcaaggagggctaccaggaattgtgtttatataaggacttctgggtcctctgaaaataagtactaagggaatgtcagggctgatcaggacactggaacggacttaaacaaggatggagatggggaaactggcataactcccaattagaaatgaagaatggggagaagccatccacatctgtctccgtgctttttaacctgggtggtgcaccctctgatcacatccctcctggcctcacaatggctacttggcatataaaggaattcctccaggtccagacccattccttctcccttctgacttaatctgtgggacttctgatatatctggagtctatatctgggttactgctggaggcttacagtgggacaagatggcagcatcatataacttcctggcctgtgacatgaacctgaaagtccaaggccattttaggatcaaacagccacagtcccatattcattgatccaaacaacagacatctgtggttgggaaaaagcccaaggccctgaaggagctggagttccacttcagggcagagccagttgggccagcagaggaatggcaggaggctgccatggtactaaataaagaggggcgagcccatcgtgctctcagggttttccaggaccagagctaccacagcagcagccctgggtggtcccagagccccaggaaaggccggggaaagaagttcccagaagatcatactcttccacatagagaatcaagagaataggaaggggcatggaaagagaagcccttctactcccacattccttccagtcatgtccattcattctacaaatggtagccagagtgagtctcttccaaactgatcagatcattcttctctgacttccagttgctcctaggattaaggccaaactcattacttggcctataggacctcacaagggccctgcctactgctgtaatctaaattcactccattgtgccatcctctatactctccagaactcaaagtttaattattttatagcctgtaaattccatgaggactaagttcacatatttttactcactactttatactagcacttggcttatttgcctgacataggtgatgctcaatccgtattggttggtcagctgaatgaatgaatgactggctgaagagccaatattctagcaactaagttaggttgaagcaaatcacttgtgattgcagctacaacccttatttctcccataagtggaaggggatagagagacagagtacagttcaggcttctgtgttaaaggttaacagcaacaaagctttccgtcaaaggctactaagcacacacacctgcaagcagatttcactgattcaaatgctctttggaaaggggtaggaaataagtcaacaaatgaatgtaagaaatgaaattttactgttcctatatccttgaaatgactcagaagaatgccaccaatttggtttttcagttccctcccttttgcagtgatggtatttcgtcggtgcaaaagtaattgcggtttttgccacagtcaggaaaatgagatggaagtcctgagggacgaacctctgccctgctaccaactggatgccaggcaatccaatatgtctaaagaggtttttctggttgttttgtttgttttttgagacagagtctaactctgttgcccaggcaggagtgcagtggtgcgatcttggctcactgcaacctccgcctccaggattcaagcgattctcctgcctcagcctcctgagtagctgagattacaggtacgcaccaccatgcctggctaatttttgtatttttagtagagatggggtttcaccatattggtgaggctggtctcaaactcctgacctcatgatccacccacctcggcctcccaaagtgctgggtagttttctttttttgggaagacaaggtctcactctgtcatccaggctggagtacagtggcactatctcagcttactgcagcctctgcctcctgggttcaagcgattctcatgcctcagcctcctgagtagttgggactacagacatgcaccaccacaccaagctaagttttgtatttttagtagacacggggtttcaccatgttgcccaggctggtcttgaactcctgacctcaagtgatctgcctgccttggcctcccacagtgctgagattacaggcatgagccactgcacccggcctagagaagttttatgagtgagccttagtcagggctcactgctaagcagcatcaggctacagccctaagtgaaggaaaagcttatctcatttctgataagatgggatacgtggcagttttgattttggtgctttcctgtgatgggaggcttcaggacctggtttcacccaggatggagtttagacacagcataaccctgagggcataaggagaggcaggaagccagataagttatagtcggtaaggattaattaaacacaacccaggtgagaatgaggaagtagttcccagataacaaagtggagaaaaccggccccaggcctaaagacgtggcagcaataacctaacagcatgtgtgaactgagctcatgttggtgacaggacctgtggtttggcataggtttattccctaagcaaactcatgcaaaactgggtatacagcactaccaccttctaaccacagaatttaaagattaagtatgagattggtgttgtttatgagaaagcagagtgttgctgtattttctttccagggcttgtacaatatgggcaacatgcctatttggcctttgcttagatactcagcccgagagatgaacaacagttatttagaagacctgctgtagaagctctagacattgtgtgataaaactggagatttaacacacattctatgagttctgctcttgactaagcttactctctctacacagaagtaggcagtttaatttcaacacaggattttcacattatcttaagctcctactgtctcctactgactaagaagttctgctatttgaaaaggagtttattttgaatgttcccacagttttagaatcaatctcaatcatccagaggtgaataactcagtttcaaagcttaagcatggtaaaaatatatatatatataaatgtatgtaaaataaaaaaccagcttatgacgggggcagcagtggaatcggaaaaaaagagagtgaaccgataagaacaacatcatcaacatattagaagcagaagagggaattttttagaattacatagtaatgtttagatgccaaatttgtctactgagacatgagagaccctgagagtcccagcatgctggacaagcttgttgctgctgacgcagaagcaaagtgacatgcagatggctatgaattccagtaacacagactcagggcctagaatagaggttctcaccttggctgctcaggagaatcccttggagagctttgaaaaccacagcactcacactctactcccagagattcggatttcgttcctctgggaaagggcattagtactatccaaaagctccctaggtgattccactgtgagctaagattgggaagccctgggctaccatggaggatacaggtgaggaaggtaagggaaggagggagggggagggaaggagggaggggggagggagggagggaggggggggggagagagagagagagagagagcaactgagtataaattctccattcaattcacaaagaggggaaagcaacaaaccatagaacagttcacttttgcaccaagcaatttatataatgtttagcatttgctgaagtattgtactcataccatttttacacttccagatgatgtctctaaacactggatgccatttaactgcgaggctcacaataaatctatttcataatagccatttttgcgttatctacaacctcttctcccaatcactctggtgaaatcagaggtgactccagcacaaccctattcacttactttaattccctgtgatccatagccaggggggccaggagggccaggcaagcctttctgcccagtatcaccctgttagaagatggggagaatttgaagacaaaatgtaagaagatcgaagaagaaacaacgttaagtattactactctcagctgcattcttacttcagtctgaccaggactttcatgctgcctataagctacttcctattttacttagagtgcttccccaatatttttaaaccacagaattctatgcaaacaaaaccttaaatataatccaaataaaaattaagcagtaagcagagccgctgggcctaagcagaaatggaggcccagggcctcatctgcttgggcccccttcactgccctaccaccaagctcaagaacaccagggctgccctgcaccacatatgaaaaccactgacatgtggctccacatagccttaagatgttgctccatttcaatataaggtgtgatttcactggggttgcacttaaagatccagtggatatcaatgtccaaatttttaggaaaatgtgtagatgaagctataagcaagtgtagcatttcccagtatctgttcataaactgagcccatgtttctttggaaacacttcgtggtggaataagattggaaaatagcatgcgctttcccttggagatctccagtgcacactaatatagtagactaatggctctaacaagtcccacagtaaagaaattagtgtaacgttgcttatcccagaagttcctaaattaacactggatggaagaagccttcagaagtgctgggttaatataagttattgtataagtcagtcttttactttccagtattaaaaaagcttgactttttctgattataagaggaatacctgcccattgcaaaaaaaaaaattaaacagaaataaagatgacatgaacaagaaaaatagacccatcttcccatcacccagtgataatgactactaacatcttggggggatcttcatccatttaaagtgatctagaaggttcaaaaatagcataccgccaaaattgagttgagggacaaaacagagataaactgagaatcttggtaattctgggatgctcagtaaaatctttgactcatacagccttttccctctcctctctgagaatgggctctaattcacttctgtgcattttcggcatgaatataccaattcaaaatttgaatttgtggtgggtggttcattgacatctattttccctattgaacatgcttgctacttctttaccctactttcgaacaaatcaaagaaagttgttgagcaactgaatgaacaattaaaactaggtttctcaaactcagcactattaacattttgagctgagtcactctttctgatgggaggctgtcctgggcattgtagaatggttggcagcatctctggacttgatctactacaaccaaaaaatgtccctagacattgccacatgttctctgaagccagggaagggaaacaaagtctccctctttgagaaacactggattaaaagaataaaaggatgaataaccaccaaactgaaggagacatagaaaggagggaaactgggccaaaagaagttgctctcatcttctccagggacaatcagtctagacccttgtactgacaccctgccagagtagctgtggcacaaagggcacaatgacacattagcaggtgacctgttaaaaaagccacctgaggcacctctgccaaagtaaagatgtgcttcttgatgacggcacagcctctaagaaacccagaaatgttctgagcactttgcagttaaaaagaggctgacttgctcatttcttttgggggaagtgaatggctttataaactcgaatgttctattttactgaacgttcacctgatatgaaaaataagacgtttcatcagtcaccaagaaaaaaataagtcaacaccaagacgaacacttattatgaagttactgttcacttgtttgtcactgatgatatctgaccctcacacaaagcactgagctgaggactcacctttggcccttgggttcctacgccccgaggcccagaaggacctggagggcctctgaccccaggctctccctgaaaagacacaacaaataacaagttactaattttttaaagactttatgtttttttcaatatatatattttaatatcaaaaacttcttgaatgtgactaaggtattaattgaaccctcttctcctagatcacttttctattaccacctaggcaatcttcaaaccaacagatccaggtccatttcaaattaatcaagtcaattaacttcttggcaacattaacttttttcagaaccctcttctctagaatttggaaaagtaattacgagtattgtgaatagaggatggaagaagagacaagaataaaaaacaaccattaagaaatataatcatatcctgaactagttgcttttatcattgtatgcaacaaagattatgctatttgagttatgatgtttctgccacctcattaactggaactgcagggtaaactctaaaaaggattttcagcttcactaaggcatgacagcttcatagctggcaactattaccagaaaattggtggtacctgatgagggtaggtgacgccctgtggcaagacctactagagatgctaatgatgggaagaaggagagaaataaaaattgcttcattagccaccttctgtattcccaagactatgccatgtatgttcatatatgttatttgatataatttagtactcacaataatcttgcattataatgatgtctagtttatgtaacttctctgaacctcggtaaattcatcacatatgtagaaaataatatctacatttcaaagggctcagaattaagtgagacaaagcttgtaagtgtttctatcatgatttttaccacagaataggcacttggtatatgtcagctccactcacctattttattaaagtggaagctaaggtttgcccaagtctgcacagctattaaggtgcagggctagaaggatgtagaaaaacaggaaccctcataattgctggtgcagccactttggaaaacagtttggtggtttaaggttcaacataaatttgccaaatgatacagtcatttcactcctacatatacacccaaagaaaataaaaatgtatgtccacttagagacttgcatatgaatgcccttagcagcattatacataatcatccaaaactagaaacagcctaaatgcccatcaactggtgaatggacaaagtgctgtaaattcagcaataaaaaggaataaactatgaataaatgccataacatgaatgaacctcaaaaacattattactgatgaaagaagccagatatatgattacatttataaataatacccagaaaaggtaactctatagaaacaaaaagtagattagtcactgccaggggccagggacagcaacatggattaactataaatggtcgtgagggattttactggggggataaaaatgacctaaaactgatttatggtgatggctgtatagcttagtagcaaatttacttaaagaaccattgaattttatacttaaaaaggatgaattctagaatgtgtaaaatatgcctgaataaagtaataaagaaaaaaaagaaccagggtcaggctttgaactaccacccaagacctttagccttaggtcctgttttgcccatatcctgttaccagctaaacagcttccagcttccaacactgcaaaaaccataaattacaagaaatgttgaagttgttcattcagaaaaacagtccatcttttaatttactttctacttataaactctaaaatacttccagataacccaagcccttaaaaggacgggggccactttaaaactgtactttattactgacttaattcttttaatatctactttcataattatgtatttctattttgcttacagaccacttttattatactgtctccatctgttccacttagtacttagctgcttctaaggctacgggtgctaattatctctttaacacctctctcctactgactcccatctttgagggtccccaagttcctgccagctgaaaggatcactccaacatcaagggctccaagtagagaacatgaaaaccctgtagtacatacatttccattagcactcctttcttgagtacctatgaagtactttcaaagggagagtgtgtaagttcactgcctgaagttctccaactacacctgactgattcatacactttgctacatcttaaaaggacatgtcttttctcttccaaacattttgacactctccaacaaaacaagtcaagcatagttaagtaaatcttacccaaaatcatcgaaagtttcatcaaaaataatactcctctttgctcagtcaccccaacccaccccagatttggtggcttcctctcattcatttccgttcacctgtgcccttccaagatgaggtgaaaaggttaggaaggatatggccaggttgggcgcagtggcttacacctgtaatcccaccactctggcaggccgaggtgggtggatcacatggtcaggagtttgagatcagcctggccaatgtaatgaaacagtgtctctactaaaaatacaaaaattagctaggcgtggcggcaggcacctgtactcccagctactggggaggctgaggcgggagaatcacttgaacccgggaggcagaggttgcagtgaaccaaaaccacgccattgcacgccagcctgggtgacagagtgagactctgtctccaaaaaagaaaaaaaaaaaggaaggatatagccagacaccatgtgcctcctgctgtgatacattagagaatacaccaccctacctatcaatattctggcctagaaaaaactgaacctggatgtaaacacgtctcttgacctaccagctttgagtgtccccaagttcctgccggctattactaccagcttacagtaatagacggaagagggagaaacacgttacacaacaccatgaggatatcatcagcaaatccgcaagtacaaataacacatacactaactgcgagctaaaaacaagggaggagtctactttgattaagagagatttaagagctatttcaatcaaatgcaatgtgtgggcatgatttggatcccaatccaaacaaaccaattgcagcaaatgggtaagacaagcttggaaatgtgaatgctggatatttgctatattaaggaattgttcatttgttttaggtttgataatagtattgtagtcaagtttttaaaaagagttcttacatttgaatgacaaatgctaaagctttatatggatgatgtctgaggattgcttcaggataatgtggtgaggggaggagtgaagaatatagctaaaacaagatcaactatgtgttgataattgttaaggaagtgtgatatgtaaatgagagttcatttcactagtctttccacttttgtgcatgcttaattttcataattgttttaatacaatttttaaaaatccataaacaatatccagcaaaagtctctccagtgaacctgagatagtgttgctgtaatagacccccttaataataattcatgattttaaagatattaaaactgggcaaaggggaggagcacacaggtagattcaacatcattagaatttacatctgtcgtgtgtattcttgggatgtaccaaatgttacataattttttttttaacatagggatacggagagaaggcaagatttttttttaacaaagtagtatgttttaagaaaaaatttgacactgtagtatttaattcatgattttttttgtgtgagaatgttagctaaaacctcccctcaactagtattaattacactaatacccacacatgggaaagcaagcgggaaaagcagttaaaataggtccatagtttacctcaggccagccttgtcaatgctcagtgttgctattcattctctccttcacagtctcccttattcacgtccccctaaccctcaacctttgggagtatctgaaggccaactgcagtaggacagctgaccctgtagataccttactgttctctctgtcccgcagcctcagccaatgaatttaagatgtgttccatgtcatctgtggtccttcagtgttcacctaaaacaaactgtccatccttatccatataattgttgacatatagctatgtttcacatatctaaataatcttttgtatctttcaaactacgggaaaataatgacttatagcaatgcttttgtgaatctaatagactttaaatcaagtcttaacgttctgcagatattagaattggtctgtaacacggcatgagagttgttcctcagtgtatatgtaccatactttgatagatgggaacattaggcatttaatgatctgagaatccacagaagtagtgtctctccactatggtggggtctttgaaaatgatcttttgtggttccatgggccgtgtgtccatgttaggccaccacacctggtaaatgtgagcaagagaattgcggacaggtcttgcttggccatttgacggcactggttttgtcataaggcagcaccgtaggtacctaagaagtgcgttgacctgtgatattttcagatacacagtttattgtcagtggatacagcaatattcacaaataaaggaattacaacaggttgtcgcatagctggacatagcttcccacgcaacagctgagggttgttggagcctgcagagggagcccttgtattaggagataatgaacagacgtgcgagcaaattctagagtcgccattggtaacaacatctatcactttcctaagatgacagtcttagccttacccctaacccctgcacccactctctcaaaagaagaataacggactgtttagatggcataccacttcctcttggcccgccaaagggattctagatgggagatactactttcattttcacaggaaacggccaaattcaggactgtctgcagtatttgtgcatatgaacttaacaaatgattcagtgaagaccacctagaccataaccttgcagagtggataattttaactcctttaaaaatacacatcatcttatgatggttctaaaactcacacattgaagctttccctttttaaatgaaagaagaaagaggagagcaaacacattcattcattttctcattagtaaatcttcactttggttaatattaaaactattataataaataataaataaaaataatacttattaagtttattatgcagcaggaagttttcattcattatcttacctgatcttatcaacatcaacttattccattttacagataaggaaactgagctacagcaggatacatgacttgccaaaaaccaggcagtctgaagcaattcaaacccaggtatgactccagaacccatctcccattttgatgtggactgggactagatgcaagacgctaacttttccatagactttcttccagctgtcatttaatgcaaagacctcggctgtttggctgtgaaactgtaaaagtcctttccctacatcgccagtcacaccctctcaaggagaagaacatcctggattataagattcatcctgtattacacaggtcccacacgacctgcacaagaatccagccctctaagtcttcccgtcccattttccctccgttgctaatccttggttttgcggtttactccaatgtgttaattgacttcattccagatctcctacctataccagttcttaatctctcttcttatccatcctacaatgtgtgtgatttggcagcgtgatgcataaaatggctactaccactaattatatttgaatttgttaggattcataaagatgttttacatacattagtctattaatttatcataataaacctgtgaagtaggcattattatcccaaatcacagataagaatgctaagcctcagggagactaaacgacttgctgaggtcacacagctaataagtggcaaggtttcaaggtggagcagtgacaaggaaacaacccattataccttatgagttttctaaaaatatcaatataatatttgaggaaataatcagcccattagattattttcctcccccttactcccccacacactaatgaggctttaatcatactctctccctttgtgccagctaagttgctgccactctttgagaagaaggtggaagcaagatatacttgttccaaaagtgatttcatgctttttctactttggggacaataaaagcaaattaaattcactgtgaaagaatcagcctcttaaggatgttccaaggaatggtactctaaagattctgctaaatgatgaaactgaggaatgactgggttttaaaataaggtagaagtcaaagtgatgatagcagctgccttatgtttctttctttctggtttttaaataaaattaagatataactactccaactaccacaaacataggcagaactctggaatgaattacataattccacctatgtcatgtgttaggacctctagaatacctcactcgtggtagccagaatgtcaatggaagttttagaggcttttttctaagtatatgcacatattggcaatgtgtattgattattgaatgaccgttgtcatatgactcagtcatttctcaatgacaccctttaatatgaataggaagatagtaccaactgtcagcatgatcatcatggggatgagaaaataattatacaaatgctagaaaacaaacttctcaaattgctacatttcctctcaagtattttctcacctttaaatttcaaattatttaaagtattttcaattacttgaatcaatttatctcctaaaactttaatattcaccccaaaacagctgtatctcatagtccctgacaattttaaaacttcttattttttccttttctcaaaatcatctcatcaaagatgagcaaatgatggccttttgccaagaacttcactggagagcaagagtctttcttatttagcttggttagaaaccttgaaaacataaatattgatactgccccttacgacagtgagaagagcaggctgtcttgtactaaaactgaatataattttccactgggagaaagttcctccaagtctgcatgatcaaaaataacaatatgtttatggtgatgtgggcaatgaatgttaaggggatttaccatgtgtctccagggctgaaggaaaagtacgtacatactcataagaagagaaatacaaagctaggaaaacagcaaggagagatgaaagcaatattcaaagtcatgaggtggactactagagtgcagctcagattttagagatcaggcatataactgcattggggagtaaccttgaatagtcaccttttcctggtcttggatatgaccctttctgaaacctctgggtcaaactgcctagggtctaaactttgtatggctctggctttaattagttctgttttgggctgattgtccaggctgaagcaattttgcagtcatattatagggaggtggctttcttcaagtccactttggaattacatgcccttaacttcattaagtctgtatcctaggccagccctccttgttgggcactgttcaaaaatggagttccttgtccagtctatgtctgccaatggaattcacacattcctaatgcatctctgtgtgaatcggtcctctgttccaccaatgcctgttggtggagtgtacatatgtgagccattgcagagaacagaggggcaattcagatgctgggaacatttttagaataatgatactcagtggaattccacatagacttgcattttatggctatgggtcacttttgtcaaataaagcatgtatttacaatactcaaacatttaaagttactgaaaaatatttaactcttttgggtttggggtttatgcttctctttaatgtttatataatttaagttttgacaatagaaaagctaggctgaaaggggaaacaatccaactgcacacacaaaagagtgcctagatagaagacggacagcataggagattgagcatctgtggatcagggtaagtcatgctttctgctctgatttattcatccatttagtttttcattcattcatccatatccatagcccctctcatatacaaaacaaatgtagtatcaaaaatgtttctattgtaaagagacaagttgctcaaccttctggttcttcatttcttcatctataaaacagggggactgttaaaaatgtcataatattctggaaatatttaggtaatacataatcatgacaatgataatagtaattatacctgtaataacaacaacaatccaacaagtcttttctgccaacagacttatgccaacaacttgatggttaagaggtcctaaccccaaatccaggttagatctcctctgtgcaaagattaggctaagttcaaccactccaaggctttggagcgggtcatagctttttctgtgatgatccagctccctgagagggcctgaaaaaagctaagagacgggcacggtaggctgtacctgcccttagtgaactcaggagagccacgtcttatattccttttctatgaggccagaaataaactcttatatcagagacatcaggaaatcagaccttatgctacatgtaccttacaaagctttgggggtgaaaacacaggaacagagttatctgcagctcctcgaagagaaatgagacgtatggcatgtttgccctcaaaccacaagaagtgcccttaatatctaaggctccagagaagaaaagcaggctgtgatgagtggggcttggagcttggcttccccatcaacgagccaggagattggatccaggagtgaggacactggatgagcacttcccacttagcaagaaaccaaattatcagttcctcttcccagcatgtttcaaaggtgagtttaaaatctatatctcctctctccttcaaagttgtagtttttacaagaattttagaaatatctcagaaggtcttgccgaatttgaattaaattcaaggtaattgtatccagaaggacaataaccactgatgttgcagggaatttttccacttggaaaagagccacggagaaccacaagggtgctagatgtcagcaactgctttttatatgttttgaaacacagaagctttgagtttaatgtctgtgtcatatgctaaacacatgtgaccttaactaaacagcaccaaaacccaccataaattcatcgtcaaccttaatggtttcctcatttcaaaacacatttgttttgtaagttaatgccttaaggccacaattttaaggcgactacacaaagcttaaatgaaaaacatatcaggatccatatggctctactaccacacacacatatatacagtttcactgtcattttaactcaaaaggggagaaattttgcacacatttgggtcctgtgcttccgctgccatggacaatttttggtattttcagaatttcccgtactttaccaagcaagaagggcaaagttaactggaattatcttcctttctttgccagtttctgtctatgaatctccctctctctctctctctctctcacatacacacacactctctttctctctgtgctctgtgtgtgtgtgtggggggggggatggtgtgtgtgtatgcgtgtgtgtttccagaagttttcttcagaaaaaaaggccacatagaaattttgaagcccctgtaaaaaaggagagatgatttttaaagttacttagaagctggtattttcttttagactttcctttattttcaagtttatgatccaagttcccttgattctaagaccagctcaccctcctaacatctccttccagggctagagaaattctgaacaacacaatttccatgggaagagacaagaagcaatggaaggaaggaaaagcaggtgagagggaggcgtgcagacaggtaggtcctacctagtactcttctcccccgggctctgcctgcagctggaagcaaaccatggactgccgcttccactcagccttccgcgtgggctcactcagacaatgggagtttcacttaagatacatcttctggcagcatattagccatttcaaaaaaaacaataggcaagatgaagttttgaaccctttgtttcttacctttttccccctaaaatgtagacgaaggcaaatacaggggacttttggaggaaaatggcatatgcaatcatttagtaaatgttttagtctgtatcttagataatctgacacagtgaaatattcataagaattgggttttttatgttctttttttttgaaatggagtttcgctctgtcgcccaggctggagtgcagtggtgcgatctcagctcactgcaacctccgcctcccgggttcaagcaattctcctgcctcggcctcctgagcagctgggattataggcgcccaccaccacgcccagctaatttttgtatttttagtagagacggggtttcaccatgttagccaggctggtctcaaactcctgacctcaggtgatctgcccacctcagcctcccaaagtgctggaattacaggcatgagccaccacacctggctagttttttaagtgttctttatctgtgcctaagtgcctgtatttattattattgctcaatgtaaagcagtaacataatcgtataatttaatataacatcatgtctagttatataaaaaattcataataatctactctgtgaaaatgtaaatgatcatctgtttccattggaatacacatattctagtatatatttaacatattttatttcatgttttattttacatagaaataagcttctacttccctaaatattcaatatacaagtttttaccattgtttcactcacagcgtaagataatgaggtttacctattgaatttctctattttttttaattttaggattttgacaggtgctatgccttaaagaaaaaagaatacatcagtacccaaatttggtgcagtttattgatacagttgaggcttattcaaggatctgatgtagtcctgagtcagaccaagccagatccttcatcgaagcacctcgggtttgtcctgtctgtacagtgtacacagcacttccagatacatcctcattggactctcatcattacccccagaagcagaatgtggcagctatcaagattcccttttaaagatgaaatttagtgccatgggtctccaatcttttattccacctgggagagggcaaagaggcacttctaaattttgtggcaggggcaaaaaccaaggggagaagttggcattaagcacgtacaacatcttttctctctaatgacctggaaacattcaaaaaagtaagtagatatatttcaaaggaaaaattctccctttagggtaatattgatcatttattcattttccattcattcaacaagttgtagagctcctactgaatggtacacctagttctggtgacatgaagttaggagggaacaaagcaagaagcctgctccaggaaaaccttcactctcatggaatatgcagagaaataaatgaggaagatgatctcagaaagtgatacacgctacatggaaaacatacagaggggttggggtagtaatgctttctgtatgggtggtcggggaggtgacatttgagctaagcttttaataatcagccatcctggcgagtccctgatgcaggaatgagctgaagtagggcaggccattttggctgaatgtcggcagccagggagaaatgacagaagctgcagtcggggcatgaaggatcttcaaggccatgggaagtgttcaaagtctgaaagagaagccaccagggtgtttctaggaaggaatggtatatgctctgatttacggttttaaaagaccactcttcctgctaagttataggaggacagaggtggaacagagggaagaccaatgaagaggctatttttacagcccacgtaagagatgacattgtctgcctggcagaagcagaaagaaaaaaaggagccagagttgagatatattttggcggtagcattgacaggatttaccaaaggactaggtgtggaggaaggagaaggaaaggaaggaacaaaggatgatgcttaatccttctggcttgagcatggaagagccatttgcagggttatggggcaaaaatcaaggatcttattttggattattttaaattagagatgtttgtgagaagcccaagaggggatacatggtaggaaattagatacatgagaccagattttaagggagaaaagataggtatttggaagtcatcagtgtgtggacagtggttaaagccatggggctggacgagagtatctagggaaagagtatggctagaggagagaggagatctccgacttgtaccctgatcttggtataagaagaggaagcagcaaaggaatgcgagttgctatcagagaaggaggacccaaaccataaagttagtctacatgttcagattagttccccaggaagtctatagataagggcaaataactttatcaattatttcagacacctctactcttctagctgataaaaaattttatttttaccaaagtcacctacctataggtgcactcttagaagctagtacgttgcctactttaaagtcttacctttgctccagtgtctcccactccacgtaaacccatcggcccagggggtcctggtaatccacgaggtccctgagatgacacagtaagggagggagtgagcatccttgtagtatgcaacactcaaaaaggagggagggaagaaaaaaatgtcccacttacaggcacaccaggatagccatcacctttgagtcctggagcacccactggtccccgagggccttggacaccctgggtaaattccaacatcagtgatatcatgagactcaactagaaaacacctggtcaaacttaagcataacaccaactcaatatgccaacggtcgatttctaacccgggagttagaaaatgacttattgctagtactttaattcttaaaattataaatttttagtgcatcgtaaatcaagaagaagtataaaaaagaaaatttattaagcacaatgtgagaagagtagaaaagaatacatagcaaaattttgagtgtgggataactagtttcctattgttgcgttaaatctattctcttcattaatggggcccgaattatacggggaataaataaacccagatgaaaataaaaacacattaatttttcaaaaacaagttatgaagggatagagtttgtgactcatatcttgagacctagggaaaagttgtaaatattgttttacagtgatgaccttaggcatcaaaaacttttagtaacagcccttagtctcctacagaaagagcagggaggggtgattattgtcctttagacaacagagttttctaagacttgtaactgtctcacaaacagcaatcagaaaatttctgactcaagtaaaacggggggagagaaaaaaattaagaaggatcttttagaagattacctacaagtggccgggtgcggtggctcacgcctgtaatcccagcactttgggaagctgaggtgggtggatcaccaggtcaggagttcaagaccagcctggccaacacggtgaaaccccgtctctactaaaaatacaaaaattagctgggcatggtggcgggtgcctgtaatcccagctactcaggaggctgaggcaggagaattgcttgaacctgggaagctgaggctgcagtgagaagagatcacactactgtgctccagcctgggcgacagagcaaggctctgtctcatttaaaaaaaaaaaaaaaaaaagattacctacaagtccattacacttttatttaaaacttgtaatacttctttttacaacatattccactgatctgttacaccgatctgttgttgatgactcttacaacagcccttgtcaatatgcagcccttgttttgataaagagctgctcatgttttaaaatatttatggtttttctttatattgggaggaaactctaacaacaggcagacctttgttttgcaagaatggagaaagaaagtagcaggactcttaagaactttcctcatatgcaaacaaactcggagatcaaattgccattattccaagtgaaaatactgcccaaagtccaactctcaaaaactattctcaactatactccaataaatgaataattgactgggaacaggggaaaattttttatatactctttaagcaatcagaaactttattttaaaaaccaagaatgcaacagctgttatttcctattaaatctaaaaggctgtttttatgtggttaaccttcttaagaatgatcatctttaggaaatatgtggccacttataaaaatttaacctactattcatcatcaacaaaaactcaaggtgattttttaaagttgaatgagagaaaggaagcccatggtcttcaggacaggtaaatttgggtgtattccaactatggggaactggtcacttctcagaaccaattttttatgctattccagttacatttaaggatgaagctctaaacatctgcatatgaaacttgtcccaaaataagttttccacttatctccatgtttacacaaggagagggccaacaacaaactaaagcagtaacagctccccggttgaattaaaaggaaaagaaaattggaatcaaaatttacttttcagtttttatttctacagtccaaacttagaacaaattgtcagcagctgctcttgtttaacgtctgacaccacagcggaggggaaaaccatgcaaacactcacagtttacaaacatcctttttatagagatctttgtccttgctcctgcaaaaatctcaggtagcttgttacttctattattaacaggaaatatcaaggagcaagaggaggagcaggtttttattttggactccttaccatatttttatagatggaattttgccacttggcttttctgtactggattcaaggaaatgtcctacaaagttatttacttcaaagtgtttctctcattcaatagaaattagggtaaaaatggaaacctagtattttgaaatcagctttagggggcatctgggagacccctgaagtattacataaaatgaaattaatgtgctaaatcttccgtcagaccttcaaaggtgtgtatgaccctcccaaaactgaaaaactaatgaactagggaagaacaacagaaagagtatcattagagtccaggggagtagcaaaatgattgagtgaagaggcaaatatctttaaataccatcacctataatgcctaataatcatcaacagaaaacaggtgaggcctataaactctagcagcacatttaattggattgtattcctattgcaaacagaagtatatgtagagagagatgtataaatcggattgtgaatacacagcttcaatctatcaaaattgtcatgcaaatataattgatcaaggtcatagctgcagttttcaaattagaaaatttgctattgtccccatgagctgtctatatagcttgtgtttctaaagagagtggtctacatagtttgggttaccttgggatctgtgggaagtagacgaacaattcgtccaagtttgcccaagattttcccagttttagcccggaaagtcatgcgttccaggaaccccttcaatcccgggcaaactagggcagctgtcactctagcagggaggactgttaaagcaataaaaacaggagaggctcaagattctccctttacctttaaaaagaaccactccaatttatgtcagtttttatacaacaggttttgcatcatattttatttaaaaaatgactccatgttttcttcttttaactttgaaggtcatcagtttagtacttgaacccttttatctagataagacaacttagtatgggagaatataagcaagtttcaaagctacgtaacaacatgctattgattttaaaagtgctaatgatggggccctgaagcttgtcctcataaacagagatatgctggttgacacctaggaatgctatacatgctgaattttgctgtggtgctgggtatagtgtgaggaggaaaaatggtgcttcgttgccatgaaaaaccagatatgattacagaaacctggtttcttcttatttgtctttccctttgaaataactcaaaaggataaataaagcaggaaatttttattcagcaaagcttccaagcacacacgcttttttggacaatgttttgcagaatagatacttcagccactaatatgtaaatgaagaggccagaggccatttaatgccttgtatcactgacagtgcaaaagagcatttttcaaacaattgtctaatcagcaaaaatttaaccataagagctacttttccccacaagtatgaaaaataaactatgtgattgcttgtttttttaaaaaaagggaatagctatattcttacattttagttaatcaatgtagaaacctcacaagtagaaaaatcaacttatgcattaaatctaccttcatttatttcagatacagaaaaacaaaaagaacatgaataaagcatacctttggtcctcgaatagaaagtccaggttctcccttaaatccaggtatcccaggtcctcctctatctccctgtacatttcaaataacatttcacaggctacagttgtgcgagaaatcacaagcacacatagcaaaaaaaaccattggccactctgtaaagagcttaatctgtccatctcagaccttgagatagtatattcttcaaacatatttgaggggactttcaaatcctaagtaaataacacctgtcagtaaagactattactgctgttgggagaaagtccattgaaataatatgtggcaattcagactcaaatatttcgactttaagaatggctgagaatgctcttaaaattgagtgaaggccaggcacagtggctcacacctataattccaacaccttgggaggccaaggcaggcgggtcacttgaatccaggagttcaagatgagcccggccaacatggcaaaaccccgtctctactaaaagcacaaaaattagccaggcatggtggcacatctgtaatcccagctatttgggtggctgaggcaagagaatcacttgaccccaagaagtggaggttgcagtgagacaagatcgcagcactgcactccagcctaggggaaagagtgagactgtctcaaaaaataaaccagtcaaccaacctgagtggatatctcttctgctaaactcttcaattataaatcctggtagattcttctgaataaatgttctaaattcttacctgcattagggtttaggatttggaagacgtaatgaagggtaaagtgacaagcttgggaccaagagcacaaaatctggtttctagtcttaactctgctgctggctgtagtttgcttatctgtgaagtttcagagttaaacggaatcatttctaaggctcttccaaaactaaaattctagttcactggtatcatgatttttttttctccaactgccaaagggtcaagaaaaagaaaataatctccaagaatatatacctttggcccaggtggtccaggaattgatgttccaggcattccaaaagggcccataatgcccggttcacccttaaaaagagcaaaatgctcactacatttcaagcagagaaagcacatatagagacaatattaagaaaagtacagaaatgtctgcagatttttaaattatgttatgacctctatctgtttcaaagaccaatgtgaaaataatttgagcatcttttgtaaccactgctagttattgactagtaagatttcagtgcttttaaataactatgttcaattaatcactgaatgttaggaacattttatctcttgtgcagcctcttattagctaataaaaattatgcaattcatggtgcttcctttttgtgttgtatgttgggaagctcaaagagaatttttttttcaatatagcaattatcttcagcaaatgttttagggtgtacttctaggttataactcttttttctttgttgttttattttaatgaccaaaggtaaaatagtcttccattccatgttatctcacatcctttttaagaagtagaacccctatgggctgggtgtggtggctcacacctgtaatcccagcctttgggaggccgaggctggcggatcacttgaggtcaggagttttgaggccagcctggccaacatggcaaaaccccatcgctactaaaaatacaaaaaaaaaaaaatagccaaaattagccagacatggtggcatgtgcctgtaatcccagctactcaagaggctgaggcaggagaatcactcaaaccctggacgcagaggttgcagtgagctgagatcgcatcactgcactccagcctgaccaacagagcaaaacgctgtctcaaaaaaaagaacccctatgattttaaaaaaatgacatttttaatagaaaattttaaacatttagtgggggagatgtctaatatttagagtctcaaagactcaatctggagcaacaggtaattctcctgttccatctggatctagacaagtgattctcagattttagaagcagaggaattatcaggaaagtttggtaatgcacagttctgggttcaaactccagagattctgattcaatagctctagaggttggggcccaggattacgaaattttatgaagcacccctggtgaaaaacactattccagagcaattgtcaccgcacaccgcaaggtgttccaaatgacccactgggatataaagaaaatattacaacttgtctctatatttttatctcatcaattaaaatttcatttatataaattcataacatattagtatgatagcttataaacagaaattacaattaaaaaattaaaaatctgtggcatgtgatcaaaattttactggaggggtttataatcaaaacagtttggaaactacttctctacggtaggtgggccaaatccagcccacccccttgttttgtacagccttgagctatgaacggctttcacattttcaagtggtcattatacaaataactaaatatcttccattttgcctcttgggccacaggacctaaaatatttactatctggacctttaccaaaacaaacaaacaaaaaacactgtggagatgagtcgtggagaatgagctgtatctatgctatgtctaaacatgaccctctaggttttcagactgctgactactcctgcctccgtctgactcatgtcctctgaaaattcaattgcatgagcttccttttcagtcatcctgcttcctccagcagggactccatcagtcagattcaccagtgatgactcctgcccagggccgtgttcatcttcagagctgaagcctcccgctgtattgattagccaatacaaccaacaagctgagcacactggcccactgagacccagttcttgccaaggcatgtatgtgccagtccttaaatccaaacctggaaggcaatggcacaggacatgacaagaatcgggaaacacaaaaaaaccccatccaagcctttgacaaaggaacagaacatgaacctgttaaaattcttcactaaaaccaaaggaaaatcaaaattatgtctctagatttaattttacttcttttttcaaaaaaagaggtcaattacttttataccatgaaaagtatcatggagagtattaaaatacaggtctcaaataccctgtattaaggggtgattatgctttaacatatggcaattcttcaccttcatctttaaaaacagctttatttcaaaacacagaaaaatgttcactttgaaatagagtaactaggacataaagactaatctgttattaatactaatacaacacatctgttacatagtggcacttctcataatgtgcttcctgaactccctgcagcacagggcatttacttgagaagcacagattcctgggctcactcaccactgaatccagagagctgaggatggtaacaagaaatctggatttgtaatcatccccaggtgataccgatggacactgaatggacactgaagtttaagagtcactggtgtacaggtgatgttttgtatctgatgttgtcagcaccattttttaaaaatgtgctttttaatcatctggtcctaaaatatactccttgtctctttctcacaattagtatctttctagagacatgaactctcttacgtttgcagtttctgtttcctgacacattcaaatgaccttaatggtgggtctctgaggctaagtcaggacacatacttaattgctcacctcacaatccccttcgcttcttcctcagcactgtgttatcaacaatttaccaggacatagatcccctacttcccatttcaccatattgatttttttctctgaataattcgatgtattcaacacttactatataccaggaaatgtgctaagtgctttattaactcttttagtcttcacaacaactctgtgaaatagagcatatcgttatcttctttctataattgaagcgacttgctccaagaggttcatggcacaggaggatgcaatcagccttccaaagaagagccttcatcatcactgtgctgcctctcactctcaggcttttgggttgtttagcaaagcaagattatgaagaactgatagctcctatggtcccaattttatcccaacttctgaatatttggttgttactagagaggactgacagacaaattaggaacataagtatttctatgagtattacatattttatgcaatctattccattctattgtggtctgggaatagtatgttttctataggtttcttattttggggtatttgttttgtacttgttgggaaggaaacaaggaatccaattttcagtggaaatttaatactatattaaaaccagacacaatacaaactcctcaaagcgtaagtcagaatacaagaaacatacctttggtccttcgggccctggaagtcccctctgtccttgatttcctttgctccctttcttgccttcgtcaccctaacaaaataattatgaaaatatagattttcgtatggtattagcaacctcccctaatctagcaaggaccatagcggagccggattctcgactaataccaattttaaagtggtgtgccctgagcacagctcaattgcgcaggattcgtcaatgttcttgaggagatcagatgacttcagattgttcagcctttactatttattcaatatgatttgctatttttcaaaaatctaagttttgtatctttcttttggaacttttgtttgaatttatagttcattttcacccttggtctattaacagatggttctgagacattcacagtttcagaaatgagtactatctatgctttttcatgctgtttttcaatttttctatttcaggtttaaaagatgaaatgagacattttaaaaatcacagccctatttcgtcctcactggggagtctaattctttcccccaaaagagaccaatagttttattggcaggaagatgcttgagcattaacctggggcagagctaggaactgactactagatgttgcccagcagggttgtgtaaaacagtgctctcccaaaagaattcctttaccttcaaaactatctttcaactagggttcaactgcaaggcgccatatccagggatgtacacagctcaacaaacgaaaaaaaaaaaaaaaattcctcgtggtctgcagctgaggctatttaaatatttatactataaattactataccatggtttttaaagttgagcaacagaatcacctggagagcttgttagaccacagattgctgggccctccacccagagtttctgatttagtaggtctgcactgaggtccaaacatttgcatttttaacattcccaggtgatgctgatgctgctggttcagggaccacactttgagaatcattagactatactaaggtcatcagcaaagcaggcactttattaagaagagatgacctcctgtagaatccacagaggtttccatggtccacactaatgtaaagcagtggcaccggtgtaaaaaaaaagagttgaatgtccaaatatcttatatcattatcacttaccagtagagacaaaattcaaccacaactctttattttcttccctccactaccactaatttaggttattgacctaaatcaccccagaaatgaacagcaggaacccaattacatgtaataaatcgccaacactgaaccatggtatacctgggctatgtaacatgttcctaccactcttctccaataggctttcataagccacaagtcacctcaagccacaaattcagtagcctctctttccaatgcacattcttcttgccttattggtggcatctgataccacccattgctttcatcttgaaatcctttctcctcagtatccctaacatgctaccattctgcctattctgtagagttgttgttctccagctacctcacaatgtggggtttaaacctcaactctcttccttagagacattgttcattctcacggcttcaattattaactccaagcgcctattttccaaaaacacatcctaaaaacaattctcctgaatgttagcagatcggcatttctaaaagtatatttcacgtgatgatgttatcccctccacctcacccaaaaaggatccccgagactggtaaatcaataaacaaaaatgtttaaaagcctacaaatatatttaaatttcatgtcctcacatttaagattaaggattcaattttagtgagtatgttcacaagacatcaattactattttagtagaattatgaacagaacactaatatgtatacaaattttatttttacttgacttgtatataatccataacaatctttacatgggaattgataactacacataaaaatagaaagaagcccaggcgcggtggctcacacccataatcccagcactttgggaggctgaggcaggtggatcatgaggtcaggagttccagaccagcctggccaatatggtgaaaccccatctctactaaaaatacaaaaattagctgggtgtggtggcacacacctgtagtcccagctgcttgggaggctgaggcaggaaaatcgcttgaacccgggaggcggaggttgtagtgagccaagatcgtgccactgcactccagcctgtgggacagagtgagactccgtctcaaaaaaaaaaaaaaaattgcaggaagacctggaatcttaggggctataggttatgtcactagttgtcttatcctattgatgaatttgtatagtctcatcttaacatataaaaatgttattcaactagcatttctacagtggttaaaatagatttatgccaagttgtgaagtgaaatggccattcaataaagtgatatttcttattgcatgagattttataaagaaaatttatggactgtcaaatctcaacgatgtatctcaaggcttcttttccttcctatgtgttttttaaatgtcaatctgaccatttattgagaaaacgtgtgtcaaactcttctctatgctgggtcttacaatagacgttaggaaaataaaagtgaatcatatacgcttgctgtcttccaaaagcttccaagacagtattcatacttttaagccagacataaacacattgacatagtaagaataacaatcaaatttcttctaagttggctcctcagtatgaggaccagaacacaggctgcttccaccaacactgtcatttccataccttggggccaggctgtccttttccaggtggtccttctgggcctcttgctcccggaagccccgcttctccctagagaaaatgacactgatgtgttagctgaccctccagtagacagactgtacgtatcatcccaccttgtctccttttatcattagtggattcagctgagactctccaaaacacaccataccttcactctagtctcaaaatcaatttggaagtttataaacttgaaataaagtaacatcaaactccagtttaactcagagcagctgcaatatcatgaaaaagtaatttatcagccaatttccaaagcaataagctcattttcttttggctcttcattcgcatttggtagattttttaaaaaacagggaagaccttcagcctttccatctgctgtttttttttttttttttttttgctacttttactgaaaaatgagtatttcaaatgtcaacacaaaatacttcaggaaatctttacaaaggccttatttcctgtatgcatttacagacttgcctcttagggggaggcggggggagtggctttctcttaagtttaaattaatgtgctttctagaaatcctgaagaaactaggccataaccaaaacaccagacagaaggcagaggatgtgagacactatctcagcctttgaataggccactccttctctcagggagaagtggaaagggacatttgggattgtgagatattttttcttaaagaaactaagtttgtcctgaatggttttattcgagctcctgcaggaccaagatatcagtttggttcaacagttcctactccagtaatacgaaaaacttggtgttaccttcttccctgcagctccatcttctcctggtactcctggttgtcctgggagccctattgagcctggctctccctggtgaatgaacaaatattttatttccctaaagttcatacctccattctgaggtacttgcaattggatgtatcttacagtgtctgagaaaagcctccgagaaatctcattagcaattaatactaaactatttgatcttgggaagctacttaacatccctaggccttagtttttgattctatttttatgggctgaattgtgaccccaaaaagatatgttgacatcctaactctttgtacctgtgaatgtaaccttaattggaaacatggtctttgcagatttaatcaagttaaaatgaagtcattacaggggggccctaattcagtataaaaggtgatataatttggctctgtgtccccacccaaatcttatttgaattgtaattcccagtgttggaggaggggcctggtaggaggtgattgagttatgggggtggacctcccccttgctgttcttataatagagttctcatgatatctggttgtttaaaaatgtgtgtgtagcatgccccacttcactctctctcactctcctgctcctccatgtgaagatgtgcctgcttccccttcaccttttgccaggattgtaagtttcctgaggcctccccaaaagtcaagcagatgccagcatcatgcttcctgtgcagcctgcagaactgtaagtcaattaaacctattttctttataaattacccagtctcaggtagttatttaaagcaatgagagaatggactaatacaacgggtactataagaagaggaaaatgcctcttgaagacagacacacagggagagcaccatgtgataagagaggcaaagactggagtgagcgtctgctaggcaaggcatgccaaggattgacagacaccctgagaagctaagatgagaccaggaagcaatctcccttacaggttttggaagaagcataaccctgcagactgattttggacttctagcctctagaactgagagacaataaatttctgttgtattaaggcactcagttcctagtactttcttacatcagctctagaaaactaatataaaagtgaaataacaaatttgtgccctaacaacacttccagctctaatattcagtaattccacttgctttcgagttaatttacgattagtaataaatcctttaaaatgttcaggaaaaaaatatgctactttcaatcagtttaaagcatctttatggcatttattaatagcaacaaaatggaaaataattgaaagcaacttcaactaacctaaacaagccagtgaaaaaaagcacagtaaatctaacactaagtagatggaatgataaagatgagagaagaaaataataaacttgaaaacaaaaagtaagaagattcataaaacttaatgccttttttttttttttgagatggagtttcgttcttgttgaccaggcttgttcagtggtatgatctcagctcaccgctacctccgcctcccgggttcaagtgattctcctgcctcagcctcctgagtagctgggattacaggcatgtgccaccacacctggctaattttgtattttcagtagagacgggctttctccatgttggtcaggctgttcttgacctcctgacctcaggtgatccgcctgcctcagcctcccaaagtgctgggattacaggtgtgagccaccgtgcctggccagtaatgcctttttaaaaactaataaaagtaaataaatttctaataggaatgatgagaaaaaacctagaataataggttttttaaaagatatcaataaacaatatcaaaaatgaaagacataactatatatatagtaaaaatgttttaagtcatagaaaattggtgataattttttcaaatgtattggaaaacaataataatctttgagaaaaatatgaattatataaatgctgtaaaaagaaatgaacaagctagataaaccaataatattaaataaattgagtcagtgattaaaagtctctactttctctctctccaagatcacaagcttagttggttttacagtcaagacttaccaaacttctaaacttttgaagaacagttattccctatcttatacaaacatttctaaaaaaaatagaaaagagggacgtctacctaatttattttatgaggcttataaagccttttcaaaaacaattatacaatggcaagacaagaaaacaaaattatagaccattctccctatgagacatagcacaatttaagcttccaatcaaatgctttaatttcttccagtgcctgtacaaagtttccaggtcataatgcagggattgagaaaccagggcaagttcaggcatctctctaaggagacaaacatgcatctgggtgaaccaaggtatcaaaagttcacagagtagattaccagaaagagttacacagagaaaactataagtatctgctgagcatccatcttgagtattcagctgaatattgctcagtacatgtgtgtgaagaaactacccaaggccaggaaaacaaccaacttaaaggattagagagaactgacattgaaccaggaatagtgcctatttctactggcaagaaataaaacctcacaattctgagggcataaattggagttctaaaaagggtcttacctcaacagtgggaaaaaattaaccctagactaaatgttgctgtagtcttacctaataaaacttaaaagcaagacccaaatgggtcaatctgttttcaagtaactaaaaaacatccaagaacaaagctcaaaatagaggaatacaaaaatatccaacacaataaaaggtaaaattcacaatgtggggcattcaataaaaaagtattcagcctgtacatgcctgtaatcccaactactcaggaggctaaggcaagaagacagcttgagcccaagaattcaaagcaagcctaggcaacatagcaagaccccatcttttaaaatattaatattaataataatatttaatttaaaaataaaaaataggcgttcaaaaaggctgaaaaatatagcactttgtgttgagaaaaatcaatcgattgaaacttatccagaaataacaccagtagtagaattaggaggtaagaacattaaaacagttattatgactatactccatacagtcaagaaaccagaggaaatttaaagcatgttaaatagacaaatggaagatatatgaaggatacaaattaaaattttagatttgaaaattatgatgtatgagataaaaaacactggacagaattaaaagctgattagtgtcatggaagaaaagattagtgaactaacacatatagcaataaaagctatcctaaattaaacacagagagaaaagagactgaaaaagaatgagcagagcaccagtgaactgtgaaataacctgaaacatccaaatagccaggccaacattactaaagcccatctctactaaaaaatacaaaaattagccaggagtggtggtgccgcctgtaatcccagctacatgggaagctaaggcactaggatctcttgaacccaggaggcaaggctgcagtgagtcaagagcatgccactgcacttcagccttggtgaaagtgagactctatctcaaaacaaaaataaaatccaaagataagtaacactggagttcctgaggtgaggaattgctatttcaagaaatactggccaaatattttccaaatttgatgaaaactataactcatagatctaagaatatcagtgaaccaagaataccaatgaacttcaagcacaagaaacatatctaaggcacattataatcacaccactcagaacccatgatgtacaggaaatctcaaaagcagccagagaaaaaaagacatgttgtgtagagaaacaaatataaggataacaacacatttctcatcagaaacaatgcaagtgagaagacaatagaacaacatcttaaaagtactaaaaggaagaaaaagcaactgcacactataattctataaccagaaaaaataataagcaaagattttttttttggaagttgatttggcaatttcttggaaagctaaatgaatacctaccttctgacctagccatttgacttctaggtgtttacccaagaaaaataaaaacaaatgtccatacaaacacatataaaaatgttcatttataacattttatttatgataaaatttataaaaatttataaaatttatttaaaatttttatttataatattccaaatctggaaaaaaacaaaatttatacacaggtgaatggataaataaattgtggtatatccatataatacaatactattcagcaatacaaaggaatgaactgttcatatatatgctacaacatggatcttagattttgctgcattaaaagaagccagaaaatatcatatagtatataattccataaaaatctagaaaatgcaaactagtctatgatgacaaaaaacagatcaatggttagcagataattggaaagcagatctgtgggaagcctattagtgaacatagaagaagttacagagggatagaaggacagatggtaacttctgagggttacagaaatatttatcatcttgattgcagtaatgattccaagggtatacacatatctcaaaacatcaaattgtatactttaaacatgtgcatttattatatgccaatcagataatacagttattaaaataaaagcaaaaatcctgaataaaagattagtcagttgaatgatcatcataaaaaagtacacataatgaattgagtttatctcaagaatgcaaggatggtttgacatctgaaaactctgtaaatgtaatgtatcgtattaacaagttaaaagtggaaaacaacacaattatcttagtagatgcataatttgataaaatccagtaatcatttatatttaataagtaacttttggtacaaccaaaaaagaaggaagcttccttaacctaatgaagggtatctatcaaaaactttcagcaaacatcacacttaagagtgaaattttagaagcacttcttttgaagtcatttcttttaaacattgtacaagtgatcctagcagtacaaaatgataaaaaaaaaatcaaagaagagctaaaaaataataggcaaaactttatattcagacagtatgattgtgtacatagggactgaaaaagcaagagattccacaaacagatttcacagggtggctggatacaaaatcaacatgccaaaaaacaaaacaaaacaaaacaaaaaaattctcctatagacctatactagttagttaaaagatatagaaaaaaaattcacaattataaaaatttcttcaaggtatctggaaataaatttaactaaaaaaatacaagacctttatggagaaaattacaaatattttcttgaaaaattacagctttactctgtggtgtgaaagacttgctatttaatctgtagatttagtgcaaaccaaatggggtatcctgttaaatatgacaagccaaccctaaaacatgtatcttagagtcaataataaccaagaaagaagatgagagtatttttccttttagatgacaaaatatattataaacctattataatcaagacaaggaggtaatagcactgagagatataaatagacaaatggagtagaatacacagctcaggcactgatactcaaaatatggaagcttcatatatgaaagaggtggtactgcaaatcagtgtggtaaagatggactattcaacaactgattctggggtacttgtttatttatagtaataaaaaatagatccctacattgacccatacacaaaaataaattccatgtgggttaaatccctaaattttaaaaacaaaacactaaaattttcagaaaaatgcataagaatatctttatcaatctcaggtcaagaaatgttttaaaataatattcaaaaatcacaaatcacaaagggatagaaatatagaatttaaaacttctgtatactaagaagtactctaagtgaaaaaaataagtcagagcctaggagaagatatttgcagtttgtataacacagtaagatatatttgtacacacttcatatttgcacagatttagagaaaggaacatcatcgcctactgctagcaggaaggtaaactggcacaagcattttggacaagattttggtagtatcacaattgaagactcgcacgctctatgatcttcccattctacctctaactgtctatcttctacaagtcaagaaacttgtcctccaacgtgtgcaaaaggaaacagaatgtttgtggcagcattgttggcaaaagcaaaaagaatgacaagcaatttaaatatccaccatcatgaagatgaataaatataaaatgagatattttcatacagtggaatactataacgcgattaatatcaatgaattagaggcatacaaaaacacaaataaaacataaggctgactataaatatattgcagaatgatatatcatgtaaagtttaaggacacaaaaaaagtgatatatggtttatggataaaaatgtgtgggaaattataaaaacttcaaaagaatgataaacaccaaattcataataatgattatgtgtgaggagagaagggagggcagtgggattggggagtgccagcagggaccttcagccacacctacaatgtttcttttaaaaagtctagagtcagtgtggtaaaacattaacatttgataaagctgggccgtggaatacataggtgctctttgtattattctctgtatggtgagtatatttgaaatacttctttttttttttttaagatggagtctcacttcgtcgccaggctggagtgcagtggcgcgatctcagctcactgcaacctccgcctcctgagttcaagtggttctcccgcctcagccaccctagtagctgggactacaagcacgcatcaatacgcccagctaatttttgtatttttagtagagacggggtttcaccatgttggccaggatggtctcgatctctcgaccttgtgatccacccgccttggcctcccaaagtgctgggattacaggtgtgagccactacgcccagcagaaatacttcattttttaaagtaagtttaagattgcacgtcataagtagtgaaactgagatttaaacttgggtactctaacggctgagccttactatatcgtatattgcctctctgcaattgacatatatataacataatatgtttgtatacatacatacacagaggcatatattacacatatgtataaacatatgtcaaacttggcacttagtatactgtgtagcacatggaaaccatgtaaaaatggcagctattattactatattaatacttttttatcctttgtaatcatgtttatgtatgtaacatgtatattcttcttagacctacatcttatatattcttctaatactcaaatgctcgtaagaatatgacaacaacagaacaatggtgaagttgagcgctcaactggctctctagatcctatataacttcaggatgacttatcgaaactgtgaagggtaaactaagtattcgttcatttattcagcagtatttattgagaatctatcatgtcccgaaagctggggattctataataaaccaagataaacaaagtgccaccctagtggagtatatattttagagcagcactgtccaagaggaaaataaagcaagccatacgtgtaattatagcttttgcagtagtagtagccgcacttaaaaagtaaaaggagcccattatgtagagttagataacacacacagagtctgtaaggcaattggatataaaggaaaccttatataatgttacataaagtatcatatcacttctgagcagcagtcaactcacctttggaccttgtactccaattcccactggtcctcgagggcctgtaggtcccatttggcctacttctccctagtaagaaaagagtttaatacagcagcaaagtgaaaataatatattcctgctgttgatctcctaaaacctgtcttatatcaacaaagtaaaacagtttcatgtgctcaattcatatatattgcctgaaatcccttcgggggatggatttgcaccagatttggaatatatatgtaaatgaaaaatgtacataatgtttgatgtatatatggtctgacttaaaatataggccacatagcatattcaaaattgattttaaggagccccttgtggagggtatctggaaaagataggcagttgcattctagaacaactaaaattggcacaggaaaagccaaggtaactgctgatcaagagcaatgtcataagcagagaacgcaactcaagctttcaaggcaggccccaaatcaaaactctcaagaatagtcagagtggtccattgagcagcttctcacacggacagctctagggagtgtgttctaaggtgaatagtctcagagaagtattttatttatttaacaatgattcatgattcttagaagcaatattaaggataactagttaaataagtgccatgctcctcctcaaggaaaaaataatagttccaatctatgagatagtttgattcccaagtaaataaaacatttttatttgttaggtcatttctgaccccatctctttagctaaggttttagtagttgcacctactgtcagagtggtggtgagaatgaaaattagccaacctagagagacacataaccactggttgcctctattaatattactgtttgagttggtagaataggatctcataaataaaagtaacaaagaaaacaacaaatgaaaattgtgtaaataaagctttcttaaagcataaagaatacatattacattttctaaattgtcaggaatatcagtaacattttgcattaagtagagatctctgatttttaagttcattctacctgctgtcttcccttgcactggcactgatcagaaaacagcaattatactatagatatattaaactccgctctcatttacaaagttaccttggaaccaggtaagccctgtcctgcgggcccttgtggaccaggtggaccaataggaccttggattccctttaaaataaaattttataaaatagtgttagtgaaatgaagtagtttcaaatcctctaaagtgaaactttagttcataccccataataagttacttacactcaataagcatttgtggagtggggtgccaggggctgctagttaaaccacaatttgcattcttccctatttccatattaatagaaattttagctggcccgtatatctgcctagaataaagaccacgtttctcagtccctgttgcagccaggcgtggccatgtgggctagattctagccaatgggataggaatgaagtgatgtgtgtaactcctggttcatgctaaaagaagaggtatgccttctccttcccttttcctcttcttcagtagctggaattaagagagggtggccatccaggatcatgcagatgaggaaagcaccctcagtatggcagactatcaagaccgattaatagaggcagtagtcagttgattaacagaagcaatagtcagtagataccaaactgaagaaggttcaaacacttgactccctccttcacaatataaaggaggtttttatacatgggtataaaaaaggatatgcacatatgtgtacatttgtatatgtggttgtttatttttcactctatttgtaaaagatctgagttgatcaagcctccaaatatttaacaaaaatctgtgggccatttaagagagattgtaaacatgttgctggaaacagaagttccctcataaacacatgagggaaaacattcatttttatgagagaaataggaagatctaacataacaagaattcaatggataaacacatcaaattaaagaacattgaataactgcatagacagaggttaaatttaagtagaatttatatcatttgtcttaaaaggtaaataaattcttttcttgctcagatcattttacaaatagagatctcatttccaatagagatcagctctgtaaggacacatctacctcgaaatttttttttctttacaaaaagaagaaaagggggtaagaaaatgaaagaagtccgagacttttgttttgttttttttcccaagctgaagaacaacaacctccaccaaggaacagcattaaaggcgacaggaagctgtaggtaggaggtccagaattcacaggccatctgaacagacttgtcttcgaacctcatatttagccccatagtggtcactcagcaccaggagcactgcaagacccaagatgtgacaacactgtccggccacttttgggataagtaagcccctgctaaaaccaacaaataaactaaaaggcttgagaatgtcggctggtataatcaaatgatgatatttgagtagcccaaatgtccagctcttaattattatctaaatatttatttatacatttatcttggcttcttctgtaccttaagattcctaatgtgttagactaggacctctgccaatggcaagggaatggaaaaaggagtcatatccaactttgctgttgtttggactagcaagaaaagtaataataataataaattagcagccaattagaaataaacccaaagtaaatctcaacaatgacaccggaattatctcattttttaaattcttcccttctcccactaccctagatacagaaactagatacagaaagcactattcattctttaagcaatagaataattcaaaccttactcataaatcttaatcaaacctgacctgccactttctaaccaggagatatttagcataaaactgaatttgtgggttgctttgattaataaggctgcgtaagtatatggcaaacaacaaagtatatggtaaacaaaagactacatggtaaacaacagtagagagtactgttatactatcttcacattatttagatttatcacaatacccagattttccaaaagttatcagaagattttggaaatggttctaatcacgaatgtagacattcttacagatctttcttttcttctcaccaagaggggccaggtgtcatttataaattatatctgtgttttgcttctattccagaagtttgccccttaaactaagtggttatctctgatcctggtccaagttttaactataatacttttttaaaaaatggatatgtggctagttagagtggttggtagggggataccactctactccattgggagagagtgggatttaattttcacaaagcttcaaggagaaaaaaatacacaaaccagcaggtgagtaaactattgttcccaaggggaactaaaaatattgcaccaaaacatttaccttgttaattaggttttaatgttaaaagtcacagcatcaagaaacacactacttattttttaagcctttggaagttctaaaaaataaaatcttctcatgaaaccatcttatccttccctatattcacttctggacttatactccactgcaattaactgtcaaatatactcatagatgtttgcaggactggccttcaatgaagaccaggattgggctggaatgttctgcactgaagggaaaggaagaatgcattaattacctgttccccttgactcccgattccagggatacccattggtccttggggtcccacaggtcctatatccccctgcacagaaaataagccaggaaatataacaataaaataaaatcttattatttcatactttgctaacctggaattgggctgtgttaaaatctatctttatactataaaaaaaattcaacatggaaaattataaaactttattttattcctttaaaagtttataattcaaattccccaaaatagtaaatgacatttttgctattcagtctaagttggtgagcatttgtataggcttatatttatcaatcattttctcacaaacaaaatttcctgaatagttgttatgacacaaacatttcctgctaagattgtaacagaaatatttaaaagtagaaaattcataggatataataaaaatagaatgagagataaattgaagaaaaatatttttaaattttctaaataccctttccctccaaatcttattgaaaatgcattttgaaaatgaagaaatgatctcaagtgaatgcagcaaaattaaacagccctattttcttcttccatgaaattgagaaaacaaaattaaagttaccagcaagaagaacataattcattctttctgtgtctttatacaggtgtttgttgagtgcccattataagccagaaagtgttccaaacactaggaaaacaacagtgaccaaaacagctcaaaatctctgtcctccattgagcttagattttagtaggggaaacaagatggtaaacaagacaggtagataaaataactagtatgttgaataataagtgtgaaggagaaaaattaatcagggaagagaagaggcagcgatgattttggttaagatgtccagagatgaagtcactgacgagagggaatgagccaggtagaaacccagaagaaaagcattccatgcagagaaacagccaaaacaaagatgatgcctgacatgttccagaaacagcaaggagacagtgcgggtggaaccatctccatgagggagagcggtagacaatgaagtcagagaattatggcagtggagtcaggtagaaggatcagtggggcctttgaggccactgtaaggacttggctatcctctgagtaagttaggaagccactggagggttttgagaagggaagtgagagatctgacttggtttttaaggccccatctggaagctgtatggagaacagactgaagggggtctgcatgagagatgatggggcacaaaccagaatgttgagagtggaggtggtggggagtgctcaaaacctggataatgttgaaggtagagtgatgggatttgctgaggactgaaaggactcttggcagaatagagttgtcattgactgagaagaaaaagcctgagagaaaagcaaggtttgaggtggagggtgatatcaggagttcagttttggacatgtttagtttgagatccctaaaatgaacatccaaatggagatatcaagtaggtgggagaggcctgggatgagaacataaatttgggagccctcagtatataaatgatattaaaggccataattgagtgaatttgccaagtaatagaaaaaagagatggtcccaggactgagccctttaagcactccaatcattagaggtcagagagatgaagaagtcacagcagtggagactgagaaggaagcagccagagagaccaagtgaagagagtgtttcaagaaggtgagggatccatctgtcaaatgctaccaacagggcaaattagttgatgacagagaattgaccgctggattgagtaacatggttaacatgctcattttaatggcagttgtatttagactacattagggccgcaaaacttttaaacagttggatagcagatactttgggcttgagggtcataatgatgtctctcgtaattgatcaatgctgctttggtagtacaaaagtagccatagataatatatagtgaacaagtatacctgtggtctcataacattttatttgtaaaaacaggcagccagctcaacagttggccaatgtttgagctaaataaatatgtttttatgaagaaaaatgtatcatttgctgggcgccgtggctcacgcctataatcccagcactttgggaggcagaggtgggcggatcccctgagatcgggagttcgagaccagcctgaccaacatggagaaaccccatttctactaaaaatacaaaattagctgggcatggtggcacatgcctgtaatcccagctactcaggaggctaaggcaggagaatcatttgaaccggggaggtgaatggtgcagtgagctgagatggtgccattgcactccagcctggacaacaagagtgaaactcttgtctcaaaaaaaaacaaaacaaaaaacaaacaaacaaaaaaaacaaacaaaaagaaaagaaaaatgtatcattagatcaaactttatataacattaaatatatagaacctgcactaggagatgccctggaatacactacttagtgctctatcaacctttgatctacataaatattacggaaggaaaacataatggaatccagttctggctcagagctggactattttgattcagaacttgatttcttatgcatcagatattgtgcttaatgctttacatcctttcatttatcctcacaacaacccctgtaaagtggccatccccatttttcagatgagtgtaagtaactcaccccaggtcacgcaactgttagacggcagaggtgacagtcaagtccaactcatagccactagccaaaacccaactcatagccactagtttgcaaatatttgttaaacacataagagagggtccctttttgtgcagtgttattgacatttaaatacctgtgccataagtacaactttgttttgtaccatttacatacatttgagaggccttatcagaggcgtgtttatattatcacttgaatcacaaacatcaagccctctgaatctagtgttatatgtaaaagaacaggaaaggaagaaaggaaaaagaagatggtattgagggaacagcagataaaagctttgctatgtaataatatcctgatacttcagagtgatttctttgcatgacctccaaatgtaaaaataacatgcaccatgtcccaacaccacctgaaaaagttaatttactgaactcataaaacaatggttctgttgtattcagttctcgctgctccaaaggaagaaagagcaactcatgtattttttggagtattttggagttgctgtacagccagagctaagagattgaacaaagaattgtattgcatctaaaattcctatcactcactatttatttctgctatttaaatacaaacagctagaagagataactaccagcaaataaaaataagtcattcaagattgaaacccagcacttgagataatcatgaatatcaattgttatcctaatataatatacaatataattatctgcttaaaggctgatatataaatgactccaaattgatatgagttctctgcttttttatacatttcttatatccttccccctctggcagcttcacttccaatgctctttatggctgtatcagcctctagtagctcctatcaccagctccattcccatttctaatctggtataatctgcagctgttttaaagaaaacaaatagccagtgagaaagagaaaagcaatccctaacaacgaggagctgacctgaccctggcaagtaggccgtggtgtcaaacatgaacaatttgacaaatcatcaagatcaaacaaggccaccccatgactgtgatggaccaagatgaaagccagactactccataattatatctgagcacagacaaaaacagcaaacactatataaaaccctcaaattatcaaacatcctccaatactggctaaaatgagtgactgctacttctatcagttatgactcagcctaactccatttgtcccaacttctagatgagattcattaaatactcaatcctaaacttatccccaactattgacaacattaaatccagagcccatccctgatttcttaaatgcttcccaaaatcacctaacacaagtgcaaatcctatgaaatatctttcatcctcttcctgagtcactgtaggttcatcgtatgtggtcttccttccttcagagtcaacaagccttgctaaaactctggatggattcctgttggtccttgctggagggcatcaacactagttttcttaaatgagttttctgattttaacctgattttaagataatatttttgagtgggagcctagggatggatatacacttctataagaaggtcaagtcaatgttttttgttgtttttttttttagagatggagtcttgctctgtcacccaggctggagtgcagtggtgcaatcttggctcactgcaagctccgcctcctgggttcacccaccattctcctgcctcagcctcccgagtagctgggactacaggcgcctgccaccacgcccggctaatttttgtattgttagtagagacaaggtttcaccgtgttagccaggatggtctcgatctcctgacctcgtgatccgcccgcctcagcctcccaaagtgctgggattacaggcgtaagccactgcgcccggccaagtcaatgtttttaacaactgttttctttactaagaagaaatgtctttcgataatgtctggattcaaagctgctttgctgatggtagaagtcactggatgtcagaacccaaataagtgagacattacaataaatagaaataacctaatttctcagatcataactcatcctacataataacacaccttgcatatactagatttggagatcatcgtggacaggaggcaggactagatcgcagctcccactcggatggaaagaacagcatgtggaggctagcactgtgaacctttgctctagaacgactgcaggaatacatttggaaagccaagaaaacccacggacttgctgaagggaatggattgctcctgcaggacctgggagacatcccaaatattgtgagtgcccaaactatagaaatgggaaagggagattgtccgcccctgaacacatacccccactggggaacctgaaggtctagattatgggagctgagtcaatttagagagccaagcgaaatacaggagtagagaaagcagcaggaaaatccctgtgggctcagtgggttccctagcaagccatctctgcctcacatcactggggtccttgaggatggctgccagaggcactgggaaaagcccacagggggaaggaaacctccaactgaattctgtaataatttcaacagattgagaagtctcctggccagaactcaggaaagggcgtgaatccagtgtgcagactccacagacaggggaagaaggaaagctctactgactttcctagctgggaggtgggaagcctggggcaacctctcagccctactcacccactgcctggaaacagactcagtgttgttgggagggcacggtgggagtcagaccagcccttcagtttgcactggagctaggttaggactatgactgctggctttcccccacttccctgacaacctgtatggcacagcagaggcagccattatcctcctaggtatacaattccattgatctgggaacctctcccttacccccacagcagccacagcaagacccacccaagtagaagtagagtctgagctcagaaacacctagccttgctcccgcctaatggtccttccctatccaccctggtaactgaagacaaagggcatatactcatgggagttataaggccctgtccaccacctgttccttcccatactaccacaactgatgctctcttgaaaacaccacctcccaggaggaggccaaccggcacaaaaatactgtactaaccaaccaaagctaaggaccctcacagagtccatttcacccactggagcaggcgctggtatccatggctgagggacccacagacggttcacatcataggactctgtgcaaacagcccccagtaccagcctggagcccggtagacttgctggatggctagatccagaagagagataacaatcactacagcttagctgtcaggaagccacatccctagaaaaaggatgagactactaaatcaaggaaacaccccatgggacaaaaggaatttaatgacagccttgagccctggaacttccctctgacagggcctacccaaatgagaaggaaacagaaaaccaactctggtaatatgacgaaacaaggttgtttaacacccccaaaaaattacactagctcaccagcaatagatccaaacaagaagacatccttgatctacctgaaaaagaattcagaaggtgagttattaagctaatcaggaaggcaccagagaaaggtgaagcccaatgtaaggaaatttaaaaaatgatacaagaagtgaagggagaaatattcaatgaaatagatagcataaataaaaacaatcaaaacttcaggaaacatggacacacttacagaaatgcaggctgagcacggtggctcacacctgtaatcccaacactttgggaggccgaggcagatggactacctgaggtcaggagttcacgaccagcctgaccaacatagagaaaccccgtctctactaaaaatacaaaaattagccgggcgtggtggcacatgcctgtaatcccagctactggggatgctgtggcaggataatcacttgaacccgggaggcagaagttgtggtgagagctaagatcacgccattgcactccagcctgggcaacaagagcaaaactccatctcaaaaaaaaaaaaaagaaaaaagaaagaaatgcaaaatgctctggaagctctcagtaatacaatttaacaagcaaaaggaagaccttcagagctcaaagacaaggttttttaattaatccaaacaaaaaagaataagaaaatatgaacaaagcctccaagaaatctgggattatgttaaatggccaaacctaagaataattggtgttcctgaggaagaagagaaatctaaaagtttgaaaaatatatttggaggaataatcgaggaaaacttccccacccctgctagagaactagatatcaaaatacaagaagctcaaagaacacctgggagattcatcgcaaaaaagatcatcacccaggaacactgtcatcaggttatctgaagttaagaagaaggaaagaatcttaacagctgtgaggcaaaaacacctcactaatgtttaattgtaattctttaataacatattatatcgagcactaaatggaacttttaagttttataaagagtatctacaaaaaccctagagcagaagtaataataatgaactgttgaaatctttcctgtataggtaacctataaaggaaaacctatcagattaacagcagatttctcagcagaaactctacaagctagaagggattggggtcctatcatcagcctcctcaaacaaaacaattatcagctaagaagtttgtttccactgaaactaagcttcataaatgaaggaaagatacagtctttttcagacaaacaaatgctgagagaatttgccactaccaacccagcactacaagaactgccaaaaggagctctaaatcttgaaagaaatcctggaaacacatcaaaacagaaactctttaaatcataaatttcacaggacctataaaacaaaaatataataaaaaaggtatataggcaaaaaatagcacagtgaatggtacctcacatctcaatactaacattgaatgtaaatggcctaaatggttcacttaaaatacatagaattgcagaatggataagaattcaccaaccaatctgctgccttcaagagactcacctaacacataaggactcacttaaacttaaggtaagctgatggaaaatgacatttcatgcaaatggacaccaaaagcaaccaggggtagccattcttatatcagacaaaacaaactttaaagcaacaacagtttaaaaagataaagaaggtcattatataatgataaaaggccttgtccaacaggaaaacatcacagtcctaaatatatatgcacccaacactggagctccctaatttataaaacaattactaatatacctaagaaatgagacagacagcaacacaataatagtggggcacttcaatactgcactgacagcactagacaggtcatcgagacagaacgtcaacaaagaaataatggatttaaactataccctggaacaaacggacttaacagatacttacagaacattctacccaacaaccacaaaatatacattctattcaacagtgcatggtaccttctccaagataaaacatatcacaggcaacaaaacaagcctcaataagttcaagaaaagtgaaattataccaagcagtctttcagaccacagtggaataaaactggaaatcaactccaaaatgaaccttcaaagccatgcaaatacatggaaattaaataacctgctcctgaaagatcactgggtcaaaaatgaaatcaagatggaaatttaaaaattcttcaaactgaatgacaatagtgacacaacctatgaaaacctctgggatactgcaaaggcagtgctaagaggaaagttcatagccctaaacacctatatcaaaaagtctgaaagagcacaaacaaacaatttaaggtcacacctcaaggaactagagaaacaagaacaaaccaaacccaaactcagcagaaaggaaataagcaagatcagagcagaactgaatgaaattgaaaattagataaatgaaacaaaaactggttctttgaaaagataaattgatagaccatcagcaagattaaccaagaaaagaagggagaaaatccaaataagttcaattagaaacgaaacaggagatttacaactggcaccaaaaatctaaaagaaatccaagcagaaatccaaaagatcattcaaggctactatgaacacctttatgcgcataaactagaaagcctagaggagatgaataaattcttgaaaagatacaaccgggggaggagccaagatggccgaataggaacagctccggtctacagctcccagcgtgagcgacgcagaagacgggtgatttctgcatttccatctgaggtaccgggttcatcccactagggagtgccagacagtgggcgccggccagtgtgtgtgcgcaccgtgcgcgagccgaagcagggcgagcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccccacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgagaagctcgaactgggtggagcccactacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgactttgaagagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggttatcagcaatggaagatgaaatgaatgaaatgaagagagaagggaagtttagagaaaaaagaataaaaagaaatgagcaaagcctccaagaaatatgggactatgtgaaaagaccaaatctacgtctgattggtgtacctgaaagtgatgtggagaatggaaccaacttggaaaacactctgcaggatattatccaggagaacttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaaaaatctcactcaaagccgctcaactacatggaaactgaacaacctgctccggaatgactactgggtacataacgaaatgaaggcagaaataaagatgttctttgaaaccaacgagaacaaagacacaacattccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttagcaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgccgaaggtaatttacagattcaatgccatccccatcaagctaccaatgactttcttcacagaattggaaaaaactactttaaagttcatatggaaccaaaaaagagcccgcattgccaagtcaatcccaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggaatctaattaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactgtattaagaaaatgtggcacatatacaccatggaatactatgcagccataaaaaatgatgagttcatatcctttgtagggacatggatgaaattggaaaccatcattctcagtaaactatcgtaagaacaaaaaaccaaacaccgcatattctcactcataggtgggaattgaacaatgagatcacgtggacacaggaaggggaatatcacactctggggactgtggtggggtcgggggaggggggagggatagcactgggagatatacctaatgctagatgacgagttagtgggtgcagcgcaccagcatggcacatgtatacatatgtaactaacctgcacaatgtgcacatgtaccctaaaacttagagtataataaaaaaaaataattaaaaaaaaaaaaaaaaaaagaaaagatacaaccttcctagcttaaatcaggaagaattagatactcttaacagaccaataacaagcagtaagactgaaatggtaattttaaaattaccaacaaaaaatgtccaggactagacggattcacaacaaaattctaccagacattcaaagaattatcaatcctattgacactattccacaagatagagaaaaagggaaccctccctgaatcattctatgaagccagtatcatcctaataccaaaaccaggaaaggacataaccaaaagagaaaactacagaccaatatccctcatgaacatatatgctaaaatccttaacaaaatactagctaactgaatccaacaacgtatcaaaaagataatccaccatgatcaaatgggtttcataacagggatgcagggatgggtttaacatacgcaagtcaataaatgtgatacaccacatgaacagaataaaacaggctgggcatggtggctcacacctgtaatcccagcactttgggaggtcaaggcaggcagatcacttgaggtcagaagtttgagaccagcctggtcaacatgatgaaaccccatctctactaaaaacataaaaattagctggatgtggtggcgggcacctgcaatcccagctactcaggaggctgaggcaggagaattgcttcaacctgggaggtggaggttgcagtgaactgagatggcaccactgcactctggcctgggcaacaaagtgagaccctgcctcaaaaaaacaaaacaagaaacaaaaatcacatgatgatctcaatagatgcagaaagagcatttgacaaaatccagcatccctttatgattaaagctctcagcaaaattggcatacaaggagcatacctcaaggtaataacaaccatctatgacaaacccatagccaacataatactgaatggagaaaagctgaaagcattccctctgagaactggaacaagacaaggatgcccactctcaccacccctctgacacatagtactggaagtcctagccagagcaatcagataagagaaagaaataaagaacatccaaatcaataaatagaaagtcaaagtgcctgtttgctgatgatatgattgtttacctagaaaaccctaaagactcctccagaaagctcctagaattgataaaagaattcaacaaagtttccagatacaaaattaatatacacaaatcagtagctcttctatacaccaacagcaaacaagccgagaatcaaatcaagaactcaaccctttttacaatagctgcaaaaaaaaaaataaaatacttaggaatatacctaaccaaggaggcgaaggacctctacagggaaaactacaaaacactgctgaaagaaatcatagatgacacaaacaaatgcaaacacatcccatgctcatggataggtagaatcaatattgtgacaatgaccatactgccaaaagccatacacaaattcattgaaattcccatcagaataccatcatcattcttcacagaattagacaaaaacaattctgaaattcatatgcaaccaaaaaagagcccacatagccaaagcaagactaagcaaaaagaacaaatctggaggcatcaattacctgatttcaaactacactataaggccatagttaccaaaacagcatggtactggtataaaataggcacatagaccagtggaacagaataaagaacccagaaataaaccatcatacttacagccaactgatctttgacaaagcaaacaagaacatatagtggggaaaggacaccctattcaactggaataattcagctggaataattggcaagccatatgtagaagaataaaaccggatcctcatctctcaccttatacaaaatcagctcaagatggatcaagaacttaaatctaaaacctgaaactataaaaattctagaagataacattgaaaaaactcttctagacattggtttaggcaaggatttcatgatgaagcatccaaaagcaaatgcaataaaaacaaagataaatagctgggacttaattaaactaaaaagctttttcacagcaaaaggcacagcaaaaggaacggttagcagagtaaacagacaacccacagaatgggagaaaatcttcacaatctatacacctgacaaaggactaatatccagaatcttcaatgaactcaaacaaattatcaagaaaaaaacaaataatcccatcaaaaagtgggctaaggacatgaatacacaattctcgagaagatatacaaatggccaacaaacatgaaaaaatgctcaacatcactaacgatcagagaaatgcaaatcaaaaccacaatgtgataccaccttactcctgcaagaatggccataatcaagaaatcaaaaaataatagatgttggcacggatgcagtgaacagggaacacttctgccttgctggtgggaatgtaaactagtacaaccagtatggaaaacagtgtggagattccttacagaattaaaagtataactatcatttgatccagcaatcccactactgggtatctacccagaggaaaagtcgtcattatacgaaaaagatacttgcacatacctgtttatagcagcacaatttgcaaatgcaaaaacatggaaccaacccaaatgcccatcaatcaatgagtggataaagaaactatgatatatatattacagtgtgtgtgtttgtttatatatatagtgtgtgtttatatatagtgtgtgtttgtttacatatatagtgtgtgtgtttgtttatatatatgatggaatatatatactgtatactatatatacagtatatatagtgtgtatatagtgtatatatagtataacatatattatagtgtgtttttatatatatgatggaatactatatatatactatatactctatatatatatggaatatatatatatatatatgtgatggaatactactcagtcataaaaaggaatgaattaatggcatttgcagtgacctgaatgagattggagactatcattctaagtgaagtaactcagaaatagaaaacaaaacattgtatgttctcactcatatgtgggagctaagttatgaggacgcaaaggcataagaaagacacagaggactttgaggactcggggcaaaagggtgggaagagggtgagggataaaagaccacaaattgggttcagtgtatactgcttgggtgatgggtgcaccaaaatctcacaaatcaccactaaagaacttactcatgtaacctatcaccacctgttcccaaataacctgtggaaataaaataattattttaaaaaaagaatatactagatttataattaaccagatacctgtgtggcatggttgtcatgtatacagttcagaaatgtacatacataaagaacaatgacaattttattggcattgtttccagtgtacaccctattatacagtaccttctcccctttgattgacaggccttgtaatccctgtgggccagttggtccttcagaacctttttcaccctgaaagtacaagggagggatatcaatgcaccaaccaaaatctgaattttaaaagagtttacattacaaatactatgaattgtgcttcaaaattattttttaaataaagcatccaaagtcactgtttactacaaatgggtaattctaattgactctgagatttgcaacttgcaaaaaatacattagtcataacacttaaacaagaaggaagctatccaagcaaaacacatatgtagcatccctgaagttagaaaagagctcagttcccaatttaaacaaaaatattctggaaatggatcacctaatcaatcacatagtataactaactggatcaagtctccttttccttaatattgctgaaactgggtccatcacacaaggaaaatttatttctcgtactaatatgtgaactaatacttgctaggattagattattacctttttttttgtttataaacattcattgaaaatttatgtttaaaagaattcatggaaaatcttcttagatatgctcctacagttacatgacgtaagtgaacagctctgtccttaatataacgtatattgtcataatacttcatgcatttttatgaaaaataaaccatataataaatcagaagcagcattcatttaataaatttattagaaccaagagtaaaatcaaagaacatttacaaattagccccaaatagtacatacagagaacacccattggtctgactagttggggaatgaaatattctgattctgggttcttctgatcattaccacagaatataactgcatatacttgatcctaaagcagcacggaacacgatgtgttctttctttgatgagatagaggtcaatgcccatgagctattacatacaagagtatcaataaagtatgataatacctcatataatataaaagtatgttgaacctgtcactatgaaataccctggaatattcttcttaatgtttcacatattcatttctcatttatttctttctctttaaaaaacacagattttaaagagaaataattctatttgaatttttcagattatttgggctacacataaatagaagtagaaatttactaagtgccaaaaaaatctcaaactgtgtattacaaaactttcggtgatgtcatgccaagttgctgacctgtcttctgatagtgatactgtgattagtcaaaggtgttagtaatatccctttatccaacatattatttccattatcatgacaaattaaaatgtgttcattaacaagggcgtcttttaaaatttaacccagcagtcactcaaaactaaggatgaattatttgtttttatctaattgttttccctctagtagagatttaggattctcatagataattgaatatcgatcatggtggaagaagctgagaatgaaatgcacttttagagcatgaggccatactgagaaggccatatcttagtcacctgatggaatgactgatgtggagggtctcagacacttagaaagcagcatgtacttctccgggcagtatgtgtgtatatgcatgtgtgtgttttttggggagactttggaaataaaggaagaaggactccaaaatgtatctttacgtactctgaaatgttgttgatgctgctcattttggaaaacactttttaacatgcccttcagcaaatgtgccaaagattatatacaaactgcctatatcaggggacagcaaactacagcccataagccaaattcagcccactgcctgtttttatattataaatatagttttattggaacagccacattccttcatttatacattgtttatggctgctttcaagctacatcagcagttaagtagttacagcagataccatatggctcacaaagcctaaaatatttgctatctgcccctttacagaaaaagtttgccaacctttggtgcagaacaacttgagctccaagaattacataagggaaatgacaggaaattctcaatggctagttaaaaaggaagtctttcataacattttgtttctgtagtaaaattttctttcttattatattgatggcagtactattacagattggtttcttatctgtgtttcacgaaaaaagctgtgagcaaagaattgccatagctacactcgatgatttaacttctgggcataaggatgttatttatcactgtggctttaaatgactacaaactactttaagagatttttctaatttcatatgtagtaattacatgaagtagaagtctttcaattacttatttgtagttccaaattttactgtattttcgcattacagggaaatttacatattccttcattaaatggaataaagatggtcagaaaaataattaacttctaaaaattggctaggacacatttttaaaatttgtaattcacgagcatgtaagacaaagcaccttttcctggtacagaaggtattgttacctttggtcctggaaatccttctccgggtaagcccctctctcctggtactccctcaggaccacggggaccctggttaggataggagaaaatgaggagcaggaggagagagaaaagggaaagaggagtgatgaaaaagaggaaagaggaagaaagagaatggttatatttcagtttacatgccaaaaaaaaatggatagttggatctgtactaaacatgtacaggctttttctactttattagttcctaaatactatagcataataactatttacacagcatttacattgtattaggtattgtaactaatctagagatgattcaaagtataccagatgtgcataggttatacgcaaatactatgccattgtgtctggaattggtgggttcttggtctcactgacttcaagaatgaagccgcggaccctcgcggtgagtgtcacagttctaaaaggcagcgcgtccagagtttgttccttctgatgttcagttgtgttcccagtttcttctttctggtgggttagtggtctcgctggcttcaggagtgaagctgcagaccttcgcagtgaatgttacagctcatataggcagtgtggacccaaacagttaacagcagtaagatatacagcaaacagcaaaagaacaaagcttccacggtatggaaacggaccccagcaggttgcctctgctggctagggcagcctgcttttattctattatctggccccacccacttcctgctgattggtccattttacagagagccgattggtctgttttgcagagagctgattggtccgttttgacagggtgctgattggtgcgtttacaatccctgagctagacaccaaagttcttcacctcccagctagattagctagatacagagtgtcgattggtatatttacaaaccctgagctagacagagtgctgattggcgcatttacaaaccctgagctagacacagagtgccgattggtgcattcacaatcccttagctagacataaagattctccaagtctccaccacattaactagatacagagtgccgactggtgcattcacaaaccctgagctagacacagagtgctgattggtgtgtttacaaaccttgagctagatacagagtgctgattggtgtattcaaaatcccttagctagacataaagatgctccaagtccccaccagattaactagatacagagtgctgattggtgcattcacaaaccctgagctagacacagggtgctgattggtgtgtttacaaaccttgagctagatacagagtgctgattggtgtatttacaatcccttagccggacataaaggttctccaagtccccactagacccaggagcctagctggcttcacccagtggatctcgcatgggctcgcaggtggagctgcctgccagtcccaggccctgcgcccacactcctcagcccttgggcagttgatggcaccaggcgctgtggagcaggggccgtgctccttggggaggctcaggccacacaggagcccacggcgggttggggagactcaggcatggcagtctgcaggtcccaagccctgccccgcggagaggcagctaaggccaagtgagaaatcgagcgcactgccggtgggccagcactgctgggggacccagtgcaccctccgcagctgctggcgcgggtgctaagcctctcactgcccggggcggcagggccagtcggctgctccaagtgcggggcccgccaagcccatgcccacccggaattctagctggcctgcaagcgccaggcagccctggttccacccgtgcctctccctccacacctccccgcaggctgagggagccggctcagccctcggccatcccaggaaggggctcccacagtgcagcggtgggctgaagggctcctcaagcatggccagagtgggcaccgaggctgaggaggcgccaagagcaagtgagggctgcgagggctgccagcacgctgtcacctctcaccattttatacaagggacttgagcatctgtggattttggtgtctacagaggtccttaaaccaatcccccatgaataccaaggaatggctaatgactgtggctctgtttaaatttttagtgagaatccttctagtcaactcaatactgatcagtagaattgtagagctacgaagaataatactcccattgtattaaatactcgttccatttgattggcataaaatgttctattccactgttctcaaagtagaagaaaatggaaattaaatgatgctttgaaataagaattaagaaataaattatctgaggaaatgctaaaaatctggaactgtgtggcccagagaaggatgcagagtgatttaataatttaattatcaggggagtgctgtgaagaaatcatcacacagctgttttaaagcattaagtgctgtttacatgtgtttcaatttctgtactgataaatttggattaaaacttgaattatttcaggaactggttgaacccacaggcagttttatatgcaaattgaaatcttgataggatcattaaggggaaacatgattttcaattgcaatgattcaaattaagaagttcatgtaactattgctcaaaaagccactaggaaagatgacttctcacatgagttaagaaaaacacagtctcgggctttgaaatggacttgcagaaaatgtactaatggaaaaataaaagagtaatagtgaggttttcatttaaatcaggaatttttaaagacaataatttttctctccttttcttcttggccagaaggtaaaaaagtagtaaaggaacttacaacaagaatcttagaagaagaaaatgaagcttttcctctgatgaatctaaacaaataattaggcttcacttgccagagaaataaacctatgatggaacaaagtctgccaactttcctgcaagttcctaaaccagcacactacagacactgaatgatgtttgggcttgagatacagtaatccagggtgatttaagacgcttttctcctcaagcccagtagcagaacgaggatgcagcattatactcatcagtgactgatcatagttatagattcataagaaaaagatctgtttttcagtgtttaatttttttgtctttccctaatgttttatattttacaagacaatcttctttagtatttatgcatactgattttgtaaataattaaaagaaaaagctaacatctttttcaatttaaattgtaacacttaacagaaacctagcttttaacacttccaagaccttaatgaaagcactaatatccatgacagtttattgtacgggcagagcaattagctagtaggaaaataaataggagcatgaaaattattaatagattgcaaactcaaccaaattattaatagattgcaaactaaaccaaaagtgccaagccaacatcacatactttaacaaagaaaacacatactttaacaaagaaaacactgacaaattattttttccctaataatatgacaaatgaaaaaaaacacaatttatattaaatgtaaggaagtatttttccagttcactcaacttttttcattcatccaacaaagatataccaaacttctagcaggtaaacggcattgtgctaggttctagggatagcagacaaaactgctccctgtctcatggagctgacaatattgcataatagttaaaagcagattttggtgtcatttgtactgaggttcaagccccagctctgctacatagtagcagtttcaccttaaacaagtaagtcaatctctgcaaagcacaacatcctcctcaaaatggttgataataatagtatctacctcaaccacaagtgttcatgtaaggattaagtcagagagatttaaatcttttacagattaagcactcaataaatatctgccatcattatccaaattattttacttgagtcctgtaattgctaagaatgtcctttcatggaagtttttacaaataaaagcagtctctgagtgaatgatttaaattaaacaatgtgtaaaaagcatgctgcactgaataaacactgaatcttccttcattctctgcacttctagagtacgttagctaaactggaggtgaaaatattggatctttaaggagccaagtattcaaagctgctgagaacggagagttaatgctcatggacagtcttttaggagaaaaaagcagtgatccaaagtgtaattactataaaccatcagagtagtattccacgccatcagtatattctcaagtcttccagttaaacactcagcatggacgatgatcattagccagagaagagaagtagaaggtacttgggttaaatggttatagtttaatttattaagatagtaccaaaagattatttttaaaagacagaaatccttctattaaaaaatctcagtgtcctttctaaggccatgagaaccaattacaactacgacatacttacttggcttctaacgaacacctctaataaaaaataaataatgaaggaatctaattatcagttaacacagcctgatcagtgaaatgctttatctgagacattaacgatgagatgaaatacgattgtccattatgttcatcttattactttccgtagtaatctcaatagtgttaataatcaatacaaatgctttcaatatgcattgcaagcattagagataaatatgctaataataatagtaactgtccattatcttcaaacagtgccatctactttattttttaatctcaaaataattatagttccctttcagggttttttttttaatttacagtgctctgaataaccttgcataaaaaacaaacagatcaccctgacagtcttaaccaatttaatttttatgaatcagttacatctaccagaccagcacaaaactagtggtaatcacataaagatgacagatgacagttcaaaagtaggtctcggagctagaatattaattcaatctatcagcagatttatattagtgtggtagtgaaaagagagtagtactaaatacgaaacacttgaaataattcaggcaaagaaacaaaagcaaaggactttcagtagaatctttgtcagccctaagataagtctttaccttacttctaaataattcaaaaattcacattgttggctgagcatggtggctcaggcctgtaatcccagcacttcaggacgctgaggtgggcggattacctgaggtcaggagttcgagatcagcctggccaacatggtgaaaacccatctctattaaaaatacaaaaattagccaggtctggtggctggagcctacagtcccaactacttgggagggtgaggcaggagaatcgcttgaagccgggaggtggaggttgcaatgagccaagatcgcccaattgtgctccagcctgggggacaagagtgagactctgtctcagaaaaaaaaaaaaaaaattcacatcattgatttttttataatgacattttggtgcaacattttgatacattatttaggaactttcctacctttgttatgattttagttcccaattaagtataactctgtaattatgacttggaaagcaagcaagcaagcaagaatttcatgttctggtaatattgttaaaaactctcaactacaaacagttagaaagacaggtaatatacgttttttaagatgaattttaaaggcatggaagagtccaaagaagataagagaaattgcagggttcaaaaagagagaatcaaaactcgagaactctagcatataagttaagcatcttaggtaagcatctaagctggtgctacagctgtcctgaatagaaaagtgtgtttgtgtggtgggaagaaggctaggaaatttagagggaggaacagcagcaaagactttggctcacgcaatggaaaatgaagacagaattataactgagagactgagattcccacaaacttagacagacagtctccaacttaagatgggatggttcgacttaagatttttggattttacaatgggttggtcagcatgtaaccccatggtaagtcaagtacctccttatgacttacaatgggcttatggtttctactgaatgcattgcgtttgcatcctcataaagtaaaaatatatatataaatcaaaccattgtaagttgggaaccatcttcggtgttaccaacactaaatgcattttcaacttacagtattttttatttatgacgggtatagtaggatgtaactccattgtatgtcaaggagcatctgtatatattcaatgaaagaacaaagtagaaaaaagccatcccatcaacacagtggtatgaatgacaagaatcttgtctgcttggcttgggctcataatgactaaaaatttctaccatggtcctgtgctgtgtatgagtttatgatttcaattgacattatctaagtggttcatgaacaccttagtcaagacattagcatcaaggaaacccctggagtacaaaagagatacaaacacaaactcctctcaaatcctaagaatgcttaggattcacaattaaagcccagctgaaaataactcagatggaaaagtacaaaacataaaagaaaataactcacaatgaataaaagtaaactaacacaacgtaaacttcctcaagaatgtcaaataatagaataaaataatagagacaaaaaagaagtactttaaatacttaatggtcttatggaaataatggaaaatacaagaacagtatagtaaaaagataataaatatagttaataaaaggcagattttaaaaaataactaagaatttttaaaatacttattaacttaaaaatacaatgaatgagttaagaacattttataacatgatgaagataaatttgtgggttataagttagatttgagaaaattatccaattgcaaccaaatatctagtaggatttcttgataaatagaatggggcaagaaaatatttgaagaaataatagctaagaacttttttaaactatggagtcctcagattcatgaaacggtaaatctgaaaaagtatatgtgaaaatatactcacatttatatgcatcataattcctctacaggaaatctaaagaataaaaaaaaattgcaaaagcagcctaaagcaaaaatgaattactacaagaaattataaacagactaaagacatggaaacagaaaccatggttgccagcagacaatggaattagtacacaatccagactgcaccagctaaactattcttacaaagcaaactaaacaatggcatttcaaccaaaggctgaaagggtttactgctaacatatttttactgaaaacatcttctgaaagaagtatttattgaaaaaaacaaagaaatcagccaagaagaaaagagaaatttaggaagctatgtcaactaagaaatgggtaaatatatgggtaaaactatacaaatactgacttaaaaaagttcaaaaataataataaataattttggtaggatgaaaataaagtagaactaagtcaataggaatgatactctgaaggtggaagaaatgattgaagtaaaagtgtcatatggtcagtatatttttcaggagtaggtggcaatattgatgacatttcaaacttgttagtcaagaaaacatgttaggaatcaacctaaatgcccatcaatagtagactggataaagaaaatatggtatatatacaccatgaaatattgcacagccataagaaagaatgagatcatgtcctttgcagcaacatggatggagctagaagcgcttatccttggcaaactaactcagaaatccaaatactgcatgttcttacctataagtgggagctaaatactgagaacacaaggacacaaagaagggaacagcagacactggggcccacttgaaggtggagggtgagaaaagggtgaggatggataaattgcctatcaggtactatgcttcttatttggatgatgaaataatctctacaccaaacccctgtgacatgcaatttacctatataacaaacctgcaaatgtacccctgaacctcaaataaaagttaataaaaagaacacatattaaagtttagtaaccacaaaaaaagaaacaaaatatgtaaaaatatatacaagtatatgtacacatatatagatatatacataccaagttgtgcatgtgtgtgtatatatgcttgagatatgtatatatatttgatattttgcccaatttctaattcgatttttattattgagttttgagaattttttttaaaaatgtattcccaatacaaatcctttgtaaatgtgtagtttgtgaatattttctcccaatcagcagcttgtctctttatacccttaacagagtctttcacagagcacacatttaccactttgatgaagtccagttaattactttttagggggggatcatgtttttggtgacatgtctaagaaatcttcatcaagcccacgatcctaaagattttctcatatgttttattctaaaagttttatagtttttacattttatatttaaatctatgatccattttgagttactttttgtataaggtgtgagacttaaattgaggttaattttttgtgtttgcacagataaccaattgcgccagcaccatttgttaaaaagactatgtttcctctattggattgctttcacaatctgttgactatacttgtgtaggtctgaatctggggtctctattctgttccactgatcatatttctataatttgccaataccacacagtcattgttactgtacctatataataaatcttaagaccagaaaagttagtataatttctccaagtgtattctttttcaagttttttaaaagctattctagctcttttgcctttccatattaattttaaaatagccctgtccaagtctaaacaaaatcttgctggggtatcaaaaacatttgcactaaacttttacatcaatttgggaagaatttacatctttatgttgttgagtcttctaatctgtaaacatgcctctaaatgtattaagtattctctgatttctttcatcagtgttttgtagttttatacaagccctatatgtgtcttattagatttctacccaagtattttcttttttagcaattaaaaatggtgttgtgcttttaattttagtttctatgtgttcattactagtatacagaaattaaatagattttgtatgttgatattgtaccctgtgaccttgctgaactcacttgttaattctaggaggtttttgtatagatttcttggggttttctatggaggccatcatatcatctgcaaataaggatagttttatttattgtttttataccaatgccttatatttctttttcttgtcttatcgtgctggctggaacttccaatatgttgaataagactgatgagagcagacatctttgtcttgttcctgatcttagagggatgcattcactctttcactattacgcataatgttagctctagatttctcatagaaattgaggaagttcctcctctatttatagctttctgagagtttctatgagagatttatcagcgtttattagggttttgagttttgccaaatgctttcctgtgtcttttgatgtgatcatgtgatctttcttctttagcctattaatatggtgtattccattgattaattttcaattattaagccaggcttgcatccacaggataaaccccacttagtcatgctgtataattctttttatatattgctgaattctattagctagcatgttgttaagaatttttatgtctatattcacaagggatattggtctgtagttttcttcttatgtatgtttagtattttgttttggtatcaggggaaaactggcctcataaattaagttgataaacgtttcttcctcttctattgtctgaaaaagatagggagactttactgtatccataatgttttatgttttttaaagaaaatctaaagcaagagtagtaaatgtactaagtataattgtctacctggcggaggtttaccaactcattctctatattttccaatatgcttaaaatatttcattatttaaaaaaaaacattttaagaacgacaatgaataagtgacactcattcttaagtttagtgctgagtttggaaggtataaataatagcaaagcacaaagttctttggaaaaaacaatcatcaatctatatttaaaaattttttacgcggggcacagtggctcacgcttgtaatcccattactttgggaggcagaggtgggttcatcacctgaggtcaggagttcgagaccagcctggccaatatggtgaaaccctgtctctacaaaaactacaaaaattagccaggcatggtggcgggcacctgtaatcccagctactcgggaggctgaggcaggagaatcatgtgaacctgggaggcagaggctgcagtgagccgagatcatgcctctgccctccagcctgggcgacagagcaagactctcttaaaaaaaattaattatgacttatttctttgacattttcagaatatttccagctctgaaaatcatagacctaaggagaacccaatcttttaattttatagaagttaaaatttgagacttcgctaaattaaatacatccacaagttctttgatattcttcataagcgggcaaaatctttttctattccactcgaatctgagctggtcctatacttactttagatgtcacagaaatgatgctgtataatttctgaggctaagctttacatgatgagtggtttctgcctattggaacactcctgcttggattcaagctgccatgttgtgaggaagcccaagcaaccactgtagctgcccatgtggaggagaaatgaggtctctgggcaacaaccctagctaagctcccagacaacaacctgcaccaaactgccagccatgtgaggccatttttaacattgcagccattttagcactccatctgacttcaagttataaagaactctcatgtcaacccgcaaaatcataaggaataacaaattattgttttaaggcacttagtcctgaggaagtttgttaagcagaaacacaaaaccaaaatagagaccaaaataagttagtggtttatctttaatggtactatctatttagtggaaactaagactagatcactgatctctagatgattagtccagtgtatttttcttccatataatgctctcttttttgaattagtatgttcagacattagtgaaaagcctaaacctaaataatatgttgccatttcactcacagagtgcagtaaggaagtgtatgtttctgtgaatatacacatgtgaggaactatgcagtgcaaagacaacttcaaagaccagctatccacaatcagttgtttttatttgtacctaagtgagtcagctactatttttccctaggagaataatgattacttgaaaagttaacaagctttatataccagaataatcatattttattcacttcctctccaaatgtcttttagtagaaatttttttcttctccaacaacagtaaacttcaaaactacataaaagagatgctgtgaataacgcaggtattatctgtctaccattatcaatcctagctttagagcatactcatggattagataatgagccaagtccttattctcagtgatttttctcatggttacaaagaaatccattataaagtataaacattaggcttgagtccagatcttcctagaaaattttaacacatgagaactcttttcttcttgttcaagttgattcatcttgtaagaagttacagtaaaagagagttggtgtaaacatcatatatatttacacatatacatatatacatagttctatttcaagtgttgtgaaaaatagcacgtggatctggttctcgcatatttattttcatttgttgctcgtaaagatgcaaggtggttgggaggctgaggtgggtgaatcacctcagctcaggagttcgagatgagcctggccaacatggcaaaacaccgtctctactaaaaatacaaaaaacattagctgggcctggtgacgtgcacttgtagtcccagctaattagaggctgaggcaggagaatcacttgcacccaggaggtggtggttgcagtgagccgagatcatgccactgcattccagcctgggtgacagtgagattccgtctcaaaaaaataaataaataaaatagatacaaggtggattaatctgaccatttatcctaaacagaaagaacaagtaaaaactatatttgtccttttcattccatctagaatttttgctacttactggctgtccaggctcaccaactccaatgggtcctggagctcccggtcttccttcttggcctctttctccctaagagaaagaaataatagaatgaaagcttgagattttaaataaagaataaacatagcgcaaagttctctcaagatttcaacaaggataaatagcgaaatagacaaaatgttggttttcataaaggtaaaaaattctagaggaagagaaatagctcgaatttaagtgaacaaattaccctaaaatgtttattatctcttcttgtccaaatgtaattcagtattttcagttttcacaaaatattgtgtaagaattggcaggacagactgtgtggcaatgcaggttggttacagagctgactaagctgacaatgtgtgtgctgtgccctgccctcttgccaccatccaggaatgtcaccccttccttgtccccactctatcctattcatctctcctttaagctcttttcagacttcatctcctccagaaaacttctccataactctgccagcataaactccacctttcctggagtctcaatgtgctcattgttgaaatgctatacatggggatattcaattacattcaaagtacactgttttgtactgcttgctattttaatcctgcatcaaagtcttattgtcacaaccacttggaaaagccattcaaaataggcacttctgctttattaatatgtcctgcataatgtacagcctcacaggatggacgttccttccttccctttctagttctctacaaatctctctgccaacattgacctattcattgccatggcccttctggtttctgcccctttatgcttattcaatgtgaaccatgattgttgatgtgttaagttgtttcacttcccaataacatatttgcatgtgaatgtttaaagtccatgaaaacaacagaactacatgtaccttggcaaaagggtgggtatttggagacaagtaagtttttcattccaacaaaattaaaaaatacgttaattattcttgtggtaactgcccctgacaagcacatttctgtgtccaagcacataaaatgaagtaacttcaggaagcctccttgtgtctattggatttaggccaaatggagttcaaatcatggctcccccaggccctacaataaattcaacagtcatcagtgggcaaaaagacaagtatctttaccttaataccttgctgtccaattccaggagctcctggagaaccataaggaccaggaggacctggctcaccctggaggaagaaatagtgacatcagttatatgttaggtcgactcaatagtattgactaagcagcttttagatgtatggttttgcaataggggctttcagagcaacaacaaacctgtacatcgtgcctgccctcaattgtttacaactcatttggaaagaaaacacagacccaagatcaaattatccactaggcacagtagtcacaatatctgggtccacaacactttcaggagcctgcaaatatgttccaattgtaattttttgattcaaaataaaaataaacataatgactatataacaatgaatacagcttgcattcataaatataattttttaatgtgtttatggaggaaggggcccacaaagtcaagtgttttcaggatccataaaaggcataacgcagccatcactcattcattcacaaatctttaagtgctctggaagacatattttgtttcctcccctgcggctgtcctttctcagctttccttccctgctgataaacccccaattgagtcagtcagtgggcagctgttctttgccctcagaggtgtaggatgaatgatcattggcctaatgcaagatgggaatctcctttccctttgtcactgattcatctcagttggtcacatggctcaattctgacaaacgagatgtgaaggaccttactggatgcaaaggagaaaactgcctctgtctcttctttcctacatagagatgtgataactgtcttgtaactatgaggcagcaatctctaggacaaaagccagctgctgaagaggcctggctcctggataccctcaatgagcaactgatccagtcctggactacctgccttcaaatattctgtttactcaacagcaagagttctcatgatttaagccactattattcaagatttctgttactcaaagccagagcattttgaaataataatagcctatgatgtggcaagcccataatagaattcaggcattttagaactagatgtgaccattgcactcaaacccctacatttcacaggtgagaaacccaagtcccagagagattacctggccagcccaaactcacacctgaataccactcacacagttacagctctttaggtctctccggctttaagccctgtggcatgatgataggggaaggggagtggctattgaccccaattacccatttcataatattatttttttctgtttatcaaaataatatgtctcattgtagaaaattgtcatatattaaaaagcatgcatgcaaagaaaattttaaattacctatctgtaactattaatactataaaatttcggtgtatttccttccagttttttacattcacacgtgtacctttaatttatgctaaggaagattgctgaacactctttatgtttcagctaatgaatatttgctattaaaaatttcattcaacccaaaggtttctctcttcatgctttcactaaccaacagtaaaatgaaacaggaaagtgaaacaagccttctctgagatgaagggagataaaggagttttcagaaatattaaagtctcaatttaccccagaagcttgtgattttggaagggacacctaatgaccagagcaatgttctgtggatatagtaaagacattgctttactataagaagtctgtaaccgatgtggtggctcatgcctgtaatcccagcactttgggaggccgaggcaggtgaatcacttgaggtcaggagttcaagaccagcctggccaacatggtgaaacactgtctactaaaaatactaaaaaaaaaaaaaaaaattagctgggcctggtggcatgtgcctatagtcccagctactcgggaggctgaggcaggagaattgcttgaacctgggaggtagaggttgcagtgagccaaggtcacgccaccacactccagctttggcaacagagtgagactccgtctgttaaaaaaaaaaaaaaaaaaaaaaaaaggtctgttgactttgaccaattgcgaaagagaaccagaagggctaagaagggtcagagtcaaaccagctccccagaagatatgcccaggctcagggtgatttaaaacaaaggaatcctgcctcaaaatgagtcatccacatttatgatcctttgatatttaagtggattgaattcaaaagtacttactgtgcatgctgttgagtacaagtcagtctggcaaatattttttcccttaaactcctaaggttgtacttgtttttctatattgattaagttttctgagcagccagttgactgacattctcattttacatgtttttagccatggaatttatatatatatgttacataatatatgtaacattatatatacctgttatataatatatatacatatataacaggtatatataatgttatataatatatataacattaatatataatatatatatatataccattaaaaatacaataataatatctacccactgctgaatttgtctggctaaaaaaaatacaataataacaatacaaggccctaaattcacttattctattcattttttatcccttctatatgtagcattggttctgtaatgggtcagaaggcatctaaattatatatttggtagagaatttgaggattttttgagtagtggaagttctgccctacttggtacttatctgatgtttgatcagaaacaaaccaagagcccaggttggtgacaagaaattggtttggtcattaccttgaaatgtatggatcaggagaatcaagagtagaagcagctctcttaccttgagcccatgaaatccctttagccttagtcaagtaccaagagcagctgagcaatatcttaatattgctttacaaggcagttgcagggatctgaagattacagagggattgctctcctttacctgaacacagccccttagcaatgtagcttcacatttcacttgcttaaatttatttctcgggagcctggtatctcaaggtaggatccacaaaacagtattggcctatagctcatgtttattcccttcccatttcccctttttctttcctacagagattcctgaggtagtaaagaaagtggtcctgactctaaaatatgctgtctgggtaaaaacaaaacagggagggaagagtcagcactctagtcagaatagccctggtaagacggcaggcatgattcctttcctgttaatattcctaccccagcccttagcaacacacacacacacacacaaagacagagagatggcatgcccaaaaaattgcatgcccacagtaattatttctctactttactttcatttgccatcagagccatttaccaacaggcaagtataacaaagaggtctgggttaaaatcagtagccccagaaagaatatgtttctcattacctccatgtgagtgtgaatgtgtgtgaatgtgagtgtgagcgtgtgtggaggcagcaaaaagtttaggtaaaccacctttgtccttttcagaaattaagaacacccatactatgggcttcaagaggacaggaagccaatgtttaataaaacctgctatttatcagcactgcccagacatgttacatacattatctcatttaatcttctaacaatcataggaaatagattttggggtttgggtttttttttcgaactcctttcctcaaatgattgttctgtcttggcctcccaaaatgctgggattacaggtgtaagccaccacacctagcccttcatgcatggagtcacagggaaaaaaccatggctttgaatcatttggtcttgtagaaccttggttctatcatttactaacaattttagcttttgcaagatctccatatgcaaaatgaggataattatatctgccttgtagcattgttgagaggattcaagatattgtctgcaaaacatctaagtcataaccagtcacacaacacctgtttaatatgtatagatttaattgttattcaccagaccttttttgagcaccaaactaataataggtaaataacaatttatgtctataattgaatatcaggttacctaatcacagacataaatcagattgcacctgcactttgcagaagcttacaatctggctggagagacaaatcaatataaaataaaatacaagcatgtgaattagcataataaagatattaacagaatacataagactctgaggcagaaatgtttaattctaccttaaggaattgggaaagtttcatatagtagaggagatgtttgatccaaacaaagaagtaggaatcatagctaatctgatggaaaagaaaagaaacaaaagttacagaagaagaaagagcatgaggcttaaaatggtgttaaatattctagagacggtcagcagcccgtgagcccaacaggccggaaacaaggtgacactagggccactgtctggagcagcatggtccaatgcaagtagacagcgagccacatttgtaattttaaattctctactagccacattaagaaataaaaaaacaggtaaattataattaataaattttacttaataaatacaaaatattatcattttgacatgtaatcaacactttttaaagtattaattatttttttaccatcttttaatgctaagtctttgaaatctgatgtgtatcttatacttacagcacatctcaatttggaccagccacatttcaaatgcccagtagacacatgtggctaccttattgggcactgcggtttagagtgattaatgaggttgaaggctcaggtcagtaccatgaacagtaccaacatttaagtcaggtgggagtggaagaatacaaagatgtcttgtggggagttggggaaaaagagaatttcaaaaagagactcatcatttccaaagataaattgtcatctttcactccccaatatagtcatcttccagcccttcccacctcagggaagggcaccagaatccctcctgtgtcaaatgggaacctaggggtcattcatgacacctcccactccctctgccaccatatgcaacgcatcccaacacctatcagtatgcctcctaaatatctctcaaatccatccacttcagtcctctaccacgcgtctccagtctacagcaaactgataatacctcttgttcagagtacaacaaagcccttagtactctacttgcacccactctagcatgctccaatttattccctccattgctgcagagcaattttttaattttaattttaatctgagtaaaaccttctgaggcctttcccaaagacagagctccttacaaggccctgcctctccaatccatctgtcatcagtcacctctttactccccaccccagcaacattggcttttgttgaattccttgtacttgccttgctcctcctgccacaggatctttgcacagtctattctgtctgtctgggatgctcttacctttctctttcatagtgattcttacccttcagatcttattttaagcagcatggcttcaagaagggtttttctgataagatgaaatcactattttagtattgatagcactgttttccttttttttctgagcattcattacaagttgcaactttgcatttaatgttctccatctcctccccactagactgtggggatgatgcatatgattttgttcagctttgcattctcagtgtttagctcattactataattcactcaatcatccatgcaccagacatttactgagcattgactagggagcaggggctctgctagctgtgggaggtgaacaaaactggaaagctgttctgggctgaggagctgtgggtctagaaatgctcctctgcagttccctgtggttcacttaggttttcaactaggagcaactgtatataaattacataatgatatcaagtacctattacacaatttctcctaccaattcacccagacacaattaatctttttttttagctgaaagagtaatgaaaccacaatgaagaggaaaattcagctgagaaaaccgactaacactccgtatccctggcactgattctaaccaaaagcaaatccttcatttctctaagacaatacataacaaatggttatccaagactgaattatttgtggacagaactttacactttttttgataatacaattatgaacaattttatcatattttcttaacattacaaagatgttttagcaacttttaaaaatcatttcccagatatgcatgggaccaactttaatattttaagttttattgcaaatattctaatacttttcaaatggaagaaaatgatggatgaacattttgtaggtgcagaatggttcaagtatggccaggatacattctcagctgaaactcagtgaagtgatgactgtatacagagacttgggagaaaggtcaagaaagcctccttttggaaagagaggaaggaaggaaaggagggagggagggagggaagaaggaagaaaggaaggaagaaaggaaggaagaaaggaaggaaggaaggaaggaaggaaggaaggaaggaaagaaggatcaatatttatcaagtacttgttaaatcaagctccatttttagcaccaagtttctcatttcagaggaagtgttgtgttataaaaggcttgtttttagaaaatttaccagaataaacttggtctacattagtataaagttgtcaaaatgcttaactacttaattaaaattaccaacacatatggcacttactatgcaagaagtgctgctctatgtgactgacgtgtattaactcatttaatcctcaccacagctctaagaagtagttactgttattaacttactgcatggatgaaaagattgagtcatagggaggtaaagtaacttgcccaaatcatagagccaataaaatataggactgggtttgaaacccagcagtttgaggttaaacccaaatcttaatcactatgccaaactgcctcttgaaactttttaattcttcttttaaagtatttcaaaaattgtatgactgcagactaaattcatatctttattacaggatgaaaaatacaaaagtcatataattacaatctactcacaactgaaaatccatcatatgaagacaaagcatctctaaaataaaatataagccaaggggaaatataatttatccaagctgatgcacatgctatttcaggtacataaagtctacttggttgtcacttaatgttaaaagtaatgtaaattataactggcaatactgtgatcacacaaggtaaatctacatataaactggtaagtgaactgtactgagtttggaaccactattatgtcaaatctccaactaaaatcttttttgaataccagctatttaggtaagagagaaagtccagtccatatactctacgtacttgtgctttctaaagcagaaaaagactccataataacaatgaattggtgaagaatataataaaaattatattgaaccacattttagtaactcttaactcaccttctagaatgctattaggtttaaccacataaaattgacaatatttgatcatgtttggcctacaaacatggcaattcatgtgtttcaactaataggaaagtcatacttcattatatataacaaaatctgagaaaatgcaagtcattttctctgaaaggaaggaccagtcagcagcccattaggagagcttttgagaatcgcagctctagaagacactgtttagaatcctccagcacaaaatgagttgctggtaaaaattcagggtggacatgctccattaacctaaaaacaaggccactgatttatgagagcagatgggtgtatatgacagcgtgataatgtttcttcaaaacttacccttggaggctgggaggagggaaacatggggagttattggttaatgggtacagagtttatgttgagacaatgaaaaacttttgggtatagatactggtgatggttatacaacactgtgaatgtatttaataccactgaattacatacttatagatggttcaaataataaatattatgttattatatattttaccacaataaaaacacccttggaatacaattaattttctctgttgcaaacttgctattgcaacttacttgaaataaataaggacattgatgtaattacaaagaaaacattctgacatccctctgaagacactgcagtggctgattctgttccattttagtgccccctttgactatgcatgcagtttaaactcagccactttgtgggaaatgttggcagcattttcagttccttggtccatcagagcttttacctgacaatctacacacacacgcacacacacacacacacagagtatatataccccatctgctgagaaccacatgcatcagctatttgggaatagaaatcatctaccttgaagctattggctgacatcccacatgttctggcagccacttcaagttgtcactatcagttgtctcatgtcaaacgagttaataagctcatttagagtcttggtgggcagatgtgcatgtaggtcaaagccttttctacagcaagaattgctggattactaatgattctttccctttaattaggcccagaacagaaatagcattcagactttgacgtctttgaaggaaaaacgttcacatcgtttggcggcttggctatgagtcttcatttaacagttatttataattaaaattgtaaagggattcttcctatacactgagcagtcacaacccttgttcaaaattgttgtcctgccagaagaaccagaaagcaaattactgtttttggacaactagaaaagctgacatgttcaagtaccctacacttaaaatagtttatatgaagccaaaaatacagtcattctgttaagagaattgtgaacttaaaacagttttttgtttgattaattattctttaccaagaaatgtaggaatctacatgttttcacttgatttacttcacttcaagtgataaattataaggaattatatcctgttacaaatcatgactttttaagtggttgaaagcaacatcatgatgttaggaaattgttaggtttttgacttatataagaactgaaatatatctacacaagatgcttgtttgaggagaaagtttaaaattctttataattgttcatatttgtgatgttgaactacttccaacccataactggaaacattagttatgtttagtaggttgacctagctactaagctaattttgagccaaaccaagtacttaaataatgaccaaaacaataatgtatttttaaaactactaaatcttcattagtgatttctattctaacgaaaatactggcatagaaaatgtaagactctaagttgtacacaagaaagtgtaaaaaatacaaattaaaccccaagtcttcatgccacttttagaagaaagtagaagtaacacattggattgtttaatgcacaggaagcttttgatggggtatgtcaacactgtcctgtttgtctttattacccaactatgttagaagaatggtcaatgttcccgactgttacatccttctctctggtttgctccacaactcattgccatctccttgacccttctactgaaattattcttttgaatcttcccaatgacctcaatattgccaaattaagttaccacataggcaactgcccacataacctgtcttcagtatgatactgttgaccactcatgccatttaaaaccttttattcactcattcattcaagaaatacttgttgcttcatgtaactgtgtgtgaattagtgtgcaaagcagaatttttgaatctcccagatagtggtgttcctgacccattgttcccaaatcttctgatttagacttttcaaaaatagtgatagacctgctcatatctgtccagttcttctgccaatggttcctatctgaaagaagactaggaatgattaacggtataatacatggaagctcaaaggagagaaacttgattagcacacttccagctcccagaaatatccacacatgcattcctaatatcatatctgaaaggaagacagccagccctcttaccaaaaccctttttcatagaacactttgaagaaaacaggatgttgtgtagggacgtttagcatgcttacagttttaagttcagggtctgtacatctagctcttgtttactgaatctcctcattagtatatcattaacctgaaaaatatatcctttgcttgggaacctcagaaactgggatggaagcttgaaaaagtagggttcggaaaagtagggtatccaaaaactgtggtgtggtgcaagcttcagggtgaactaaatatatcatgtactaccctcatcgccctcactgcaacgaactcctcttcaaacatggttgtagttcattcactaacagtaggtcttttgtccatttgggatgaatgtttgtgtcatttaccctgaccatatccatttattaaactgggccagtctagtgctatttctctatggattttcttaatatctcagaagtttaaattgaacataaagtaagaccaagtctcataggtaaaagaatgctaagtttcttacacttgactgtacagcaagaagaaaacacttaggacaaatatcctgcaggaatattatgaacgtcctagagtagaacaatggaaggagttaggagaagggaggcaattcattttttaagataaatatacaatactgcagtattttttaactgtttgaggattagcatatggtactttcccttgggaaaaaacatgagggatatctccttgtgccctttaggccttgaagctctaatgctggggtacttcgaaatgtcaccagctgcttcctgcacacgccactgtgcagtccctcctcccaaggcacaaagagagtcttggaaagagtggatttgcatgagatttgagaaggaaatgcccttcagaaataacctcagaaagacatcaagaaaatggcaaaaattacctaatataggctgggcaaacccagtgttccactgtgttgatttattcaaaattagttttggtaacttgtcctctgtgacttgaaaggcctaccaatcataagccattcttcctagtaattaaaggcctttttcaagggtcacatgtgattgcaacctgagccaccatgacagccccatggaaggcagcagcgttgggtttttaggggttcagtctttcctcagagcatagcgctgtctcctgagtcacaatttcagtttggtctcagggataaggcttcttgggcacttgtgtgattacaattctaactgatttccgagactattgagacgttccgttttttttcttttgagacagagtctcgctctgtcaccccagctggagtgcagtggtgcaatcttggctcacagcaacctctgcctcccgggttcaggcaacgctctgcctcagcctccagagtagctgggatcacaggcgcccgccaccacgcccggctaatttttgtgctgttagtagagacggggtttcaccatcttggccaggctggtcttgagtcttgaactcctgacctcgtgatccacctacctcggcctcccaaagtgctgggattacaggcgtgagccactgcgcctggctgagatgttcttatgaatgccacaagatgaccttcctgtgtggtagaggatgaggtggactctgagctaaggcttctttctgagaaacatctatgttttgttgctaaggcaacaaagtcattcagggcagactaggagctactttacatgtggaaagtattattgacagaaataatttgtgaaaatgggccaggagcacattttttcctgacttaacacatgcatttttttccttttgttctttggccaccttttctgaaaaccctttaatgaagaaaagccaatccctaaagcaacagaaagtgagcgtaattcaagagaaagaccatttgtaaattcatagacataggcaggccctatctagaacctctcgtggaatctttgcaaatgttgcaagtttaaaggtttctattttaaggtcttatatgaaatatagtatttgaaaatgcacaattagcattaccgttttctttctcccaagatattcccttccttttttttttttttttttttttttgagacggagtcttgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgatattcccttcctttttcctgcactttcagatgaagattaaaacccaggagaaatgcacctttcaacaaactgttgtccctagccagagtccaccagaagggaagacagatagaacttccacactgtcaaaaagaaatgcatttatttcaggccaaatattcaggaaattcagcaatttttcctaaagggataaatataatatggtagctaagagcagacttgtgggtttcaatactcagtctgtcccttactagctctgtagacttggacccattgcttaaactctttgtgccttagtagactaatctgtacaatggaaataagaatagatcatgtctcaaaaggtggtattagtattaaatgagcacttaaaactttacttatacataataaatatacaataaataaatgttaggtactgtacaagtttcaaaataaataatcttccttgtgcccattagagaatacagaattactgaattttagagggtttctttgcacaaattgcaaaagcagcttcttttaaaattgtctaataaaatgataatggataaaaataaatgtcactataaaatattatttccagattgaggaacaaaaatagcttattatgtcttcaaagtatagtacattctgggaggcaagatgaaatcattccctgaaaactgacttttatgacagtacactaataagtgtataaaatgaaaaaaatagctaatgaccaatatgacatgaatctccagctaacagatccaaagagcagtagaaattatatagaagttagtaatagtgtcaaagtaagagtacagaccttaaaccagaactatgactagaaagaaaagggggaactcatgcccacttcatagactccgagcgatccccaacattatctagaaattgacagctttttgattggcaatgaactttgttcacttggcagtgaactttgtgcttaaaacttaagtggcaatttcatgtcatgtatattttacaaaagagaggcccttgggaaattgatgaagtcctcaaatgcttttggaaaaatgactccttttatgattatgctgtaaaagtcaaccacaaagtgctattatgtcagaaaaattataaccaacccccccaaaacatacttgatgcattattaaaacttaatgcactgctgaaattaaaggccaaattttattgaaatatgtttttaaccctaagtgataacactattagacataaagagttgagccaggtatggtggctcacacttgtagtctcaactctttgggaggccaaggcaggaggattccttgaggccaggcattccagactcaactgggcaacaaagcgagagcccatctctacaaaaaaaaaaattataatttagccaggcacagtggtatgtgcctctagtcctagctattttggaggctgaggcaggagaatcacttgagcccaggaattcaagttgcagttggttatgatcatgccactgtactccagctgggggaacagagcaacatcctatctctaaaaaagagagagagaagaagaagaagaaaaggaggaggaggaacacctttttatggaccattccctaccataccaccacaactgccagccacgacctgcatcacccaaagctgcaggcactatttccaggccagcaccacctcagtgccctccacagatgatgggacctcactgggactctgcctcaggcaagccatttgatctccaggctttgtttctcatttccaaaatgaaaatgctaagccagtatgatctctaacatccctagtggctcaaacattctataattccatcatactgcaaaccccagctctgatccctgactgtaagcctctttctcacaaacatgaaaattgtcatcttaggtaatcaaagaattctaaaaattgtgtggtctgtcaaaatatatatttttttcttactgtaggattgtacctgtagccaatgcaattttatcaaaacttctgctcatcagtattcaacaaggccatttctttccccagagagaattaatcataggcaagaagtgaaaaagacagtttccccagttgaagcctaagcacatgcctgctgagaagcccattctattttaatttgccaattcaaagtggcctggtaaatcacacactgtcattatctcattaaaaatattatactgtcactctctttcctctctctcaagtagcccaactgctccctacaacttcagtttaatatcacccttaaaaagctggctttctttagggtcagttgaggatggcatcttctgcttttattactgccataaattccataccactcaaatcactaagtcgacaccatttactggatatttactatatccgtgaaatttactaagctttgagaagagttaaaaaggaactaaacagcttgttttagcaaattaatggtcactctcattggaaaagagagccttataaccaggcctttaaagatccctcccatctgcatctttttgttctgcgtggcttgtattcaacccctccctatttgtcttggctggttatctgtggactgatactacaagcatggtgctgatggttgagatttccctgtaattaaaaaaagcttgatttctgttggtataacaactgtaaatttccttcccctataaagtgtatattgaggtggcattacatttgagaaatagagtggtttgaattgtgtcacttgttattgctttttggtttctaatgagccataaaataaataaaagtcaggagtaagaaggaaacacagcaaagattctagataatggcttatagttaacaatatccctctttgaataacataataataaatgataaaggtatgctgctaacttcctgaatgcattaggacttaattctctgtatacatctgcaggttattatgcatttccaaaggtacttcctcaaagaatccattgacttttacctaataaaacatacattactatagcgcactaggggaaaggcactctgcctgtctttaatcaaagggtaagattaccttattgccttgaaacccctttgggcctgggtctcctggaggtccagtaattccctgctccaggatgaaaaccaagaattagttctgtgtacaaaaggccagcaggaatgaatcattctttagggtccctagagatcctggcgatcgaagttagactgtgtaactcagagctaaattgaaatcacattcaatcgagaagtgggatgagataaaatttcttgtgtcaaatacgtagcttccaaaatagcacttatgctaagagcaaacatttaattaacgagatgtttgtttactaaacctgtgtttccaacattattccaacgttcttgactccttttaaaaaatattttgccagttaagtatcttcttttttaaaatatctaaggcatatgtaactgacgttagagcttccaatgaacctgggataaccagaatgactgcctggctctgacatttccaggctaaagcaaagaagttagtggttaactagatggtgtctaggagattctgggtaaaattataattttctgtaggctttttgaaatactgaaattaactcctcacacagagcaccattataactttagaagagataagttcctaggctaggaaaagattcaaattattttctgaaatctatggatgtctaacttaaatgccttagagaatcagtccatattatagaacattatctagttatagaacaataaaaatatactgtgatttagataaaatgcataacttttccaactacattatagtagcagtgcaaaaatagttacatcctgcttttaaccacttgactttccatctttccagactcttaattttttaacttcatcccctaagctgctcactaatacttgcctgttggtacctatctttagggagtcttagttaagttaatgaaaacattagggaagttgtttccaaaatttattgcacattgtaatcttctgggtatcttaaacaatattaatgcctggcttcaatccccagacattctgatttaactggcagagggtgcaagtgggcaaggggatggtttaaaaactccccaggtgattctaattcaaacttagatttggttttaacccccttacctgaattcctctgggtccctttggtccatatggccctggggatccctgtggaataaaattgaaaataagtctctctaaatatacatcttcaacgtgcagtgattttaggtaggagggaaggaaatgtgttctcggtaattgccatcttccctggttatcttaacatcaaaggcaataaactgaaataatcctaattaacaagccaaggggtaggagtgtcaaactttccttcagtaaacaatctccatgaaaatacaattttagatgtaagtccgttgcctacatattgacattttggtcattttggttacagtaaagaaattactttataagattccttagagggctataaacttattggaatattatttccttccgacagggtaatgtcagttaaattaacaatgtagtgcatttccatgctatctagatcactcttttgctcatcttcaaaacactgaacgtggcaaaacactgtttatattcaatactcttctaatagaaaatatttcattcggtcccataaccaggaaaccctttaaaatttattttgtgagggagaacatagtctagtttttatttccccagatttccactttttttttttgcttatcaaagtacaacctgttaacaattgacacactttgacaattatagaaacatataaataaacaatttgaaaaatcacacagaagcaaatgctgttaacattttaggcatattttcgtccagttttattcccagtagattcctcttcaaataatgtgatcaaagtgtatgtctgattttgtgtcctacccatttggccttacactgtatcaaaaatatttttccggccaggcgtgctggctcacgcctgtaatcccagcactttgggaggccgaggcgggcggatcacgaggtcaggagatggagaccatcctggctaacacagtgaaaccctgtctctactaaaaatacaaaaaattagccgggcgtggtggcgggcacctgtagtcccagctactggggaggctgaggcaggagaatagcgtgaacccgggaggcggagcttgcagtgagctgagatcgcgccactgcactccagcctgggcaacagagcgagactctgtctcaaaaaaaaaaaaaaaatttcctttttccatgtcattaaaaactcatagtaaacagataatagtcaagaatagggaactaccataatttatttactcatttccctagctttgacctaatattataatgaacatctttatgtataaatctctgcccaacttctgattcactcctaagaatagtctactagaagaggatgatggaagcagagaccataagcacatttaaggttcaccggctgtcctttgtctctcatgccatatatagaaataaagagagagaaacttcctccataaagtttgtttgttaatcatttccactacccgagtatgagagagtgtatcttcatcttatgggctccccatcaacaattagtattatacattacttcactgtttgctaatttgataggtgatataatacttttgtatgtttgcttttggttgctggtgttgttgttgttgttgtttgagacagggtcttgctctgttgcccaggctggagtagctcactgcagcctctatctcccaggttcaagcaatcctcccacctcagcctccctagttgcccacactggtgatataataccttattgttttattgttggttttgttttgtttttgagatggagtcttactctgtcccccaggctggagtgcaatggcacaatctcggtccactgcaacctctgcctcccaggttcaagcaattctcctgctccagcctcccgagtagctgaaattacaggtgtgcaccaccatgcccagctaatttttgtatttttagtagagatagggtttcaccttgttagccaggcttgtctcaaactcctgacctctgatgacctgcccaccttggcctccaaaagtgttgggattacaggcataagccaccacgcccagcctattttgttttttttgagacagggtttcgctctgttacccaaactggagtagagtggcacaatgacagctcactgcagcctcaaccccctggactcaagcaatcttcccacctcagcttcccaagtatctggaattacaggcacatgtccaactaatttttaaattttttgtagagacggggcctcactatgttgcccaggctggtctcaaactcctggactcaagtgatcctcccacttcggcctaattttaatgtattaatttcacttatctgattgctactgtattcggatatttttcttatttattagccattttaatttccacttctctatctcttcatgttgttcatatgtttttctgaacaaacttgtgtaaactcttcgtgtcaaggactctatatctcatcagttctaaggcacattttttcacatttttatatctctgacattggggtatattttacagtcaattgcaccttacatttataattggcagtgggttttttttgttgttgttattcctttttggtatggaaaataatgggacatttaataatccctgacatcttagtcaatgaaatatgatatcctttgtcaaccattttaatttcatctagttttcccaggtattctttgactttcatttctattctattctatgtgtgtccctttttctgcattgccaatatccaggtccatcttccatgttcagttatactccaggaagaatctattcattttcacatttcccattttgaccagagataattaccaagcctaccttttgcagatccacctgactttaactctacagtactttaaaagcattcagaaagtctcaatctatttaaagtgtttagtttcatgggccaaagtcattatctcaccctcttctcctaaccttctgcctcattttctctccttgactcccttccagaattataacatagaaactgaaaaagtttggtatcttggtggcatgatgttaatagttcttaatataatgaaaactatttatttttactctgtacttttttggaccctttaacatcatgtttcagatatactctctgtatatatttggccttttgaggaactctttaacataatattatttccaaatttaagtgctttcattattgattgattgattgattgattgatttttgagacggagtcactctgtcacccaggctggagtgcagtggcacgatcttggctcactgcaacgtctgcctcctgggttcaagcaattttcctgtctcagcctcctgagtagctgggactacaggtgcacgccaccatgcctggctaatttttgtatttttagtagagatggtgtttcaccgtattggtcaggctggtctcaaactcctgacctcaggtgatccacccaccttggcctcccaaagtgctgggattacaggtgttagccactgcgttcagcctatatttattttttaaaataaaggtgaatatttatccaattgtttgtgtctacattttcaaaattccaaatctctatgtctagttgcaccacactgtttataactatttcactgactgatttcagagttcttcacactattttggaaagtgcctgttttcagtgtttgcatctggaaagcacttctaccctgacctaactgcagctttaattaactttgcaggttaaataattctttttaccataacattcagtgggcgtggcctccaaggttagggtgtcagaaaatgaagtcttaatggtccataaaaaaggcatttgggggttctattattgagttaggcatcactttgttttctaccacatgttttacagatgtgaaaaattgagccattgattccaactctagtagtgagatcaccataattcagcccaggaatttccccttaaggaaacgcaacccaaaagggatcacagctgtaagcagtttaaaaacatgttccttaccttgtcaccttttatccctggtttaccacattccccacgttcaccctaaaaaataaataagtgaaataaataagagaacacttgcagtcattcactattaagaatgtttgtttgtttgttttttaaattcccagcagactcttgtaacataagcactcttttggtttctacacaatattagcctcaatactgtgggttttatgggcattgaaatctgaatatttttacccaagagtcatccttaacttgacaggaataaatcaggaacaatgtaataaggtttgacatttttaagaaatggatgaaactagaagaaaaggaacctagcatctaatcacatattagatgccctttgcatatgtggtttaattgaatccacataacggtccagggagatcagctttatcattcttattttataattgagaacatttaaactcaacaagataatttccctctatcaaatagctagtaagtaaaagaatcagagtctgaacccagatactttaacttggaattcctattttttcaagaacaccatgcttcagcctgagtaccaaccttgaccacctagtagtgttcacctggagaaccgtgagagaaaggttctgaagtgagattgcatcgtgagttagtgggaacaggtgccatgatgagttagcgaggactgctgtaggagagccgggcttggcagcaagcatgctacatatttttcattattatgctctacttccctgtcttccctagaatattgctgaaaaaacaacatttgagttattctttagagtttatcagtgatagtttatcataaatattttatcttagttaatctgacattacctgtctgagataaatattaatccaattttatagattaaaattttgtaattaagaaggttaagtaaagagaatgtggtatacaatggaatattattcagcctttgagaaagaaatcctgtcatttgtaacaacatagatgaacctgaacctggaagacattatgtttagtgaaataagccaggaacagaaagacaaatatggcatgatctcacttatatgtgagatctaaaaaatttgaactcacagaagcacagagtagaagggtggttaccaggggtaattggtggaaacttgggaaatgttggccaaaggatacaaaactagttagataggagcaataagttcaagagatctattgttcaacacgatgactatcattaataacaatgtcttgtattgaaaatcactaaaagggtagattttaagcattctcaccacaaaaactgatcattatgtgaagtgatatatatgttaattagctcaatttagccattttataatgtatacatttatcaaattatattttatacaatacaataaatatgaactttttagatttgtccattaaattttttaaataaaactaaatatttttaaaaggttagtttcctcaagtagaaggagaattgggacctctgaatactaatccattatatcagacttttgaaacttctactacttagaactaaaaggtgacagtcagaaaaatgactaaagtttcataatcatagtaatattatctcctttataaatcactttagagttttcaaaatgcttttatatatatcgttattttgatcctcaattcaattctcattttcaagataaggaaacacaattggatatgtcaaatgatttacttaaatgtacaggctacccaatgactcctagtccagtgctctcaacactagcttctgctgctgcttctttattctgcctctgtactgctctagggcatgttactggaagtgccactacacaatgacaaggaaattacattcaaatgtaaatcaatgcactgcttctttcatcaaggaagtcttgctatgaaaaataaatgtcagctgaactttaaacagtatacgttgtaatatagtggatttatatgctggcggaagctttatcttgttgcagaatagcaacaaaccattcacagactggcagccagcctgcagaccacagtttcaacagcagtgctctatggagggaaatcacaactgtaacctccaattatggatgcaaagtgtgtgccatagcctttacattattgctaatccccatagcagccttgcgaggtatatatacatatctccactcacagataagcaaaatgaggctcagagacattacatactttgtccatgaccacaaatttgagtctgttaggctctcaagtccatgttcttatcagtcacctgtagctgaacaaggcacactatcataggctgcaagtcactttccattaacctgacatttctgcctagggtactgcctgggctcttgcaggcatcaggagcaggaaagagggaggtgtgactcttagagccagctatgcctctgatcaaaagcaatctgttctctcttcacatcctttcgtgagtcaaactgacccaggaaaaactgagctttcacttagaacaagttgaacatttatttctgaatgcaaatggaaaatcacttttgaagaatcaattagaaagcaattaatttaataattttggatgggaataaaatgagtcaaccaccaaaatataaaacagaaagtaccataaatacactcaaaatgcttttggctacaattcacattccatttgtccagacagatttgttagctataggggcctgaggaacagcatttgttttttggggggcacagattgccatcaatgaaaatattgtattcatgttatttgcctctgcaaaggcgttttcctttttggtgggctcattaatccctgtggaatggccacaactacatggtttcagaaagcgagtacttcagaaagccatgaacagatcagctctgttctcagcctctattttctgatgctgctgctcctggtgaaattctggtttgaatgtcgatggttcagggtcactttgctctgacagcttgtattttccaagtgagaactcttccagtgaatcaataattctccagaaagtgaaattaatcttttcaaaaaatatatgtataaagcttccttgtgttgataactacctcactatataaatcaaaatggaggagggggccacccactattttcctcaactatacacacagttgataattttacaactgtgaaacttttttagttttcccatattaatatttgttcctttcctcttcataatggcacttacatttgtagacaagccaacattttggaatacattgtcacgcccattatttgattctccaaccactctgtaaattaggcaggcctgtacaaattgtattccatccagttgaagaaacagatactccaagacattgagttacctaagttcttaaggctgctaagtgtagaatcatgggattccttacactcttccccttggagttctaacattgccagcgattaggatatatttattggcttacatgtaggctcacccctaatatttgcagggcccagggcaagagtgtaagtggaagcccacataccatgtgtctaaatagttgaaagttataactaaactaataatgttctggcttccttccttaacaaatatgtcttcaaaagggataaagaattaaaagacttatgaattcctcagaggtccttgccagacatagccccctgcagcctggccccaacttcccttcccacctccaactccttccacagcaagagcatgagcacacacgtgaagatgccccgggtagcacaacaaagcccgctacatgacctctcctgccccaacaaacagctaccattcggctccccctccagcctaggaaaatgatggatatggaaaggaggtttttgtatgccctcccagcagcaggccttttgaagtcttggctacccaatgcatgatccaggagaaggaagcacagacctcctgcagactcctggctccatgagaagcagggaggccagaggagactcagagctggaccctctaaagttctagcctctttctcatgcctgaaggttgtagccctgtaggatggaatggatgataggtgcatgttctgattcagatagaaaatctgataataacaagaactgtgggacagacttatcaatgaaccagtgagcactctcagaggttcctgagccccagtatgacttgttaatcccttttaaagcagtttggtatcctaacttgtaactcgcaaataatcatcaaatcatctaccaacccataccttttgtttgcttgtttgccaaatttactcccctgcaagctctacccaattggctgactcagtgaagtcagtggctcttcactgcttaaccaggataaatcctctcttttccctgggagaggatttggtgtctaggttttcacaggaagttaaacaccaagggtgcaacctatttgcagtattgctgaatctgtttgtgtaaagaaacttttagcctgcatacctgtgctgcatggcttataaattggggttctctattaaaataattcatgtttgcaaagctgaaggaggctggattctaatctcaggaatcatggtaccctccatcccttacaacacacatccatatgttaagttctattattattttatgttaactcaggaatgagggaatccagacttacaaaaataaagaaaataacttttattaagttcctaagtacacttatgtttctgtttttctttttgaaattctggtcaatctatttgttgttaccaacttaccttgtcacccttgtacccaggaattccctaatttaaaaagaaaataaaaagtaaaatatgatactctgaggcagaattagaataaggattaggtatttttcaattacaaggtataacaaaaacacatctatacagtctggaaaattagatcatagaaatgtaaactgttccacttctctttgtgcttggagaaatatacatttactgaggagaagaaaataatctgttttccctttatcacattttattctcagtttcaggtatttttccatatccagtttcttgccctttggcccaaaactagaggagataatgtacactgaaagtcattgtagaagtgatggcctataatggtcccttcaaaactgttatattgacttttaaactatgaactattgcagctaagaatgtttcatagagactctgaaagaaattggctttgaaaatgagctgagataatggcctttaaaatgtgtgtaaatatttgtatccattatggtcctccttacaaattcggtctaagatatataacatcaaggaaatgaaaggttcctttatcagccctaatgcgacagtgacctttaagctactgtcttttatctcacactaaataagaggccagcacttctactgtcttctgtgtgtcacccttgggaatcctgtacagccttttccattgtgtcactgcccatggccctttaagaaatacaatagtgaatattacatggcctgggaaatcaccagctctaagcagcagcaagtcctcttcaaatgggatttttttgtctttcatacagctatatttttcaaatatggaaatagaattgtcagatttattgagagctgaagaaacctatttaataaataagctattattacagttacatgtgagtcagactacaaaattttgttctatgcatgacttttttattaatactattatctatttatttatttatgtgtagagagagggtctcactatgttgctcaggctggtctcaaactagtggccttaagtgatctttgcacctaggcctcccaaagtgctggtattacaggtatgagtcactgtgcctggcctgactttttttacaaaaggaaacttcatgaaggaaataaaacttccaaatgtgtggtcaatgaggaatagaagataaacgtagaattctctcctatgagataataagctttttaaaaatacaagtactttatcttagttttatttttacatacttgtatgctttatatgtagaatatacctaagaaatgtttcctgaacacaaatttcagattttttgttgacattactaaactttctatcagattttttaatgaagttgattcaaaataccaagagaacagtttttaacatctctgggtctgagtccagggcacatccagggggacaagcagagaggggcaatgtcatatggtcttctttttatgcaccgtacacatctctgctatttgatacacttactgcaatgcccagaaaagtgcaaaataagaaatatactgtaattagttcttgggcaatatccactatcttctaatttggggtataagaaatcaaatagaatggtaaattttattatgtctgcagaattggattaacaaaagcatagtttagaccatgtagttcttatgctcctgaaattctaacttattctttatcttaaaaaacttaagaaataaagcaaacagttttctcattggagcctttcaccaatgtcaaattaagcatcagagaatttgatagggttgaacactcctgctcccattttcactctgttagctgagtattttctccccacatttccacttctaagatcatatctttctgattgccttcttgagccatcaagagcacaaggtagatagaaatcacttttgcacttgcactaagggggtcaaaatggtcaaccacaaaatcagtaacctaggatcactttcttaggaaggcattccagttgtgtacatacccctggacctctttctccagcttctcctttttgagcgttgccctgtgacaaacaaaaaacagtaaaaattccacagccctgaagagtgactgattgctcaataaaatgcattatacagaagattaatagcttagcccaattaggaaacatctttagtctttcccgttgacattttcactatgcaatctaggcaaaaaaaaaaaaaaaatagcaactcagataaactttgccctttgcagtgaagccagatgtgtagggtgcaggatccaggtaccttttcacagcttacaccacatcccagttgaacaacacagcgattgttctcaaatacatcattatactcacttggagccagtcactctggcttttctctaaggggctttggaatgttttccaaaatgtcctcaagagtgattgcttgatttcagcaagacttaagaaaatatattatgtggcacaaaattacaaaccaaagaaataaaatgtgaacttacatttataatgggtatttaacacaaaaaaaagaagacatgatagcatcagtttggacgtatataagatgagtgagtatagggttgtttggttgagcatgtgtgtgtatgttgtaaagctatccaaggctgctatattccctttccttgacaagcagacaattgccaaaaatgcttttatgcatttaacttttgatttttttcattacctctctaaaaactttctaatagggctgttttagagttcatttttgagttaatttttaatgtaatagttaactttgttagtatttgagtacctcttacttattgcctaatttttcccaaactatttgtgtcaagttacctgcaatgaaaagcaaaccagtttcactgccacattgctatcactagttattattgttttaatattgctgtgttaattgctataatgaaagaaatgtttttaaacgtcaaaacacacacaaaaacaaatgatgtgaactagaaaaccacttccagaaaaaaataatcctctggattccaaagtttctaaaatgtaagtatcactactaaaggatatctcattctctctatttaaatttattttattacctaatgaaattaaatgtgcttttacttttttctttactagttttgtttcctctcttgaaaattgtgttcagaaattaactcagtgtactgtagaaattaacccaatgtccattacatttgatgcaaatatttcctgatatttctatttctttaatattccttccttatattaggacattctcatgctgctaacaaagacacacctgagactgggtagtttataaagcaaagaggtttaatggactcacagttccacagtgctggggagacctcataatcatggaggaaggtgaagcaggaacaaagccacatcttacatggtgacaggcaagagagcttatgtaggggaacttccccttataaaaccatcagatctcatgtgacttactcactatcacaagaacagcatgggaaagacccgccccctatgatttaattacctcccaccagtctctcccaccacatgtgggaatcatgggagctacgtacaattcaagatgagatttgagtggggacataaccaaagcatatcactcccttttctttaattattatttttttcattacacagaattttgccttaaattttcacatagttatatctacttttctctttgtgattactgctgttgttcttgaacttggaaccaaaatcctaacaatgatctgaacagatgaatgttttctttaaaagcctgggattttttttgataggtacacagagaaaagaattcgagaagtccttgaagatgctctgggagtgagaaacaatctggtggtttttctatgattattgtcagtcagttaatcattaaaagtatacccattaaaaacacaagtgccagtgtcaatctgatatggaacacatattactagttgctgaatcatcatcctaaataagattggctgctatcgtttaagtactagtttctgtttattcaatgtccctaggtttcctaaacttactgactaaaatgttcatatatgttactcagaatttgtgaattcaagctaatagaaataagatagataatataggaagtggaaatcctgtattcttcacaaaagttgtcacatttttgccatatactacaatgctttttatttttaaaattgttgttttaaaaaaaaagtctagaaggagatacgctggtttaaagaaaagctgtttattcatttaccgggtttccttttggtcctcgctcacctttgatacctggatttccatgtgtaccctgaaggcaaagggaaaaaatattattttaagtaggaattctattgttttctatactttataataatttctgatcagttttgtttcctagaatgagggagaattgtaaaacctttacctgccaagcagaaattcaattctcttctccctttttctacaccaggaaaaccactgtcttgaattggcagattttctagatttgctcaaaagagaataatgtttctctcttcccaccaattacttcttcccaaaacaatcacttctcagcagttttgcaaacaaaatcaaactcatgcaaagatttaaaagagtagctgcaacaggcagaaggataggagttgttcccaatctctcttcattgtgggtcacttctacgattccctctgtcactcacttttaaaaggaccaagctagcttgcttgcctttggtcaaagaggttctgatatccaggagacaatctcaaaagatgggagaaaggagctctgtaatcctgttccagaaaagcattttgttttcctgttcctaatcaaccagaaagcttgcttttctgagaaatggtgttgggggtactcgataatgttaaataacatattctgtggcttatccctactaaaatgtgacaagaatgtgactaaaattgtcaggtgcttagcaattgtgagctttcttattgctcattttaaaatataaagaaatatttcttaccctggccatctcttggtgtcatagagataaacgaagactttataggaagggatggctaaacctttgctttagccaaagtcagcttctactggctgccccactatcatataacgcatctaactttgtatttggggagaaaaacatcccttgattggtaggatggtttgaaaaattgtaggctttggacccgagtctcaaggtaaaatttgtcacattctaattcattcacagtacacattcccctcccacccccaaatacaagcattagttgaaaatttttatccatgcattttgtgagattctccatagggcttcttctgaactctaaggatgatatttggaattatacaaataaatagaagactgaatgagcacgtgaatgctttatgaagataaatgttaaaaaaatgctcagcatttccagtgatctagatgtcatttcaaatgccttcccagtacagacatggcacctaccagttattaggccagaatataaagaaagcactccttcctggattatcttatcaaacaatgaatcatcatagtcaatcctgccatttatttttggttgccatgtgcttacttccatttcacagaactcaccctaatcccccaaagcatcgtgaccagcttcctgtccatgaggccacacggtgttgctgctgcactgctgcattcgtgtgaagccaacatttaactttcagagaggcttgtactccatgtttctagtaggataaagctttgcttaaagcactgattatttgtattagctttttctgtattcacttcactattgagaaattctggcttcaattattttatgaggaggaatataaatgtcctttgtgggaacaacttcaaaacacacctgccctcagttcaggtcagtaaaatcccaggcttatttctaaggatagaatgtgtccctttagaaataaaagaaagaagtagcatttccatttttcctcccatttccaaacaattgcttttcagcagtgcaaaatagccccgatgttttcaagagcgagtagagctatcattgctaggactttctgacttaagttcaaagtggaagtatactcacaggaggccctggatcacctggatctcccttctcacattcacaaatcttgcgttcacactgaatcaataatgaaatatgatattaacacacagtgaaattcaaattgtatgcagcatttcaaattgtatttcaaatacatttcaaagtgtatttcaaataaatttcaaatagcatttcaaattgtattcagtatataaccaactggagcactctcaaagaaattttaccttgcacatttatggatgttttgctctctctattaaattattccaggcaaatttatacctaccaagagctagctaacaaaatattattaaatttcagcatagttaaataaaagacatcccatcaaaaatacatgtataatatatagatgccagttaaaaggagaaaataaatattttcagtggacttttagaatttctgatccttctcttctatataacacatcaaagctcaataatataataatattaaatgctcctttactaggcaaaggaaaacatttgacttatagcatattttactaattgtaagataattgtaagatgcaccttcttcctcattttaacaactctgaaatcagaatgagtcttataacagctgttgaccaggttcagtcatgacaaagtagttgctttttgcacatgcacttcaaaacttacagaatgaaatgggagaaaattccagaacatacttaagaaatgcttcatcaccaatggttttgctggcatagaggtcagtattacgcagaaaaacaaggacatcaacaactcagacaaaaaatgattcagatttaccaggggtgtctaatcttttggcttccctgggccacattggaagaagaagaattgccttgggccacgcataaaatacactaacactaacgatagctgaagagcaaaaaaaaaaaaaaaaaaaaaaaaaaaaaagggccgtgcatacattttataacgtttttaaaaagtttataaatttgtgttggtccgcattcaaagtcatcctgggctgcatgtagcctgtgggccgcgagttggacaagcttgatttagagtctgatgtgaagaagttttagaaataaccaagttattttgcttacatattcccttatatgtatatatgaaagtgatacaggattttaaaatctacatccaaaatgtctaaaaacttatttccacaggtataaaataaaaagtgcaattaataagaagacactgtatcatagataagctagcaagggttttttcctttctttcttttctttttttttttttaaacgggagtctcactctgccaccaggctggaatgcagcagcaatcttggctcactgcaacctctgcctcctgggttcaagtgattctcctgcctcagcctcctgagtagctgggactacagtcatgcaccatcacccccagctaacttttttgtatttttagtagagacggggtttcagcatgttggccaggatggtctcgatctcctgacctcatgatccacctgcctcggcctcccaaactgctgggattacaggcgtgagcgaccatgcctggccgttttttttttcctttcttaatggtacataacataatggtatatccgaacatgtacaattcaataaaacatggtgtgacgtaggtttggttgactcctattattttatgcaacaatacttgtaaatttcctgatgttaaataagcagctcattgaacaaagctcagatgttccaaactctttcttttaagaaatgcatgtccaggacaggactcctcagcaagctgatgattatctattgtgctaaggctcgtccaatcttattggccagtttcctttgccacgtggtctggttgccatcatcaggctgccttttcttcacaataaggagaatgagctcaaagtcaattggcaggcagcaggggatgactctagactctgtctcttagctgggaaccctctgcctaacctagccaacaccaggaacaccccccaaaatagaggacctgatgtggctgatgtcagatacatgcttagaataaaggaagcacatcaaagtaagcaaaaactatgtagtttgctcatgactgatttctaaaatcactcctggagtcacattcaatatttcctactttttctaaattttccaacttgcattgaatatggtagtataaaagaaatcagatggctgcctcagaatagagtggctcattttaaaagaactaagcatttttatttagtcacacttaatcttctaatgtgaattataatgctgatttgataatgcaagtgtttggagtaattcgtagtaatcaaagcatgtggtgcttaccttcttttcaaataagatatcctacaagggaaaaaagaatgaagcattaactcgattgatagttctgcctccagctacttattagtcataactattccctatgggatatgaagtttccacaaagaatagcaattcagcctttttaaacttgtaaaagcaataaaaccaaccagccaaccacccaaggagcagtccgagccatgtaataataagagatataactaccattaaaaattaacctatattttctaggaacttcatcttactgcattctatgttttatcttttgtttcctttatcagctctgtaatctccataatttgactataaagttaatcagtcataatgacaaagctctcacttttacatacaaagactgaggcagaatatataattgtatattttcaattttttccatccctatgcacatatacatgcatctatttttcatgatttatttttcaagattaaaacaatatagtcataacttcatgaaatattaatgggtgttagatcatattaaaactcaaaaagagaaaattacaaagtccagtgacattttttgagatgatctgaattatgagaagacaaagatttccattattatgatcactaggggaggagttttctatttcaaatttgaaaagcctccaatatgatactttatttacagaatttcaacagaagccaaaaaagatactcagcttttaaatttaaacagtattaggaataatattttggtaaaaattttgaactgttcatagcaatatgcattacttatgtaaaagaggacttacatttataactggctaacttaggggaaaaactaagtgatagaaaagtaatacatatttcataataaaaaatgatcattatgaaaaacaaaaaaacaaatttaatgagtcttagtcaatcagactcaacctcttgctttgcaataaggaaacatggttccaccataatgtgactcaactgaggtaacacacttgggctgcacctcctgaccgtcttcagtgcatgtcatatgtaccatacaggaatgaattagccagaatatttttcaaaactattttaaatttataattttgcagaaatgtcatgatcttgtttttgtctaacacctaggcctcactaccatacttgaattcagtgggatattacctgacaagtgcactgaaggctgtgttggaagacaaacgctggaaagaaactaatctatgtttatatatagaattagtactttcttaacctagaaattatgtgtcaaaccagtgccttgtgatttcatctgaaggggtaatttacatacgataaaatagaaagatgaaggagcaagcactggaatatttgttgcaagatattaaaaatgcagaagctaacaaggaagttaaataagagtatgtagctttatgaaggatgctgcatccctttagttttatttttactttatttccgtacaaactaatactatagagggacgagataacaaaatgctttaatgatttaatagggaaaaaattaggctgggaattaagtgtcattctgggtttccatcccgtttcaacaattaactagctatgtggccttggacaagtcatacaatccttccaggtaattttctccatatataaaaaaggacaaagtttgactacatgatctcaggagctataaaaccctagccacagacactagctacaaaatttagagtctcacctaccacccctcccaaccaaacgattttaaattactagccatgtaaatccaggctgaaagcagatgagatatttgtatctttaagagctaggaggtcctatggagaaataggaactcagatacactgatagttttagttaaaatggtattaccctctgtagaacatttggttatgcctacaaggctgaagatggacctgctttatcacgaggctgccaggacaattcttgcttttgcctgttatcctgacatcctttctagacataccacagggaaattcttgcacttgcacatttcagcattcattgttttttgtaatgaaaaactgtaaataaaataattgccaatagtggaatggatcagcaaatgaaatactactcggcagttaaagtgaatgcattggatctacacatttcaacaaaatttccaaaaaaacattgagtgcaaaagcaagttgtagatagatacatacaatatgatctgatttattaaaatacgtaagatatttcaaaccacgtcagagagtggtttcctctgggagaaagagagagaaaagaaattcaaaagaagttcaacagaggcagtaaaacaactaataattcaagtcaaattgtaatatttaaaaaccactactgaaataaagaaaaatttaaatatttgtcactttaaaatcttttaacaatgagcaatatcttttttttttcttctttttgagatggagtctcgccctgtcacctaggctggcatgcagtggcatgatcttggctcactgcaacctccacctcctgggttcaagcaattctcctgcctcagcctctgaaatagctggaattacagagcacgccaacaagccagggtaatttttgtatttttagtagagacagggtttcatcatgtcggccaggctggtctcaaactcctgacctcaagtgatccacccaccttggcctcccaaagtgctgggattacaggtgtgagccaccgcacctagccacaataagcaatatcttaatcaatttttaaattcacgaattcagctcttactgtgcctgatgtgtaattttatacttttttcagttctttcttttaaaattcaatttcttctttgccatattgctctttagaaatatgtggcataaggcttaaaaccatagcaatgcaaaaaactatttttggaactcatttaattttgtgtttgctggaatttatatttctatggaaacaaaaatgaacccaaaactacacaatagataagactgtttcaaacaaagaacaaagccccatccctgagggctcttataggctataagccccaggaacagaggacaacacacagcaacccgagtaggaaggaggtcctaggccaggggcgggggagccgctaacaagatggcttcttggaataggtgggttttctggatggttttgaagagaggaatgcaaaggaccacccattgatggtatgctgtcctatatgtcaaagttgatgaggaaaaaagtcataaggactagtgtgggcaataagacaaaggaagtagttatgaggaacatttaaagggagtggatggaagggcccacatggacagagccggaggccttgggaggtggcgagggcttgcactcaggcagggaagcaggctgcaaggagaacagtgtcaaagcctgacgggaggccatgttcaatgacagactgggggcatgcttgagtttcaatgaaaaggataaatagggaaagggtctcatgacagcaaaagaagatgcagtcagaatttcattaatggattcatatatatggcatatattcacatatactatatatgcaaaaccagaatgctagaatggaatcaccaatttttcaaggagtataaggtttatgctgtgagaaggggacagaaaacatgtgagggatggacaaatatcacagcacatggaatgacagcaaagcactcggtaggcaaggggaacaaaccctgtgacaaaaaaattcaacttaaaatggtagcaaaatggccactataaaatctaaaacagaaaaataaggccctaaacagaggaagtcttgaaaaaatggaaagtgatcataattaatagattaagaaagcataggattctaaagatgatatagacatcatcacattgatctcttcttggtatgtgagggagggaataccttaaatttatgttttttaaaaatcgttcagaaaaaaagacaaatttgtcacaacccttatttccataaaggctttttaaatacttaacatcaaaggcaatagagggaaaaaattgtctttaattttcacatatcctctcttactcttctacaggaccaagtaatatatccaggactttggaatgaatttgtttgtttggtttcaatactattatgtaaattataataaaaatagcaataaaaatatattacatgtcttcttcaatttggagtcattaagtctcttttgagtaattcagaactaaaatgtttctatggggttcttacatgataattcctactagaggcatcaaggaatttgcaatgatttgttttgtctttgctcctgaagaatctattcattctgtatactcgtgtccattaaattcaactaaagtctattctacaataaaagggagtaaacttctgatacagaaaaaaaccctgatgagtttgaaaatcattatactgggtacaagaagcctgacacaaaaataatacatactatttgagtttgtataaaattctagaaagtatacactaatctagagtcacaaaagtaagatcagtagctcaggagcaaatggggtcttacaaagagatatgaggcaatttggggaggtgatggaaatgttctctatcctaattgtgttggtagtttcataggtgtgtacctatgtcaaaagctcatggaattgtgccctttaagttaatgcagttgtgtacttaaatcatacctaattaacttatttaaaaagtcaactacataattattttaaaataaaaagtttaaaaattcaactaaagatgtaatagaaagggattagataaagaatttttccaatggtctcatcaagagtcaagttctgggcccggcgcgatggctcacacctgtaatcccaacactttgggaggccgaggcgggcagatcacctgaggtcaggagtttgagaacagcctggccatctctactcaaaaatacaaaaaaatgagccgggcatggtggcaggcgcctgtaatgccagctacttgagaaactaaggcaggagaatcgcttgaacccgggaggcagagtttgcagtgaaccaagatcgtgccactgcactccagcctgggtgacaggagcaaaactctgtctcaaaaaaaaaaaaaaaaagagtcaagttctgccttctagatggtggcaatttgtaacattgaaagttggtataccattctttgaagagcctaataagcactttggatcctgtaagtgtttggaaagcagcacctccttctaaaaagtggtttattcatggagcttccatctgaacaaacaagctgaaatcacagatgctaaacaaacaagctgaagtcgccggatgctaaggaagagcagtattcagtcattttctgtttgcccaggaacagacaaacaattttgcttccagtctactgccaagagcctgtgttctcagtgaagcaggtgctctcagcgagggtgtatctggtgggaatatgaacaacctgagcctacacctgtggccaaacaaggagctgcctgtcccgcatcttctatggtcagctcttatccatcttaaggtgaagatgaataagtaacaacagcccactcatgaccacatcaccaggattctctcccacacgggctggagccctctgttttatgttcagtggtgaggaccccttaagtcatggcacaggcagggctaagtgttagccaggaaccactacaaatttccctttcatgcaaaagagctgctcagaatgagtacttaccttgagcaccacaggactgggcccatcagctctatctctgatctaggcataactctcccatttaccccgaatccccaaggaaaaaaaggctagaaacaatagtaactttggaggagggctgctaccaaactgtttcagagcagttctgattgagaaaatatttttttaaaaagcagttactatttcctctctcaatatgcctttatagggttaagcatgcaaactgtgaggtcttcaccggccttaaattttcaactacaaaatgggtataataacattacctacatcataagattgtggcaaacattgaataaaataaaatatataaagtgttcaggaaaatgcctaatacagagagagtactcaatacctaagagctattatttaggtaagaaaacctcagatcttatgctgaaagcaacagagagtaaaaagataagagtaatgttgagaaaaagatcgagggataagacaaaaggagcaaaacaatctctgaaatagagcctgagttttctgtgcaagctgtagaaaacagccatatgaaacgctcagtacataaaggacacctttgccttcctttctcaggaaatcaaagaaatccaagtttttaagaaaatcagtttttaacactcagccaatcaaccaatttatctctaggcgttttctccttgagaaatattgtgaagagggatttccttttgattgtggtgccgtgtgttttacaaagcagcaaggaaaggcttttatacacagctgagcaacaaacaaagaaaagctgaccagacctatcaagtgggactcattgatttgatgggagaaactgttgcttgactgcaggttgcagatgattttaaattggatgggcttgagaacatctaagaaagaaggaggtaattttaaaaattggaagtctatgaactttgagtagcataatgtaacaataggtgagacagagtcaaaaatactcagtcctttagaagagtaagagagaatatgtcaagattatgtcaaaaatacctgtacagatgtggaatgggaaaagaccaacttggtacaaatatagcctaacacctcaagttgagcacaacctgaatataagtcagcaatgttcatgattgtaggctgtataaacaggagcttaaggtatatgattggaaaataaccccttccaaaatcctcagcatcagctagcaataaagttaaaaatgcaattccagggaattagcctggaacttttccagattgtctggagtaaactgccaagaaagtggagtgacacttcagaaagattcttctttctgttttcagtgttaactctcattttctccatctttttgacccagtatctcttcttatgggatttacaacaaatatgtcaatattatgatgataactgtataatcaacccattaggtacctaccagacgatcttgaattttatctacaagggttggatcactcaacagtaaagtgggttcactggatgaatccccagaaatcaaacgaagtttggcttcattgactaccgtagaaagtgcaatggtgataaatgatattcctgaaattctggcatcttcagaaatactttgaacatctggattctttggatggtcgatgccatcagtcatcagcaaaaccactttcacaccatccttacgcccttctctcttaagtagcctagtggcattggaaatggcataataagagaaggtaccttgccctattaaattcatagacttgaccttctgcttaaatgtctgcaggtccttccaggaagaaaaaggtggatcaatttggacagagctgctaaactgaagggctgccagtttgatgtcatattccaaggagcgaccaggagtcaattggaaaatcttgtcactcaagctatccacaaaatctttctgtttatcaaagagggcaattttagaactttcagagctgtccacgatgaagacaatatctatgaaacaaatggagcctgaaacagaataaacaggttaggcaaaataattattcctatcatgaaacaaatttgcatacggaaagccctgaagtggtgtgttgtatattgtttggtgttgagagcagcgtgaggagagaaagagagacacgttggacagaaggcttcaattgtaaaaaactaaatgtctaagtttatgaattattttctccttgtaaaatcatgcaaattaaaaataaataagatatcttttattctgagcatcttttcaatgttaaacctgctgaaagtgggaggaaatgggaagtcaagatgcatcacattttaaaaatccaactaacactgagcatagttgtctagaagtaaatgatactctaattctcaggttgtgtcatattggtgagtccctatttttttttaaactttcttgaaatcaagggagaaaatgactataccccctataccaagagtaagtggagaagaaacctaacttaaacacaacttaagtttaaatcccagctctgtgtctcagtggttaatttgcctatggccttgagtatgccactcgacctgttaagacctcaatttttttaatctacactatgagtggcaatctccgtcctgcctattttacaaggttactgtgaggctcaaatgagataataagtgcacaagtgctcttattaaagactctgatgtgctataagtatgtaaggtatattatcatcatataattttatcaaagtagactatcacatgtatacatgtatatggcttgctatttatatcaaatgctatttagaaaaattcacataagtatttttaacaggctaaacttaaaaacaaacaatttttttttttttaccctggacatcacttttccttgcaagcaaatttgattttggtcctttctttctttgtccggatactgtttgactcgtaaacgctgacaaaagcaggagatagaagacaaaatatctgttccacattatggtagatggtgaaaaatcatctgtcttgtagcacctttaatagaaaagtcagttacaaatactttaataaaatatggtgtttgttatttttaaatttcaagccagcagggttgaaaactggcatgtgactggaaaaaagaggttttcattcatatttctagaaaaatattcacattgagattttgaaagatttcaatccaaataaatcatggcaccatgaccaaacatttattagtgaatatttctatatattcaaagaactatatttaagtattcttaattccgcattgtattttgaggagcatagagttgggagagccatttaaaaacatttcaatcccgctctatatgattactgtggttcaatcacagggtctgctttgacatttccaaattcttcagggggaattcagattgctatatggtcatttcattcactttcattataactgattcctgacaaatctagtattttgtagaactgtagacaaccaccaccctttcaggcttaatactacacacataacttcagtgagttcagaggtcaaggtaaaaattaaacgacccttctgtttccatagaaccccatctctcttttctaccctagctttggaaactttgtctccaccaggggttcaaagctgcatatgcaatgaatcaaaagagtatgagagcaaaaataatagatttgcttaaaagcaacactcttcttccagtgatggctaaaagaactaatggacagaaacgggacttaaagccaagaagcaccccctctgaatagccccgtgaaactatttttctgggtggattaacaacgaaaaatctaattctgtattaaaatcctcaatcttcatcagtcaatatgcctagctacacaccaactgactcttaaactgacagatttccctgggaggagaagactcatgtgttgctgcctcagtatacccaagagaatgggaacgagaaagcttatttcgaatcaatacttagtatggcttaaaaatgcttgcctgctgaaactttattgacttcaggagttctggaaaaggaatcacattttccttctttggcaccttgcctttaggggataagaatctgggaaatcatgagcacgatttttccagactctgagtagagagtggaaatatatgcaaaggcagtgaggagtgagatggagactgacttttttcatacatgccagatggataaaccccaaagggaaacaaaactgttgggttaggagaggaccaatggatggcttcatgccacagtctgctcctcacatagcatcatccagctggaagtgtattaaaagaactttggataggtatgaccaaacatcttgtgtagcaattggccaaatgccaactgatcctcagacaaggtatactaaaatgtaaagacagctgggtattaaaaacaaaacaaaaccaagaaatgtgctaaggaaacagaacacacaaaggccatctctcctcaagttgtccctttgctaaccaaggaaaaaaataaatgatgtacaactttaagtctgaaggttagtgtaaagataaggctatgtgaaaaacacagttgttattgcattttcaaaggggaaagggaataacaccatggccatggtattacatatgacttttctctttggttgagttcataccataaggaacatctcagaagttctggaaataagaggctgagaactgaattccattgagaactgagcaagattttataagcaacataatcaagcaactcttcaaaacccttcatgtaaggttttagaaatactggctttaaataaagatttatcttttcccaaaactaagcacctgctcttactgttttcttggcatataatcatgaatttgtacctgatccctgtatatatgatattcacaaacataacttttccattgacaataatcccagtatctcatattttgttcttatttgctctgacattgttaatctagctctcccaaaccaaagtcttgttatttctttctgtttccctattgtagccagaggacattttcatacctctctagatttgtttctctagcttgttagttctactgcttccctgaaatatctttctcgtttattaatttggcatcttgagagcccactcatttctaatcactttttaccatgttttattttgcctctgtttttaataattctcacctttctctctttctgatgtcacgtacaagcaaaataggtttcagaggaaacagtgccattagttaagtgaaagaaatgtgaacctctgtgtttactataggttacattttataaatgcagaaacaatcataattattaatcaaataccgtagttttacttttggcctaaaatttatttggggtaaatatcaggatcagtaaataaatccaagatactttattttttataatttttcaaaaataaaatgatcttatatcagagttcaccaactttagttacaatgtttgcatctcagtttctacacaaatagaaaatgattgaataaagactttattcaaattgacaaattagccaagttgtaaagtattctataactaattctgaattgtaaaccctgttccaaattaagaaaaagatgtcctaaaatatattaacatcgttgtaaaacaatttagaagactgtaaattaaaaatccatttcaaaataattttaagttttaaatttctacattttaacaatgttaatatttttctaataattgatttgaagtaattgcagagaatacaaactattgacaagctttctcacctaataattatgtaagtaagtcatttagtcttccacagttccttgatggtcctatctgatttcaagtgactaaaataaatctgttatgtcttaccttataaagtttgtcaaacaggaattaaagactagttgagtaaatgccaacagcaaggactgtggttgggggtgaagttagctatttgatattgttctgttctgtgggaaataaaagtgtctttgctttaggatcttttgcagtcttttgttcatgtttattcgactaagtcaaagcaagagtggtcaggcatttggccagggtgcaagatctgggtgggatcagtaagcaatttaaaggaacagtgtcctttcagaatgagactgtgttttccagactattgtaaaaacaacttgagagaactttctacattttaggcattggttgacagcctgcctttttttctcatgctatgtccttctctttttattgctacatttctttgcctgggggatgtgctctaagatactggttctgaacatctctgtgaaggagtataaatgacaccagactcagaatcaaagctgtttttttaagagaggtaacagtttgattgttattaaagctggatgatgagtacataggtgtgcattgttctagtctttgtatttctgtgatttttgaaattttttataataaaaggtatatataatatacagggaaagagtggtctgagtatagtcatagttctgcccctaacttttatgggggcttcagttccccacttatgaaatgagagagtagatttaatcatttattaagatgtgttcgaactgtaacatgagaggtttacagcggttaatattttggtctctctctaggaaaggatcactgtggtttttccactccctgtttccctattttctaccttgtggttatggtccatattaagtcaatgtttatcatgtaatatatactgccaagaagccacctgacccctagacagctaacaggcaggcttctccacggacttcctctgaaatagagaatagcaagatcatccgagaaagcaatacaaatgtgcatgttacggttatttaaaatgaactttcttagccattttaatgtgtatgaatttccttattacagcaataatagcctccaattcatggacacttaccaggtgctaggcactgtcctgagtgcttcacacacattacctcatttaatccttcacaagcacaaccacctatatacagtaagtcctcacttaatgtcctctgtaggttctggaaactgtgacataaagtgaaacaattgataatgaagacaattttcccaagagctaattgatataaataagagttaagctcttatggcatattcctagtcacaaaaacatcactaaacctctaaatactcaaaacacctctaataataaacattgaaataaatctaagctatatatacatttatgaaagattgataaaaacaagataactgcttacctgcatattccagttcagggtcacggttgaccagatcctgtcccagcagctgaggatacaaggcaggaaccagccctggacaggatgcagtactgtcaaagggcactcatacacccacccactctctcagacaggcaccatgtagacacaccaatgcatctaatgggcaaagctttgggatgtgggaggaaactccaggacctggagaaaacccacacagacatggggaaaacatgtcaactccacacagtgagcctggcccaggaattgaattttttttctcatcaatgttataacaaaatgacattgaacaaaatattattccaggaccccttgtacttagtagatgttgtaagaattcgaatttttccaagatggaggcagagagaggttcagtaacttgtccgctgtcatactaaaaccagagaatggcaaaatgaacttttaactcaggctggtaagacctgtgagcctcacttataacaactactgcatcattaagtatctatgcgaacgtctgtgttttcactgtctcctcctcacaaaacaggtttcgaggaactgaggaagttttgtgaggctttggtaacagaaagaagaaacggtgggtataatgcagaaataacaacggaatttcctagggaacaaccatgtatttacctgatagcctatgggtgttagtcacactttttacttttgtaagatgagaatcaagagacaaggaagtagcatcttttcaggtcaactctctttttgctgaggcaggttaaaaacatgcagaataataatgccactaagaagcaaacaggtgattcctagatgggggaaatggactaaagccctcctgccttggagctgttttgattaaagttggtgggaggttggagtccaacttagtcatccattccctttcattctccaacattaaatagggtaactcaaaccaaagatttgccacctctcattctcaagcgtgaaaatcagcactaaattaattgggaagattatgcaaaataaaatcttcagtttcatcaatctataaaagacaattagttttgcacccagagaaacaatgcaccacaatcttaatcccaacagatggtcttgaattagtatgctattggacttacaccagaacaaataagagagcatggataaccataatgactagaaaaaggcaacgtggagcccatgcccttctgacagttattttgtagtaaaagtctttatggaagaaatatagcacactattttcattgttactactataaatagcccagagtaagcagtcatatttgtgaaataaatgattattagaagtaatttttagtgtttatcagtcacttgaggtctgtgatacaataaattgctcttctccaaagctctgctagatgaaaatcttttttcaactttttcaaattcttttaatatgctaccatagtagcatctgcattgtgtttattgattctagtaccagtgccaacatcttaatttcagtggtgatgatattttggggtcctagaatcatttaaaaagagacaagtctgctaggacttacatatttcagagaattgtatctgcatgaagtcatagaaatacacacaaaaaaaggctggtaacaaatcaaagttatatattttgaccaagattaaggcatagtatagtttcacaagcttctccctattttagccacctcccacactgctgatctagagtagaaaaaaaaaaacattaccaactaacaaggaagaaattaatgaccttcgtacctgatttgaagaaatttgttcttgaagatcctttcctttctttctttctttttttctttttctttctttctttctctttcttctttttgtcagtagaaaagcttgatatagtagaatttctaacacctgccccaaagctctgaaatttctgggattcattatccttggacccagaatatgacctaggcattctctcaactccttcatcagtaattagaggaacactgtcttagtccattttgtgttgctataaaggaatacctaaggctgagtaatctataaagaaaagaggtttatttggcttacaattctgcagtctatgcaagaagcatgacaccagcatctgcttctggtgagggccattgactgcttctactcatggcagaaggtgaaaggggaccagcgtgtgcagatcatatggtaagagggagcaagagagcagggagagaggtgtcagactcttttaaagaatcagctcccccaggaactaatacagagagaacacactcattaccgcaaggatggcattaagtcattcataagggatccacccacatgacccaaacgtttcccatcaggccccacttccaacagtggggatgaaatttcaacacgaggtttggagggggcaaatatgcaaaccatggcaaacaccaaaactgtattggtcttatttgtcaacaaagggaaagattaaaagcattcaaagacaataagaaaataaaaattatcattggtaataaaatacaggatgtggcattgcttaaatgtggaacagcgtgacttcagttcctatgccctcaccaaattctgattgagttgatccttccacattccctctactatttttcaattgttactattatttaataaactttatggtttagagcagtttcggggtacagcaacacggactcaattatcttttatatcgtttactccctaagatctcttgcttcattatttgtcattcaatccccagcttgaataattgtgtcacatttgcaacacacagtgcctcataggctacagtgacaggctaaattcccgttataccaatcttatgactattaatctctttctctaaaatattttttcaatattaatatttcttctttccatgttgtttattcctgactaaatgcaattattttagaccaaaaataaatcaaggtgccatctggaaagttttacaattttttttctaagaaatatctgaaagtagattgatctagtcctatcataggtttgaatgttcaatatttttctttaattattttctttggtcaatggatagagcagttttaactttttcatgcagagcctacaaatagagaaagatcagatctatttataccttgactaaactctgctttaaatggcaaaatatttctatttttcacttagttcattttactttcagatattagacagtgttattctagatcttggtgaattatttgataaccactgattggtatttaaacttttcttgtattggggacaaacaatagtgttaaatctctgaactggaaggaaacttagaaaccacttttatttaattctgccatttcacagttgataaaatagaggacagatattaagacccacccaaaggtcaaatcattaatcagtgagggactaaaatttaggtctttgtgcatcaaagtggccatctttcattatctctaaatgccctagaaaatttttaggcctttgcgctatccaggcttgtgcttgagcaggagaaaaaggaagctgtatggctaataatttatatttataaggatttaactttagtggcaaatggctcagaacaaatcatcatgggctaagtcccagcacattaaagagtctcacctctcactgtgtaaatcttagtgcctgggccattaaaggcaatgaacaccacctcttcgaaccctgggttgaaaaactttctcctccaggtttggacaggtttatctgagtagctggggattgttacagctacttcaataactgatccctaatcaaaacatagccagtaatataggtagatatcatcatttgcatgaatattaagttgtagaaacacaatacctacttgggttttctggtcagtgtattgagatttaataagaatatccaaaaaaagttttaaaataactcttctaaatttctggaataaaagtgttttaagagcattaagtaacttattatcccatgttatattaagccgttacaatgctggtttacacaacattgttcccagttaaggtaatagggtcatctgtttttttcattgcatctaaattatatagttcctcctgcacaacagtttgtttctccttctgcccttagaaattctatactaagggtaaattattcatggacaaaatttatagaaaaggggacttgaggtgaattttttttttcctatttggggatatgaacaaccttttaataatactaaattctacacagaaataaagtacctattatcattattcattgtttatatccagaactatagattttgaaatcacatatataatgttatttaatgttgagtaacttttacttaattatatattttctgttattctaattgaccaaattcagaaatgccaaatactaacacaatttagtcaggactctgcatgggtcttcaggaagtgttgtttgaaaaaagatatttgggcaccaccttgtgggactttgtagaaagacatagtgtgagagtttgtcaactattgttaacagatgaaaaattttaatcgtctgtgatgctgaacgggtggaataaaagttgctttctacagcttttttgggcagaagaatgaggagacgaacgaaagagtgataaaactactcttatataggatcaagaagctctctaagtaacatctgatgaaatccataactcattcacttaactaacatcaacttagtttctactatatgtgaggcactggatagaaaacagatagatgcagtcacttcaacccagtgaagaaaataagcaagtaaagagcaatggcaagttttacccaaaaaaaaaaaaaattaagtaatcacatatctaactctagttgacaataccatgctgcagggtttgggaacaaaatttaccagtgtctgcaacttactttgaaatgcatcataaagaaagaagatggggctgggtgcggtggctcacgcctgtaatcccagcactttgggaggccgaggcgggcagatcacaaggtcaggagatcaaggccatcctggccaacatagtgaaaccccgtctctactaaaaatacaaaaattagctgggcgtggtggtgcatgcctgtaatcccagccactcaggaggctgaggcaggagaattgcttgaaccagtgcgctgagatggcaccactgcactccggcctggccacagagtgagatcccatctaaaaaaagaaagaaaaagagaagaaaagagacgggtagaagaatgggtagatgggtagattatgcaatagagcaaatatgttcattgtaaatacaattgtgaaatctgggtggcaggtaatgggtttgctgtataattctgttaacttttctgtatgtttgacaattttcataacaaaatattaggccaaaaagagcaagagcaatatagtgtgataacatctataaaagagacttacacagagggcacccaggtcagactgtgatatggaagttggaagtgcaggagcagaggataaacagtggtttcttttatgccatgttaaagggtttaaactttatcttgaaagcaacgggagccactgaacaattttaagcagggttgtgacatgatcacactttcatgctaggaaaatcactctgattgctgtgtgaataatggcaggaaaacaagcttggaggctgagatctactaggaaacttactatgacaccaatgagagataaggctctcaagtaccagcaatgagaatgcaaagtgaagaagtctaagaaatattaagaagcagaatcaaagagcttagtacctaattggcctaggaaagtggaagaaatgaaggagaaagatggtacccagcagtctgccaaaaagtatttaataactgtctctctggggaaaaaagtgtattgtacacatatacatacgtaagtttatcagaaatgttattgataaagaacgtatggtataaaattttcaaataataataaaatacacaatattctctattataaattctatatagcaaactgattcatacagattgctttcattgatttttggccaaattcttatatctttagccaatctatggttgtaattgatgaatgagtatagttccaacaagaatgttggttggcattttcctcttcttgaacaagtaagacaaaaatgaaacaaagaaaaaggtgcatgtgcattgaaacttcatttgtttgtcaatgatataagcaactttgtagctgaataatataatacttttcaaatactgaaacattttcttagtttttttcttattcaactgttacagataaaatacacttttgagtttaatctgcattattgttttctccatcactttctttggcctagacaataaataagacagtaattcaagccctaatttgtagcagatttctattgtgtaaaaagtcctactatgtcagatttcaaattactaatgtgacatcactgaacacagggttgcaaagagaaacacaaatatatagcagcataccactatgcaggatttccatcatatagttgccatggatgcaaacaacttcaagtacacacacaatagtaagatttagtaaataattaggaagtaatgagttttgagtatttattactattgtttttaatgtaatttatttacttgtaagttaaatatataatacaacatttaataatatctgcggttaacaactggctcaaaaaatttctggaaatttagcagttgaccctcacaaggtgacatgagccatcttcagcacaccagagactatacctaacttccaggctgtgcggtgcgctcttgcctcttaaaagagtacagcacacaggtctgagaattggttctgccactttttgacgctggacctgtaagttctgaaagccttacacagtttccacatccgcaagtgaagactatgaggaggagcccaataaaaataaggatagcaacagcagcatccgaatcaacaacaaaaataacacctctctcacagtgttgtggtgagtatcaaaagagctttgtaaacagtaaaaatccataaatgttctgtaatttcaaaaacaacttaaaagacaaactagtaaaagaacagagattataacaaactatctctcagaccacagtgcaatcaaactagaactcaggattaagaatctcactcaaaaccgctcaactacatggaaactgaacaacctgctcctgaatgactactgggtacataacgaaatgaaggctgaaataaagatgttctttgaaaccaacgagaacaaagacacaacattccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagcagaaatgaataaattcctcgacacatacactctcccaagactaaaccaggaagaagttgaatctctgaatagaccaataacaggagctgaaattgtggcaatgatcaatagtttaccaaccaagaagagtccaggaccagatggattcacagccaaattctaccagaggtacaaggaggaactggtaccattccttctgaaactattccaatcaatagaaaaagagggaatcctccccaactcattttatgaggccagcatcattctgatatcaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatctctgggatgcaaggctggttcaatatacgcaaatcaataaatgtaatccagcatataaacagaaccaaagacaaaaaccacatgattatctcaatagatgcagaaaaagcctttgacaaaattcaacaacacttcatgctaaaaactctcaataaattaggtattgatgggacgtatttcaaagtaataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaggaggaagtcaaattgtccctgtttgcagacgacatgattgtgtatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccagcttacaagggacgtgaaggacctcttcaaggagaactacaaaccactgctcaaggaaataaaagaagatacaaacaaatggaagaacattccatgctcatgggtaggaagaatcaatatcgtgaaaatggccatactgcccaaggtaatttacagattcaatgccatccccatcaagctaccaatgcctttcttcacagaactggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttaacaaacctgagaaaaacaagcaatggggaaaggattccctatttaataaatggtgctgggaaaactggctagccgtatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatggaatctaattaaactaaagagcttctgcacagcaaaagaaactaccatcagagtgaacaggcaacctacaaaatgggagaaaattttcacaacctactcatctgacaaagggctaatatccagaatctacaatgaactcaaacagatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgttggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagaactctaaatcatgctgctataaagacacctgcacacgtatgtttattgcggcattattcacaatagcaaagacttggaaccaacccaaatgcccaacaatgatagactggattaagcaaatgtggcacatatacaccatggaatactatgcagccataaaaaatgatgagttcatgtcctttgtagggacatggatgaaattggaaagcaacattctcagtaaactatcgcaagaacaaaaaaccaaacaccgcatattctcactcataggtgggaattgaacaaggagatcacatggacacaggaaggggaatatcacactctggggactgtggtggggtggggggaggggggagggatagcattgggagacatacctaatgctagatgacgagttagtgggtgcagcgcaccagcatggcacatgtacacatatgtaactaagctgcacaatgtgcacatgtaccctaaaacttaaagtataataaaaaaaaaaaaagaaaaggtgggcagcaaagtcaaaaaaaaaaaaagacaaactacactagaacaggttcataatatataggatcagtatccagaatatataagaaaaagaaaaaaataggatatgaaatggcagttttttagaagggaaataagaatgtctaacaatcatatgaaaaaatatttactctcattagtattcatgaaaatgcaaactaaaagcactgagatatcatatgtttctcattagattgacaagtttaaagagtgtaataaagggttagcaaggatgctgggaaatgggacatgtggtgggagggtgatttggtaaaactgcattacagagcaactgggcaatatttgttaaaaataacaaagtgtatttttttcgcttccaggaatataccctggagaaattctagcacatttgttcaaaagacatagacaagaatgtttattctaataaaatgttagaaacaacctaaatgttgatcagtaggttggataaataatttgggacgtaacaacatttatttattcaacaaatatatcttgtaatctttatatatccttaaaatacaattttaaatagaaaagaaagctatgtaatgatataaaaatatgatatattttctataacattttaaaacatacaaaatgttagctattttacagatacatctgtaaaatagatacgtctatatgttgtaaatctataacaaactttgatagtagaaaactcaccagttttctgacagtggttgtcactggagagagaaaggggaataggactgggactggatacaaaggggacttcaactctatttctaatgatctgagaagaatttttttaaaaccctgaaacatttaaattctgggtggtgggtatacagatttttgtcatattacccttaatatacatgtttttaaattttcacaataaaaagtactttgaaaacccttcaactcttcaacctattaagcaatagctaaaacagagttgataccatgccagttacacagatttaccattttggactctactccttaggccaccagatctcattaattcttattttcagcatttctcatggatactttaattttccaccagatcgccgcttcactaactagaatccttagcccctgcaaaatactcactctccaaatagccctagaaatcccaagtagacatcgtatatgtactcataaacaaatcatcagttaccatttgacatcatccatttctttctgtcctgtacttgaagctcattctatctctagacttatagaaaatggggcaaatttctactttttaatgcttcttaactggcatgcagcccacaaagatcattccttgctctgaattcttccagcgttatttatggtaccattcatctaacaatacttattgtgttttgtactgagaagtgaatattttatgttatataataatacttaaataatatatattttattaaaggcaggaattttttaaaaaattctacttcttttatagtacccgtagcaatgtatgcagtcattcatcagcaatggttgtaaaatgaacaactattttaaatattgtagcactgtgtgattgtcttctaaataactttatctttccaagattttgatgacttaaactcgcaaaattcctcaaagtatgtcatgggaaccctatgcctctgccttcattttttcatgatacttctgttagtgtgtaattttaggcatctctatatcccttaattcactgctacccataggaggaggagttaggtgtatctcatacttagtataagtatgtcacatgcaacatgtggaacatacttacactgagaaaaaaactaattgcttatctgaaacttaatttaacttggcagcctataatttttgtgtatgctaaatctagcaaccctaacactgacccatctcagtgttatgatggggggagatagtctaacatgcattgatctaacatccattcgttgatttttcttgaactagtggagttagtatgttaaaagtcctatgcattgtgatttcctcttttcctcttttactattcagaatccaaggatggaaggcagcgagtgacaccctttgcaactgtaataccccgatgagaaactccaaatctagacatgggtacaggtacttagaagcttggtttgagttgcaggtccaaggcacattcagctttatggaaaactatgctgatattttgatccctatgtttctgaccgctatgtgtatttctcaattaactccaaacccagaagaatgttgagaataattatcagtgttaacccccatctccctgtggatatatgtggatatagttaaaagtgactacattttatttcattctttacatactctccaatccctaacctctaccttgtcaaatacatccaaagtaaagaaaaaattaggtcaaaaggaataattttcagtaactaagattttaaagagcttgtaggaacacgaatgttaatttcagccacaagaaaacttcatggagtcagtgcttttattagaacgaataatcttagccaatttgatttaatcatcagtgtagatcttacttgtatccaataatgtcaaggccactgctgatacatcagcattctttataagctattaaatgggagtcttatttcctagacatttatattaaacttataagaaaggaaaactcttaggcaataagacatgtatttaacaaatacaatttagcatttgtaaacattaatataaggaatcatttctaagtaaccacagaatgccttagaacttcagtcagacagatagaatttaaatgtgtttggagacaaagtggaaatgtcaaagtttactaaattactaatttactctaaaactcatgcacccaaaaaactaactttattttctaaatatgaacttagcttgttccagataaaacaaaacaaaaaccttaagctgatcacaggagatgattgtcttcctaaataaaatagtctcgtccaattaaattcagtgtcttgtggctcttcaatatagattcaatagttacacttattgcatacttccaaagatgcagtataacagacatgtatttccttggctgatgttaaaaaaacaaatatagattgaaactttaacttttaaaccattaaataaataattaccaagatgctggtaataattaatgaaaactaagctgctttctggaaagaagcttatttttgaatccactgtataaacattcatcacatagtaatgttgttaatagtctgagcacttgcttaattgacacactatgtgcaaatacttctcatgatacatggtatcattccttttcctaccccagattagaaaagcgcctcttcctcaaatctctcgctacctgataactgtcagaataggtaggatgcaattgaccctccatggagacgtttaatgtacaaactgaagaagtataggcctcagccctgtgtaacatctcactgtttatgcagttaacatacttgtgtagagttgaaaaattatttttatttttcagtttgtattatatttattaaagtttaaaattttagtttaataaagtggcttgctcatcctgattacagttgaatgttaccattctgtcgagtagaagtccacaggatgcatcataaaacaactttattattcccccaccactcttcctattggggaagtggggcaggattttccttgcaacatggatgaaatcacaggtagtggtcatgaatcttcgggttggtctttgataaaaaaaattgcttctttcaaatttagttataaaaactctctcgttccaataatttaaatgtttatcacaggtagtagccaatattctgagcttgaagtttcttctctggaatactgcagtaggaaagcggacatagtcaacttttccatttccccactttgtgcctctctgccttccccaaactcatgaattgcagtttcaggcccttccaggtagaagacaggaaagatctgcttagctggtcactgccacgctttgattttggaaggtattcaggtgatctctttctcactgcagagctcttatgcattctttggagactctgcttcaccagggatttctcatctgaagttctcttaatgctggccttaatgcaagatctcttctccagcaggtatcaaatacaatctttacctcacaccatcttgttcccaacagaatacctccaacatctctctgctatggtcacctcagtcctggcagatagttctacagatttctttaagctgactctcttgcccttgtagtctacatcccatcctcagggcaagactcatatcctctatcctgacaaactgagagtgaaggttgttccccacaggtgcacctctcacctcttggccattagaaccagccagccccagtacctgagttttaaggcatgggtcccaaagcagcccaccctgttccctacctacctccctcttccaagatgcacggatcaagctctctgtgtggaacagcacctgcccttcacccccagatatctcataggggattaggagtgagactcacagaaaatgaatttctccgaagaaatcacttccagactcttctgttcttttatatctcagaaaggattgggttttcaggttgcaaaatcttttccagctctgcataggtaggtagcatctcactgaggaatggagtatttaccacctattgttctgttccagtctagtagagctttagcaaaaactacaggcaacaaattctatttttaacatcctgttacacaaacaaatatgctgagtatgcacacaaataaatggtgaaagaggcacaaagaagtgaaaacaatcgtgcatggtaggaatatttgaattgtattacatgtcctttaatattgttttaacagtaatatttttacattttcaattggaatgaaagcatgtatgtgtttgaataatttttcatcgtgcactcatttttttgattccacaactaatgagagaaacagtgatgattgtaaaatgtatcccacccttaaggaattcacagtagaattccttgtagttcctgtagaactacaataatataatgtaatataataggtaatagtattataatactctgtgtgtgtgtgtgtgtgtgtgtgtgtgtgtgtaaagagatggggactaaggcaggtacagcaaagtgctaaggagtccagatggggatagatgctacttctacttctagctgcaggagacttcaaggaggggctggagggatgtatcttgagggatggatagcatttgatttttctaagtcttggagaagagcattctgggggcctggggggaaggaacaaaagcacgttataaggaaagtgctatggaaaagtaattgggaacaattcagtgggacagctctagtatgaattaagaaatcaagtgggaaaaaatatgttgggccacagtaggtagggacaacctcatgttgataaccctttaaaaaaattccagatgtttttatccatgttacatggagagaaatattcaccattacatgtaatttactaatctttaaataattatcatatacttacctcatttatacaacacatttaacatctattaatttagtaaatgagatttctcttaagcactgttgcaaactgaatccctcttctcaagtttaaagtaggagactcttggaaatatttttcaaagagaggacaaaatatgccaatagaacaatgattataaaactgaatagtataaaagtcattaaaaggctaaaactttggaagtaaatttgtgtccacatcatgcctgtcctgattctaattctggttctctttatgcttctgggttttttccctctttcattgcttccttgggttatgattatacttagccaagaaagtcaggcttagcttctcaaatgagctgctaatgttccaggatttagagcatgtgagtcaactctgttatccatctgaaggttttccagttacacattgtaaggtacaatgtgtaccttacagatgtaaggtacatctgaaatagtccaaattactgactcaggccaatcacatatgctttgatttttctgtgacctaatctttttctcaaaatgaccctggtcctcaatgcgttgtcttcatagtctaataaacatctacctcccagttcttgttctgaaaatctttttcttattttactaccaacagaaaactgtttatataactgctttgggtctaattataaagttaatctgattcattgaaaatacaactttttttctcatctctcaaccattatgacttgcaacacggacatttaagtcaagtctgaggagtctggatgttggtctatagggaatgttaaccaatgaaaggctctaagtaaagggtcgcttcaggtatgcttcagagtaatcaatctggcctcacagaggaaaaggattagagtaaatgagcaggaaccagggagccagaggccaactggggagactaccgtctggctgaggagtaattaagacctaaagcagggcaatagctgtgggagcagagacattggcagaatgtagccacatcatctgtttcaaaatcccaaatgtgatttactcaagtcttgttcaatgaggggtagagatcaggcagtaaaatgactgtggttttactggtactaacgatgccaatttgagaacaattttgatagctgctactttagtgactcagtgcccgttagaagaaacgcgccaaattactaacaaaaaaagcaatgagcaaggcaggaaatgtttggattgcccatgttgcagttgtcatgctaaaactgctccagttaataaggcatctgatatgctgcttgaatcttatttgtaccttaactttgtggatataggattatgatgtgtctattatggaatttagcatcctgatccctccaattatactcttaaaataacattcatttttttcttattaaaaacatttttatattgtaacgcatataacaattacattcaaatttagaaaacacagaaaagtataatgaagaaaataatgatcacttttaaacctaccacacagagaaatctgttaaaacttacccttttaaaataaggctaggatcagtataattatttcatccagtaatatttcattcctgtaacagtaaaccgtagtgctttctcaatctttaaataatttcctaaaacgggtcaacaagctaatccagcctgccacctgtttctgtaaataaagttttgttggcacagagccatggctatttgtttatgtactatctatggctgcctttgcactacaagagcaaaatcgaatagttgtgacaaaggcagcacagcctgaggagctggaaatatttactatctggctctttacaaacagtttgctaactcctgctttaaaagattattttaatgacagcatataattagatcaaaaggcagttcccttggagagtgcacgagccagtggttagaagcacaatgctggcgccagattgtctgggtttgtatcctagcgcaaccatttaagaaatgtatgagcttgcctaccttatttcacctctctgtgcctcagttttctcatctgcaaaataggaaaaataaaagtgttatcctcataaagttgtgatgaagatgttgtgagccctgtgatgcgcctccagattttcctttggtcattagtgacttcttccttcagctgtgggaagtgctgccagtagacagccctcagctgtcagctttctttggggactgccttacccgaggaaattgcctcactcaaaatcatgcctcctccaagggacagttcacattcaatgacacatccacataaatggaatagtataaaggcctgtgtcccagcccccaactcaggacaactctgaaggaccagtccaactccagagttacccatgggctggcagaggccttttttggcattgcatagctgctcaatctccccctctgcctaatctcccttcttcctcctcccatccttaggtgctgatcccaacaatactccctaatgaatatgctacatcctagtctccattttagaatctggttcccaggaaacctaacctgagatagtatgttaaatgagtctatatttaaaatctctgacacatagtagatgctatatatttatataattttttcttaaataaacaaataatccagtgggaaagagtgaaatggaaatacaagttcaaggagaaaaaaatagaacaatgtaaaatttcctacaattgaagaataacttaatcataaagtttttgttaaaaaaattaattatatagatcaagcagtggttattggttgagacaatccacattgacaactttgaaatattccagtgttaatatttatttatttttaaaaatcttttttaaaaaggtgtacttttcttttaaatagtatgtgtatctatttgtgggatacatgaaatcttttgatacaggcatgcaacatgaaataatccaatgctaatctttaaatacaggggacaaacatcaatcagattctcataacatgttcagagtctacataaactgaattctggacctagttcaatacacaagggaaagagaatgacagtgtaattaccaataattaaaccaaaggcataattttccaaatcacttttagtaagtgaataaattctgacattttaaaagtctaaagctacataaaattcaaagcaatcaaactatttttctacctgaaattttttttgaatttctggagggagggcaagatggctgactggacacagccaggtggaacagctgccaccaaggaaccaagatgactggggcatgtctaacagatcttcagagggaagtcacctagagtggatggagggaagacacagaacctgggctgaagggggaagaagctgggaaccctgcatgaggctaccacacactgagactcgttcctggccccagtgacaccaggggaacaggtgaattgaactggcaaggagcaacccgttcttgccatgggcctctggaatcccagcaggaggagacccccttgaccagcacagacacttgagttagcaggaaaggctgcttagagaagtggtagcggcagcacatcagctgaggcagagcctagacggtttggtgcaggagcatctttagtggagcacagccagggaagcccatctccctagactcaacttgctcccataagagactttagccctagggaaactgtaagatctgaactctgcaaggtgatcttgcccttcaaatggggccagttcaacctgagcacctcttggtctgctggcctctcccagggccccagcctccccacacctggttgcagagcagcctcaggtgccctgggggcccacttcacagctcctgtactggcagatcatgcctggctggcagacagctccagaggggtggcccccatggccatgcaccagcctgcctgctccctttctacactgcagtttctcccaggctcacagcaagcccccacattgctttcccagagcacatgtgcatgcgcaggttttgccttccttacccaccagtgcagtgtgtgcaagctccctgccctgctactgctgcagtgagaatgcactccaccccacctccccaccaccaccaccaccattgcagttggagccttggcaggcatagagccagccagccagccctactcccaccagtgccctgcccttgtgccaacactgccctgggagtgaaactaggcagagaaaacagtggatcctcccctgccctgagggaccaccctagcctgcagcacacagagaatacacacagacctgtgcccaccagcaccccacccccatgctaacaccaccaccagcctgactgcacagttgccagcagcgaccccccgacccccacccagcggtgctgcctctgccgctgtgatgaatgcccacatggaggcaggcatcccagcacctgtaccctgctgcagcaaacaagcatatacctcactatgcttccactgccactgctgctgtcatgtgtgaacgaggatggatcccagtgttactgcactacaaaatgctttggctaacaccacccattagtgtagtgaacagcaatccgaaccacctcagctccccaccccaaccccccatacagtggattcctaacctcaaggatccagacaacaagatcagggcccgatacaagtcccccagagagagaacacacagtccaagagttgagagcttcagcattggccccttaaaatcttccaaaaacaaagccagttgactgaatccatcttataccacaaccaaaccctcaaggtcatcatactagatgaaagaaagaaaaaaacacccaaaggtcagcaacctcacagattgaagaaacatcaacccacagagatgagaaagaaccaacccaagaactctgacaactcaaaaaaccacagtgccttctttcctccaaatgaccacaccacctctccagcaagggttctgaacaaggctgagatggctgaaatgacagaaacagaattcagaatatggataggaacgaatactagccttgaatgtaaatggcctcagttccccaattaaaaggcaaagtggcaagttgggtaaagaaacatgatctattggtatgctgtcttcaagagacccatctcacatgcaatgatacccataggctcaaaattaagaaatggagaaaaatctaccaagcaaatggaaaacagaaaaaaatcaggggttgcaatctcaatttcagacaaaacagactttaaactaacaaggatcaaaaaagataaagaaggggattacataatggtaaagggttcaattcaacaagaagacctaactatgctaaatatatatgcacccaatatacaagcacccagattcataaagcaagtccatagagaccttcaaagagatttatactcccacacaataataatgggagacttcaacatcccactgactgtattagacagagcattgaggcagaaaattaacagatattcaggacctgaactcaccaatagatcaaatggacctgatggacatctacagacctctgcatccaaaagcaacagaatatatattcttctcatcaccacatggtgcatactctaaaattgaccacataattggacacaaaactctcctcagcaaatgcaaaagaactgaaatcataacaaccactctcttggaccacagtgcaatcaaattagaaataaagactaagatatttgctcaaaaccatacagttacatggaaattgaataacctactcctgaatgacttttgggtaaataataaaattaaggcagaaatcaagaagttctttgaaactagtgagaagaaagatacaatgtaccagaatctctgggacacagctaaggcagtgttaagaggaaaatttatagcactaaatgcctgcataaaaaagttagaaagatctcaatttaatagcctaacatctacaactaaaagaactagagaaccaagaccaaactgaccccaaagctaacagaagacaagaaataaccaaaatcaaagatgaactaaaggagattgagacacaaaaaaacattcaaaagatcaatgaatccaggagtttggtttttaaaaaaattaacagaatatactactagctagactaataaaaataaaagagagaagatccaaataaacacaatcagaaacaataaaaggggcattaccattgactccacagaaatacaaataaccgtcagagaatattatgaacacctctatgtacataaactagaaaatctaaaagaaacataaattcctggacacgtacaacctcccaagactgagccaggaagaaattgaatccctgaatagaccaataacaagctcggaaatggaatcagtggctgactaccaattaaaaaaataaaaaaataaaagcccaggaccagacagactcatagatgaattctaccagagctggtacaattcctacttgaaactattaaaaaacactgaggcagaggaactcctctctaactcattccatgaggctagcatcatcctgatatcaaaccctcatagagacacaacaaaaaaagaaaacttcaggtcaatatccttgatgaaccttgatgcaaaaatcctcaacaaaatactggcaaaccaaatccagaagaacattgaaaagcttatctaccatgataaaataggttttatctctgcaatgcaaggttggttcaacatacgcaaatcaataaatgtgatttgtctcataaatggaactaaagacaaaaaccacatgattatctcaatggatgcagaaaaggctttcattaaaattcaacactgcttcatgttaaaaaactctcaataaactaggtatggaaggaacatacttcaaaataataagagccatctatgacaaacccacagccaacatgataccgaatgggcaaaagctggaagcactccccttgaaaatcagcacaagacaagatgccctccatcaccactcctatccaacatagtattgcaagtcctagctacagcaatcaggcaagagaaagaaagaaagggcatccaaataggaagagaagtcaaattatccctgtttacagatgacttgattctatatgtagaaaaccccatagtctttacacaaaagttccttcagcttataaatgacttcagtaaagtctcaggatacagaatcaatgtacaaaaatcaatagcatttctatacaccaacaacagtcaagccaagagccaaatcacaaacacaatctcattcacaattaccaaaaaaaaaagaataaaatatctttcctaggagaactacaaaacactgctcaaagaaatcagagatgacacaaacaaatgaaaaaaatgttccttgctcatggataggaagaatcaatattgttaaaatgaccatactgcccaaagcaatttagagattcaatgttattactatcaaactaccaatgacattcttcccagaactagaaaaaaactattttaaaattcatatggaaccaaaaaagagcctgaatagccaaagcactcctgagcaacaagagcaaagctgaaggcagcatgctacctgacttcaaactatactacagggctacagtaaccaaaacagaaaggtatgggtacaaaaacagacacattgacaaatggaacagaacagacagcccaaaaatatagctgcatacttacaaccatctgatcttcaacaaagctgacaaaaataagcaatggggaagggactccctattcaataaatggtgctgagataactggctagctatatgcagaagattgaaactggaccccttccttatatcatatacaaaaattaactcaaggtggattaaagacttaaatgtaaaacccaaaacccctggaagacaacctaggcaatactattctggacataggaatagacaaagatttcatgacaaagacaccaaacacaactgcaatgaaagcaaacattgacaaatgagacctaattcaactaaagagcttctgtgcagcaaaagaaactatcaacataataaacagacaacctgcagaatgggagaaaattttgcaaactatgcaactgacggaagtctaatatccagcgtctataaggaacttaaacaaatttacaagcaaaaaacaaaaaccctattaaaaagtgggcaaaggacataaacagacacttttccagagaagacatacatgtggccaacaagtatatgaaaaaaaaaagctcaacattactgatcattagagaaatgcaaatcaaaaccacaacgaggtaccatctcaccccagtcagaatgactattactgaaaagtcaaaaaataacagatgctggcaaggttgcagagaaaaaagaatgcttatacactgttagtgagaatataatttagttcacccatggtggaaaacagtgtggcgactcctcaaagacctaaaaacagaactatcatttgacccagcaatcccattactgggtatatacccaaaagaatataaatcattctattataaagacacatgcacatgtctgtttgtcgtggcactattcacaataacaaagacatggaatcaacctaagtggccatcaatggtagactggttaaaagaaatgtggtaaatatacaccatggaatactatgcagccgtaaaaaagaatgagatcatgtcccctgcaggaacatggatggacctggaggccattatccttagcaaactaatgcaggaacaaaaaaccaaatatcgcatgttctcatttataagcggaagctaaaagatgagaacacatggacgcatagagggaaacaacagacattagggcctaccaggggtggagggtgagacaagggagagaatcagggaaaataacaggtactaggcttaatccctgagtaactaaataatctatataacaaacccccataacatgagtttacctatatggcaaacctgcacatgtacccctaaacttaaaataaaaacttaaaaaatcttccttgtcctatttaaacataattcttggtattgaggtaaatctgaattcacatgatatgctttgtcaaatttttccaaaaacttttttttttttttttttttttggagacagagtctcactctgttgcccaggctggagtgcagtggcatagtcttgactcactgcaacctctgcctcccgcattcaagcgattttcctgcctcagcctcccaagtagctgggactacaagtgcgcaccaccatgccttgctaatttttgtatttttaatagagacgggctttcaccatgttggccagactagtcctgaacttctgacctcaggtgatccacctgcctcggcctctcaaagtgctgggattacaagcatgagccaccacacccagccctgttttgcttataatttaaagatttaaaaaatattacaaatcatatacttgacaactatgtaaatttgttttgacaatgttaggtgtaatcccaaaatgcatgaagaaatgcattgatttaaaaaatttatttggggatattctagaaaagtttttgaaggccattattttaagatatctctgatcttctgatcttcaacctatgtgaaaagattacctaagccatggcacatgtttacagggcttcatttcagcttgatacctgcccagcctccatctaaaagcaaaacttgctctcaggtacagactgattttgtgcatgtggaaataaaaagaattgggattagccagtcacagacttcacaaaatgttccagtactgtagtaactgaattgctgccaggagcagctgtaaataagaaagaaattcgctgtccttcaactgcaatccttctggttttaaaaccacaacaaaaatcctctcctggatcaccacaacataaatgaagaatcttaaaaagaacatcctggccaagcgcagtggctcatgcctgtaatcccagcactttgggaggatgaggcaggcagatcacttgaggtcaggagttcgagaccagcctggccaacatggtgaaatcccatctctactgaaaatataaaaattagccaggcatggtggcgcatgcctgtaatcccagctactcaggaggctgaggcaggagaatcacttgaacctgggaggcagtgattgtggtgagttgagactacaccacagcactccagcctgggcgacagagcgaggctccatctcaaaaaaacaacaataaaaaaatcctattaggaatacaaaagcttaaattaaaaacaaacaaaataccgagactgaactacagtggccctaggatctattgtaaaacgcatgtttagtaaaggcaactagtgtaatctcagaccagtctgtcaagttctctgctacggtttactgtttccaaagatacaaagcactcactcaactcagtaaatattttttggatacctatgcaacaggtgctaagggaaatccaaagttccatgctaaaagattgctacctgcaaggatcttggtttagtagagaaggggaatcagtttccaaaaagactgagaaaggtgtcacttattcctgtgaggggctttagaagaattagtggcaatatgaaaaaatatatactttcacaaagcttgagtggaaaagaaagttgaaaaagggacattagctggaggaggatgtagaataaatacgttgttttaggatttattcaatacatttttatttaccacatttattaggtactgttttacatcctggtgattaagcagagaataaaatagacagagcccctctgttttaattagggaattggctaagctgctctaccaggtccaaacaaacaatgattttttaaagaacaaagtttattttctcttgcataatggtccagaagtctgtggttgatccaagggaggaggtgccccagctccctgagattagtttgggacttaggctagtgagaacagctttgccttccttaatacatggcttccatttccagtctgtatttctttttgccatttgccagacagcaagaagagggaagagaaagtgtatagcaagcagctttccttttaagggacatgatccagttctactcacatcttacaggacataactttttgatatagccttaccttgctgaaagggaggccaaggaatgtcatgtctaagtaggtcaccaagtgccctgctcaaatttgaatgtagagttatttcctcttactaaaaagaaaaaaaatacagaatgaaaactggagataaggagaagacacagtctagaagataactataggaaagtaaagagatggcgacgtatgtgaagttgtggtgtcataaagacaacaacaaaggagctaatttataggtagtcagtgacaagtgagcagtcttgagtaaagggagagtatgagtcatgtagatttctgcattccagacagagggaatagctagtgaagaagccctgaggcaagagcatgcttgtcatgtttaaggaacagtgaagtcacagggataaaagacaaaccagaagaaagtgatgatatgcaacaaagtgaatgagacatgtcaagagaggaagtagtcaagaacaacagaagttgcaagagtgaagctttggccattgaaactggcagcatggagctcacaggtgaccttgacaagtggcagtttcgtggcatggtgggcatgaaggactgaatggagtgaattcaagggagagagggggaagtggaattacagagagcaaatatgatcctctcctttgaagagaaaatgggaataacttgagtatgtgttgaaagtaaagaaccagtagaaatggagaggcaaagatacatggaagtgaagtaattgatggtgcaaggtcccagaagaggagatatacatggggttcctcctcttactctttgtcacctaaaagaaggtaagaatggtagtgaatcaagatgttggaggagggaaggaggaagcagtgggaggttgtgcaaattctagctaatagttttaattttcttttctgaagtaggaggcagtgtcatctcctgagtgcaagcagaaaagttgtcctcaactatgtatagtaggagtggataaggaagagatttgtattgatctgaggttttgtgtgggggtttgaggccagggtcaaaaccactgagaagattggcaagatagtgtttgaagtgatgaatactgtcatgtctcctctcagtaatacagcactttcttcagcctacattcttctaatggcaggattggaaaggcaatactttccccaaactcatcatcttatcaaaaccatctgccaccaagatcatcaggactaagctcattatgctgtttacagccatcaccaccacaagcccaagaccacccacttttaatcatgaacagacaagcaaagactgtcagacatctgaagactgcctcgaggtcagactcgtgacacctgaggcagcaccattcactcagttttgggaacaaaaaacttggaatcctctttcaccgtcattcacttggtcagtcaccaagctctgttcatcccgccttctaagtattccccagggcccccacttctctccatgcccactctccgtgccactggtaacctgcgtttctatcatccctcattctgatactctatccctccagctctctgcgcaaaaactgatcatactggccgggcacagtggctcatgcctgtaatcccagcactttgggagaccgaggtgggcgcatcacgaggtcaagaaatgagaccaccctcgccaacatggtgaaaccccatctctcctaaaaatacaaaaaattacctgggcgtggtggcgcgcgcctgtagtcccagctactcgaggtgctgaggcaggagaatcgcttgaacccgggaggcggaggttgcagtgaggagagatcgcgccattgcattccagcctggcgatatagccagactccgtctcaaaaaaaacaaaacaaaacaaaaaactgatcataccacttgcctgattaaaaactttcgatgactctaacattgcctttaggtaaatgccatccaaactcactaaactggtttccaacccgtttctgaaagcaccttaatctctccccacttcctctgctcattcatccatacctactgcctcctcactgctatgtcctctctcctgacccggcacttgctctttcccagtcctagaaggctcttctcttccagttcccactgcccttttccctttcctggctaatcccatactcatccttcttgtctcaacctagtggtccttaaggaagctttgctgacccccgacaccgagcgggcgtccctcctgtgtagcactgtgttagccctaccaagtcaaggctctccttgcctgtttcctgccggaaccatgtctttttacttcactcctgtctcctcagcattccagcacagtgctgggtacataacaggtgctcaagacaagtttgtggaatgactaatgagtgaataaatcattaaccaaacaccttggatctcctactacatcatttgcaaaaaaaaaaaaatgtttaatagaaattaaaatggacccagtgagctagagtgtgtgaccctgcttaaaaacgacagagtggttctgagaagcagtcccagcctaggaacccggggatccggcctgtggacccacgggcagggcctgcggggtgcaccggcgctttcgggcggaaggcggggcctcccggccagtgaccccgccccgaggcgcctcccgggcggggaagggcggggctcgcgctgggaaactccccttccaaggccgaggcgccgctgcgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccgcctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccggtgagctctgttctcttctcatatgagtaatgaaaattaagaggatgaatgaaacctcacacatgttgtggactttgctgaataggttagcaaatgactgcaggccttttgtatattttaagggaaatttggatatgtgcagtgcatctcctcgaagatgctgatggtggaaatttcttgaaaccgctctcgtaatttgccacggtaagaaaagtaaaagacaacatcaaaaagcatgtggttggatcctttgtacactgagtagtattttaatgtgttggacttcactgtccagtagccacatgggattgagatgtgctataagtgtaaaatacacatcggatttcccagagttggtgccaaaaaaacgtaaaaatcctcaataatttttgcattgattacatattgaaaggataatgctgttgatatgttggctaaataaaatgtgtttttaaatttcattccacctaattttactttttaaatgtggctactagaaatttttaaatcatatggctcacactgtatttcttttggacagtgctgttgcaaatattctggtgaatgaacacagaatcagcatggctttcctttgctgagaaatcactgatgggaagtgagacttgttaaacttgaaaggtgaggatataaatacaagctgtaattattgcagaccgcaccccttctacacctaattttttaatgtctccaaaatttggaaaaaacattaactttcagggctgattaagggaatggtagtaatactaacatctgtgtgatgtgaagagctcatttcagttgattgtcacagctttgtgagatggaaatgggatagattttatctcggttttatggttttggagtattacaagatttgttaggatctgagctggggagtggctgtaggatttctgactctagattgttttctttacaccagattcttggtgatgtatgttcatgagcaaggaactgtttatcctgtatattacatggtgaaaaaaaatacacttcttaaaagggtggacatagatgcacctctctatacagggctactcttatgatgtgcaacctgtgcagtagcacagagcccagcatttagaatggctagcacttagtttaatggccagtctgctgtcactgtctggacattgtaaataatttttaaatgaggggccctgcattgttattttgcaccacgtcctgcatatcgtgtagctgatccttttctttgcagtaatctaggacggaagttgagagaccttggataaccacccaaacatctggtcttcactttactcctttgtgaaattagaagatttagctagtctttttctctcaagttttgattctgtatgaattactgtcatcagattttgtggatggcaatagaagtattttaggtgcataacatgggaagaaatgctgatattctccgttgagagtcatgtaaatcaaagttttaaattttatgctaaaactcgtattttatgttttgtaagatggatttttctttgtggcatcaagattgcttaccatagaccattggtataaagagtcgggttgtggaatgaaagcctagataaaaagtgtgtttatttaaacattgatttttcaatgagatgggaaaatggcccagatctcatgatgtctccaattaagagatttcctttgtgggggtatgagtatgaacccttatttggcagtatctgttcctctttgctgtcgtagctgcttcctgttacgtgaggtgcccctcttcctcctcattcttaaattttgaaactctttttaaggttggacttaattttatcactacagtgcaggttttttttagaccagagacttcatcggctcatgtttgctgctgtgttcccagcttcataaccatgcctagaacatagaaggtgcccaatcaatagtcacagaataaatgaaagtataatagcagacatttaaatcttggccggagccagcctctcctagggagcgtagaagtggaagcatgaggaaataggtaaaacttggagatagcagttgtgagaagtgtcagagggatcattcagcacatgcatttatttaacaaatgtttattaacttcctactaagtgcctagcactgtactggggactagaggtacaatggaacaccaaaaatacttcacctgctctcatggagtgtataatccagtagaagagacagagatggatgattaaagggaaagaatactgtttaatgacagtgtatgtctgagtaaccagacctcgactagggaggggatggagggtggttgacgtcaaggttgagcaggtattaacttggcccagaagacagggaactgtgctctaaccagaggaaacatcatttgcaaaggtatggtgatgagggaggagggtatatactctaggaagtggaaaggacagtgtaaaaggacagcaagaatgttgtgccacaaggccggtgcagtaggcagagaccaaaagcatttagggttttgtaggttatactaagagcagctgaagaccattagagggttttaagcaaggaaggatagcctggtcaaggttgtgttgtagaaagatttttactctggtattctataaagcaaaatttctgaaggaccaggggaaagatgaataaaagaaaagcctccagcaccacacaccagatatgttgtataccttaatttactgaaatcagttttcagaggcttgagactatcctctgtgtggtagcacttggaagcctgagtgaggagacaagatgataaataattgggttgatctaggactggggaaaggcaaacccaaagtggcaaggaaatgaagacattgagggtgctagtaagaatattgaaatgattgatcttgggcttgagaaatgctaaagaaggaaataaaaccagtataagaattcctaaatcagtggtccccaacctttttggcaccagggaccagtttcatggaagacaattttctcacggatgaggggtgggggtgtggtttcaggatgattcaagcgcattacatttattgtgcactttatttctatttacattgtactatacaatgaaataattatacaactcaccgtaatgtagaatcagtgggagccctgagcttgttttcctgcaactagatggtcccatatgggagtgataggagacagtgacagatcatcaggcattagattctcacaaggaatgcacaacctagatccctctcttgcacagttcacaatagggtttgcactcctgtgagaaactaatgctgctattgatctgacaggaggcggagctcaggcagcagtgtgtgagatgagtggctgtaaataacagatgacgcttagctcccttgcctgctgctcacctcctgctgtgtggcctggttcctaacaggccagggagcagaactggtctgcggccctgggagttggggacccctggtctaaattatatgagtctatgaagttttagactggtaattcccaactgaaacttttgcaagatcaaaaagaaaagcaattatgtttgagttgaactatttagtgtatccttattaggagtctatgccaggctctatatatggcactaaggatagagaggtaagtgaaccatagctttaccttatgagaactgacaacagagttgtacagatgccaattgcaatgaagattttaagtatgttcattctttttgaatctattaccttttgccagcctctgttagaaacaggcatttaaatttttgtaggcaaccttaattattgaaacaccatttttaactatagctatatttagttcgtgtgcttctactgctagaatatttatttttttcaaaaattctactttaacacttattcaaagtttgtagaagcgaaaactgaaagagcctctaatgatcacttaatccactttctcagagtgtggtatgtgtgtaccactggtcataaacaggatgctttgtagataaaacacaatcaagcctttttaatagttatatatttcagtgtaggttaaaaatatatttagcatagcataccatgattcatggaccttatgaagagattaaagtcaattttcagattttaaaaatgagtcagtttaaagaaaaatattaatggcataggtgttacatgactgaagtttgggaaatactaatctaaaccagctcctacattgtgtagatgagaaaacaaaggggttccccacacacaatgacttttctgaggcatataactaatatacggcagagctaggactagaactcaggttcgttcagtacattccagtgtttattctgccatacaaggctgatgcttattactaaagttgaagaaaccgctgtcttagtatgacattgtactttaaatctccattgttcattacgatgaccacatatggttatttatattaaaatttgttaaaattaaggtttaaaatttgaattagtcacatttctagtgctcagtagctacatgtggctagtggctaccatattggacagcatgaacatgaaacatttctgtcattgcagaaagttttattgggcagtgctgctttaaactattgcttaggaatatgattcataagttttccccccttcaaagggataatacttattaatttgcttaccacactgaagttgttataactctgaagttaagctgaaggtactagtaacagtgcaattaagataattgatcatgggaaatatagccaggatgggattctcagattcctaccagctcattttattggaagtggttgttctttctccttttttttcaataaatattttcttgaattcatagcagatagagagaagaaatacaaatatattgaaaaagagggttcttgaatagagaattttctgactttctgaatagtttattcaacgtaagaattatattttgctgatattttaaaactttttatttttaaacattttcagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactatatccttttcattgtgaattttgtgaggtgaatcaggtagaaatgttcttgaagtttgccaaaaggtcagtctgtaaatatgctcaatgttttatatacaaatacaagttacataatactaacattataaagtaaaattgttctaaactttcgaacttgaaatactgctttgtagattgtgtaggaggaagaaaagtgtatctctgcaatagagtcgaaccaccttatttacactgatacttattatgaattggctccaaatcaaaataaatttagctttgaaatatattgtcatgcatcactagtatttcctatgcatttaaatacttatgaagcaatacacagaagatatggatcagaaatctccaggcaacaaaggatcattggtttatgcaggaattaaatcaattgtaaagtcatcgttgggtaagaaaattctatttcattttctccaatatgtttataacttttgtacttttattttgccccctgtcatttggcagaaattatctagttatttcaggatcatgtacataattttttttgttttctgattggatatttcattgtattgttgagttaaatgcatacttgtatttatatccaaaaccctttttgcagggagtcttaattctctgaagtgatgttgatcttcttaaatctatccacacgtttattcaatgttatttttttgaaaacccactttgagaggttttacactagacaatttacagattactgattgttagttcaggttttatcgcaacattttgcttcttaaaaactaaaaagatctctaattgaaggagatccctttttattttgctcctcaaatactttcattgagccatctaacagcaaggagtatgatatgaaatatggcctaacgtggaggaattatacctgatatagtccttggttaattagtgaatgaattaattaacgtgtgagttaatgtaggattgaaaattggtatggtaaactattaaagaataaaagtgacaaaaaccaaacttttttttttttctgactgctttaaacagttgttcctattcttttactggaattgaataatgggttatattagaattgcaggttgagtataccttatccaaaatggcttgggaccaaaaatgtttcagatactttcagattttgaaatatttgcgttatatacttagagattgaccatccctattctgaaatccaaaatgctccgatgagcatttcctttgaatatcatctcagcacttagaaagtttcagattttgaagccttttggacttcagttttcagatttgggatgctcaccctgtatctctgtgatctaggattcgttctctaacttttggtaagtcaaatttgggcccaagtcaagctgttagaaaagtagttaacattatttagtcaaagagcagtaatagaagtagtaaatccaatttgattttttacggagcttgtatcagtaccatacaaacaaaatacaaaataataaaatattttagagtaggttaagtgttttaattaaactgttacattatagtgtttttttaacgtctttcaaattactttggttcactttactgaaagatgcagtagactacttactgatcagtttgattttattgtttttgtattagccctccaccaaaaaaagtaacctttattataaatagtaaaatgaataagtttagttagaagctgctgtttttattaacataggtaaaagggcacacatactgttttactcccacaaatgaacctggtaccatggttcaagattttagagccattgcctattgctacaaagaattaaacaccaagtttatagaatttatagtgttttagctatatagtagatcaggccacactgcactcaattatttagaggttggttattgtgttttttgtattttgatatattttaaggaaaagccagcatctgaggaaaagcaaaaggggaaaatgtaatatgtttatgtttctggtgcactagagacaaactgagtatcccacccctgtgtcaaaatagtctctacccagactaaagaaacactactgttggaaagatttcctcattcatcattctctcattgctaggttttcagcttttttttttttgtttggtatagatatttttgtttctactacccaaaggtgaaaagtagagaaatactgtcaaatatgccactcttagatttcagtcttctgttttatttggccataccttttcctctaattgtatctctaataatcaacacatggtaagtcaacacattgagccatcttgtccacagtaacctaatacacaagtttattagagcatacagctaaattttaattttggtaacaaatagtatatatataagtgcttgctatgaattagttgcttttcccatgttactttaatttttacaactacaatatgaagtaagctcattcattcagcaagtatttattacctacatgcatgctatatgccaggagttatcctaggaactagagacataactctcaagaagatacataaatctcttccctcatggagattgagcaggatcaatgtcatccctgctcttgaggagtttatattctagtttagaatatagacaagtaagctggcagttataacatagggaagaacagacagttaattacaggaaggactcctaatctggttgcagggattagaggtttctcagaggaggtacagttaaagacaaggtccagacagggagcagcatgtgcagtggacccagagggtagagagcatagcacattattatggctgaaacagagcatgagagaggaagtgaggaaagaatggaggctagaaaggtaagcagtgggctaactcaagaaagacttagaaatcatgttaagaatttagggagattcatcttgtaagacggggaaacagatggatttgtgacagatttgtgttttaaaaggatcaagattgatagtagggatatcagatagaagcctgctgcaaggaggcaagacgtgatgctatccttaccaaggttagtagcagaggagctagagaaatgtggatacattagagaataggagaaaatttaatgattaattagataaaggggtggagaagatggaaaagtcaaaggtagcacacatatatttagtttgggaaactagttaattttaagtatgttaattaggaataacacaggaagagtatttgggtttattttggagcaagttgaaatcaagatgcttaggtagagacgtccattgggcaataggatatcagttcaaagcccaggggaggaatataatgtatgtcagaaataaatgatatttgatagagtaaatggaattgtttggagtaagaaagagatggcttaaaggagactgaggcagattgtcgagagatgtaggagaaagatctatatgacaaaaaccgcaatcacttttgtaccaacctagtatacattcatgtggaagagaggtcagttgtccggtgctccatgcttcagatccagccaaataagaactaaaaaggactcactgaatttaggactaggagaaggtctttcactggcggtatggatagcaaattgcagttatattagaaattcagagtgggttgaggaaatgaagtaatcaattataaatactttttttgaaggaatttgactatataaaggaggacaaaaagatacgcagtaggaggagacaaatctggagccgggagctttgtgttgctttatttctgttttcaacatgggattaatttaagcatgtttaaatgctaattgaaggaagcccatagaggttaaagatgcagagagaagggagtgaagcgaagttcctagaaatgggagggaatgggatccagagcacaggtttctttagctttagatacaagggtgcacacctccacatttgccagaggaaagggggaaaggatgctgtatgcaggatgtttgagtttcaataaccagaggctgagggatttcccattttatggctgctgttgagaaggagcagggaggtcgtaggaagaggatatggagaagaggagagagagctgtcttgagaaatatgggaggattactgggtaacattattttaccagaaggcagaataaaggacagtagggcaagataattaaatatattggcaagagagtggttcacttgacccttgggatcttatttggatagagatgaaaatgaagacaggataagactgataagtaaaaataatagtggtgaagacactgcgaggttgtgaaaaatataaggaagtgagatttttggaaggctatgtggttgtggttagaaagtaggtcttttggaggaggacagtttcaagtgtggctgtgaaaggagtagctaaagtcttggaggtgtagaccactggagataaggaagcaaaggaactgagaggctagtttattgaatgggctaagtgcttagatcaaccaggatgagaagaatgcatgctctgagggaatctcttctacagacctgtatagcaagttcacagtgttattagtaggtataattccttccttttaagatggcagaaagttgtataaaaaatattggcctgctttaatccatcatgaaaataatatttttcatgcttaaagagtaaactctacagttccggctactcaggaggttgagataggaggatcgcttgggcccgggagtttgaaaccagtctgggttacatagagaccctgtctctctttttctttaaaacaaacaaacaaaaaggtaaaatctaatctagagaactgagaatttgtctatgcaaaatgacttcaaggggcaaaatagctaggatttcttataaactggataattgtattgcttagttactacatagatattaaaatgaaacaaattagtagctacaaagagcatagtatctgattgctgatttgaaagaaatgtttaaatcctaatttttttttttttggagacagagtctctctctctgtcacccaggctggagtgcagtgacacaatcttggctcactgcaacttccacctcctgggttcaagtgattttcgtgcctcagcctcctgagtagctgggattacaggcgcatgccattacacctggctaatttttgtattttttgtagagacagggttttgccacattggccaggctggtctcaaactcctaacctcaagtgatctgcctgcctcgggctcccaaagtgctgggattacaggcatgagccatcgtgcctggcctaaaccctgatttttaatgtttaaataaacttgttttcctcgcagccatcagtaaaacgttttctgttatttatgtataggacagtctcaaatttaggagataaaattttgttactttagtggtacataacatgcataaatatattttacttcgttttcagagatatattaaaaatttatatgtaaaactcataagttaaaacccatgctgacatcatattgcttatttgataattctgataatcaactgtagcatagttatcaataaaaagatctctaagcagaaaaaatatgtgatacaataaccatgttcttaacatgcaggacatattaatatttctacctcctagcagtgacctctttgaattcattttcagtcatctactgcacaatgacgtttctgttaacaatcgactgcatatataatggtggccccataagatttaatactgtattttaactttaccttttctgtgtttaggtactcaaatacttaccattgtgttagagttgcctgcagtattcagtacagtaacttgctataaagcagaggtgtccaatcttgtcttccctgggccacaatggaagaattgtcttgggccacacataaaatacactaagaatagctgatgagctaaaaaataaaaaagttcttaaaaaatccccccaaaatctcataatgttttaagaaagtttacaaatttgtgttgggccgcattcagagctgtcctgggctgtgggttagacaagcttgctttatagcctaggagcaacaggcccatgtagcccaggtgtgtagtgggctatgccatctaggtttgtgtaagtacactgtgatgttcatacaacaacgaaattgcgtaatgacacatttctcagaatgtatccctactgttaatcaactcatgactggattgttctctattctgttccatgacatgatttctataaaataaaaactctttgagaaattagaatattattattaagctgtaaggaaccatttgaaaaataaattgctgatttttgctcacctgttttaaaattgtattatcactaaataccagctttaaatccaaaatttataggagagatatgaaaatacacaccttataatacatctcagcctctacctgaaattaaatgactgcattctgccctgacaatttaaatttgttattcagaatgaatgttttaatttttttaataagtgttttgttaacttttatcattaatcgttaaaagttttcacattatagtccttaaaaatccactttcataagctaaaagtgattttgtctttgggctgactcccctcatggttgcaaataaagtagcatgctccttctttttagtgggtaggaagtgctgttaaagtaagaaaactttttggaagtttcctcttaactccttgacctgaattggcaatagtttccaatagtcaggttaaaaatacgtaacttcaagtggaattatttaactaatttttgtatttccaaaattttacaaataacacatcttgaaactttttcataaagcaatcggatataatttaaaatatgtactaacatgcataatattttagacttgccacagcctaaaatcagataatcacacaaggtttttaaaagtatgaattaggtataaaagagagtttagacctttgactatgtactattttacctttttttttttttttttaaagagacagaatctcactctgtcacccaggctggtgcgatctcggctcactgcaacctccgcctcccaggtttaagcgattctcctgcctcagcctcccgagaagctgggactacaggtgcacaccaccacacccggctaatttttgtatttttagtagagaccgggttttgccatgttggctgggctgttctcgaactcccgacctcaggtgatccgcccacctcgtcctcccaaagtgctgggattacaggcatgagccacggtgcctggcctaaaatttttcttaaaaatcatttagtctgaatacttgaaaagagtaaaaataggccgggcacggtggctcatgcctgtaatcccagcactttgggaggctgaggtgggtggatcacctgaggtcgggacttcgagaacagcccggccaacatggcgaaacccggtctctactaaaaatacaaaaattagccgggtgtggtggtgtgcacctgttgaggcaggagaatcgcttgaacctgggaggcggaggttgcagtgagctgagatcgtgtgccattgcactccagcctgggtgacagagcaagactccatctcaaaaaaagaaaagaaaaattttatatatgtaatttaacttgcaaatgacaagtttttaatattttcttatttttgcttgtgtttgtttatgcctttaattccttgaccagaatgactgtagctaaattaactttggtagtgtattttcattcatttactatctcgtcatttccatgggtcaggagtctgggcacaccttagctgggtcctctgttgagagtctcaaaaaggctaaccagaaggtatcagccaaattgtatttatttctagaggttggagtgctcttccaagttcatggagttgttggcagaattcagttccttgcaactgtgggactgaggtagccattttcttgagggctaatggccagaaattgctctcagctccttagaggctattcacagttccttgccacgtggccttctcacagaccctctcagagcacagcagcttttacatcttcaagatcatcagcaggagatctgtctcctgctgcttctctcttacctcgagactgtctttcaaaggacttacttaattaggtcaggcccacacaggataatcttcccttgattcgctcggtgaactgagtaagggccttaattatatctgcaaaatgctttcacctctgctgtattctgttatctcgagacaagttacagattctacctgtacgcaaggggaggggtttacacaagagtgtggttggcggggcgggagggcgggccaggacaggaatgcagccgtttttaacagttctgcctacaaccaacaggttgaatgaggaattctagaaactgtctgctgttgatctagttatttacaaatgtataattgcagtattgtatgtaaatatataaatatataattactgtaaattacaaaggtaaattactacaaaaaataaaaagttggtaatgttggacattcatgttgcctaattcataatttagtttattctgaaaatcctttttgttaaaaaacataattatataatgacaattttggtggtaaaactttctagaacatttaagaatttgttattatagttcttaagtgtcatctttattcgttttgactttatttggcactaagtatcatcctaagtgaaattaccatgtcattaggatcaactgccttgattgcagtataaataatgctatgtgaaggcaagggtttgttctgaaaaaagaatgagaaatgaagttttctgatttagtaaggggaaaaatagccctcaagttagtcccattatattttaaaattattacttaccttaaactttcaaagtactttgaagtctgtaatcttgttttttaatgtacagagaaagaaggaagaaagcaagatcacttctactggatttcagacagtagggataccttgtgaataaaacagacaagacacctgcccttttggagcttatgcgctactgggagaagagataagactgaaaaataaattaataaatgggagcacatattaagtgctaaaggaaatagaggaaacaatgggtggtgagttagataataacaagtatgtctattttagattaggtggccaggcagtaactcagtttagtccatctgagcatttgctcttatttcagtagttctttgctaactcaaggagctactgtacttaaaaacatgcaaaatatgttgtatttgtggcatagttcatatttacactatcataaaattatggccgagaagttaaatattctaaatgtgtcaacatagttctctgtaaaactgacttactttccaaatatattttgaaataaaacaatataaaaatgttttctgtttttaggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggtattaggttataaactaagatattagttataatctaagatgttagcagttcatggaatcttttaaagaaaagaggctaataattttcaaatatctaatcacttaaaattttaatttaatttttgttggaggagaaaacacagcagtatatctataacagtaaatacttagctcatctcttatgccttggtttagggctgtaaaaacaaagatgtgtcttaaatgttagtataatattataaggagtgctcaagtgtgtccattttcaatgttttctcttaaagatagttcacataacattttttaaaatatattttcttaaagattagggctactttagcctacaagtatttttacgatccatatttgagtgttttagtttatactttctttgggatggttattgtttgacctttaagaaactctgaatgacacttttatttaggctaatacaaattgttataaaaagcatactttgatcttcaaattgcttcttgaatctggtgattaaaatacagttttcatttagtattttttaaaaagaaagagataaggtttttttactctggcattttgccagaggatcctcggaaaaacaaatcctaatacaaaacctcaggggtttttttcttatcaggaatatttcgcttggaaataactaaaatatatatagctattggtctttagtacacctaaaaaataatttttgaatattcagaatactgaatccttacttgctggtccattttgaaaccattatagtttagctgtagcatagagaaaaacatgaaattcactgtaattttttttgtagtctaaaagttaaaaaagtcaatgttttgctcagattggcatcttttccttcacctttgctctaacaaaagtctccctcatttaagagtgcaatagaaaataggtgatgatggaaaaaagaattgatatttaaagccatttctaattataattttgctataacttgaaagggtgatactttcctatcttgtgtacctgggaaatttggtggtcgatttaaacacccatactaacaatagggaaaatgtatctttccagtgattttaaggactgaagagaagacttctctgagtcaaacattcttttccatttagaagtaaattgttctatacaaaatccaaagatacttctttgctatttttatttttattttaaaagaccttaaatctaatgtattaggcaaaggaagcaagcacaaagtaacttgggaaagtgtttatagaaatgaggaatataaagctgttaagaacataaagtgggaaacactgctttatttggaaaagaaagaaaaagattagaatcaagaaatagattaagaaaacttatataataagtgtagaaaatacttaaaagtcaaagttaaaggaaaattcagttttttcttttgaagctgaacttcggttagaagactaggcagccatactgctgaaggcaaagttagcagcttatcagcatgcatctaaactgctaagaacaaatgtttaaaagactattggtaacaaatgctttcttgcaaatgggtctaaatgcagttctgtggtaattcttgtagttcattttgtcctggaaaaattgtaagtgtaatactgtaattaaagtattgaaatattactttctgcactttgcattgacacttatatacataagtgtctgcattatatatttaggaataggaaaataaaatgattttgaatattgcagtcttgagatgcaatatttactataagtgtttttgaaatacctttacattaataaacttgttaaagttgacagtgattctggtaggatgacttcacttttcttcatttagtaagcaataacatacatatatgggaacatacacaggaataacttatataagaccctgcctggattgagaacttgaaaagtaaaagatctgcttccctgcacagagtttgcacacatgggcatgagttttataagggtagaaatgttttgcttattgtctttgccaaattttccagtctgaatcaaaacccaaaccccccccttttttttttttttcaagagtaaagtgcaactttattaagaaagtaaaggaataaaagaatggctactccataggcagagcagcccaaaacccttattctctgagctcatttttctgagggtaaaagtcaccctctgatttctatttatggtttaagaaatgtagaagagatattaagcttttgatcactttgattagctggctgtttttaatatgcaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttggtaagctaacttgttttttaagatcttcctttgaattaagataggagtttttatctaactttattaaaattttcaaatgtctgttgcataaaatattatatttttatgcatatgttatttaaaataaggcatcttgggctttttttttgagcagctcttcttgagtgtgattcccgtcctagagttagttaactgataccaaactggatttgatttttatggttttaatataatttacagatatagaaggaataaagattttatcctttagcttaagaactgagctgtagaaatctacagctgtgtaaacataaaaatatattcgctgtttacactgtgcacacatgcacgtgtgtgtgtgtgtgtgtgtgtgtgtgtgtgtgtgtgtgtagttaaataaaacaactcacgattattgatcagttatggtggaggtggccatacatcttgtcccagttagtctttgtggttcctgttaggaatgataacagtacttacagtggactatttcagctttttatttggtctttgtgttattctttttctcttctgttttaaccacctgtgatcataacacaatcaaataggttctttatcacaaaacggggaaagaaagaatgaagtgagatttgcttaccagttttagctattgggttttaagctaaacaatagtactacaactttctttgcactacttggcttctttctagcagtgggaagaactttctacactgaaattcatttctgtgtttgctactgtaccatttcttatcaattatacatttcttgaataagtgatttaaggattagtccctaagaatttgtaaaaatatgtattttattggagcagcttaatgaaatgtttaataaatgtgtattttgcactttatgtactttattacttttaataaattactattgaactttttctgaccaattcaaattaatacgtataatgttaggactttattttttaactgtaattaatcttttttgttaaacagaagactttaaatgtatcttggagagataaaataatgctttcacgaagtgttagagaatgatagagactagataaacaagtggattgttaacttctgaattgataaaagatgtatattgtttaaatattaaatttctgcattttaagttaagtgacccataataagtacttttctttcccttttttttttttttttttttgttgttgttgttgttgtttttgagacagtgtcttgctctgtacccatactggagtgcagtggtgcaatggcagctcactgcaacctccacctcctgggtttaagtgattcttgtgcctcagcctcccaagtagctgagactgcaggcatgcaccaccatgccggctaatttttgtatttttagtagagacggggtttcctcatgttggccagaaatatcaattctggtctcgaactcctgatcttgaatgatccacctgacttggcctcccaaagtgctgggattacagatgtgagccgccatgccctgccccagtatccttgttttgctatacataaatttgagttattagataacagtcatcttgagtacgaagttcatatttccaagctgtttcatttatgtatttagttatactttatgtataaataattataattaatgttgctatttaaaaaatgttaatagtaatgtgaaaagtactgaattgggaagtcggaaaatacaggcctgactccttgctctgccccatttaccatagccattcagttaatttttttgagtattactttctcgagatgtaaaatgggacagaataatgtttataactctttccagatcaaaattttgtaacatatgcaactgaatctaagagttaaatctagttatatgaaatatgttctctctttagggcaaaaccatattttatcatagaaaaaatatgctaagatataggtatcaactgaagtgatcttacggttaaaaaagtaaaattttcataggatgacttcagtggaaattggatcttttttccacccttaaattatttttacaaattacaaaattaattgtaccttcctacatttgtagtaaatatatttcaaaagtgtttcatgatattgacgagtttacaaaaattttagttattataatgcctctgaaatctttgccacaaaccacctatataacaactttagccacaagagtgtgtctgtttatgttttaaaacttgtcactttgtacttggaaacgtatattggtattcttctaagttgtgtactggtgtagccaattcacaaatttcttagacttactgattaacttagtagccaaggaaagatttccttagttctctaaaattaatttctatgatggaaagattatgtggcatcttaaatttgatatactgtgcatcattgcttatgttttatgttatgtaagactgacctggatttttaaaaactgaatttggctagtgtttaaaaggtaaatttttactttgcaaggacaaaaccttattgctgaatttcctaagagttacatcaagaaaggcatctcaggcaattaatggctctgcaagataaatataacttattaataaatttggaaataaacatattcattttatttatataaaacattcagtctctgcaaaaatttaaaaccagtgcgcctagaagtaactccttgctttttctcttctttccagtatgaaaacaaagttgcagtacgtgacagagtggcatttgcttgtaaattccttagtgatactcaggtgaaaactgatttaattccacatttgaagtaattaatatgtactgtcacaattatgtaagaaactagtctttataattacatatgtatgagattgataagctaattcttctaaaaagtatggtaagaatttattagataaaaatattttgaaaatgtctaccataactaaatttatttgtttagaatactgacaatattttagtatatttcttctttggagggtaagattagttagtaggtaaagatgttaaactcacctcttagtgatgctatgaaagggttcctcatttttactacattaaacaatgctaaatgcctatgctgtgtatatagtgagggggaaatgcatgtaaacaaccagtaatactatatgctaagtactataataatgaaaaatgctggggaaagatggaggaatcttggcaagagtttggggtgggttgaagtcagggaagacctaaaggaagttattcttgatgatcttaaagttcccttccaactccagattttgtgattctgttacatactactatgatagacagcaaaaatttcgcagaataatgaggacaattatctttaaaataataaaccatctatagttcttttatggattaattatcaacataataaatgcctttttaaaatattttaaatgattatggatattgctttgaaatttgtaatagatgcagacttcttagttaaatatttatattttagtaaagtcttttgttttaaaatgttttccattaggaatgaaattgttcaaaatgtagttttgaagtacaaaatacatagtgaaacagattgctttagaaaaatcactttaaattttccagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacaggtcagtgcagtttgacagcagcttttaaaaaagtaacaatattctatattttctttcctcagttgaaagtaaatatgcacttttgcttgcttaggatctttagaaggcatttagttttaacctaatcagttgatctactgaagacttgtgccttatcttactgtccctaagcctcttcattgagttatccagtttttcctttcagtctgagaagggccagtcttgactgcatctgaatttatgtaaagctcaaattgaatagagaaactctcttcagtttctccaattgttgacataactgcatcttctacaagaaagattggcttttcctgatctcaactatagtcttacttgaagtgctgaagtctagttataccacagctctcagctttcattttctctttttattatcattgggggtatttggggtaaccaatttatccatattttctcaatttttactgtccagtgattaaaaacagattccaggcatagattgctgtctactttacttttgctggaaataatggtaaaatttagagtattctcctgagatttcctgtagccctccagttgatcttatccttacatgatgttggtaccctcctctttcctgccctcatcctcatatcacaatatggtagcatactgtgtactgggtgaacacaggaaaatgccccctctcccactgcaccttcttgtgcatatatagagacactagcccacagaccacaaagtaaacttacctaatgtatcaagccactgcccatggaagaaaaagtacccttctataacattttttcttgttgagataaaattatgtcttttaaattaaagtgtatgtatatggctgtagatggctacagagtgcaaatgagttagtaacttcttaccaagatttataaaatatatttaaaatgcagacaatacagatcttgcttttttaaaatccagtctgataattgctgcctttaattggagtgtttccttcatttacatttatatggtcatggttaagtctaccatcttgctgtttgttttccgttttgtttgtcctttttccttttgttcctatgttcctttcctaccttattttgggttaatatttccatgtttcattttattgcctctattggctttttagctatatctcttttcattatcttttttaaaagatgttgctgtagatctaacaatatgcatccctcaactcatcaaagtcaacattttaccccctcatacttcacatttctcacctgacacatcatgctttctttctactttaccctttcttatgtcactctgacactttctgggttttacttcatgcttcacaaatgtcacaacagtgtgatttcatttacacatccattcctttgtcctattgtcatatattttacttttacagatattatatactccaacttacagtgtttttttaacagtcatttgtcttttatgtaaattatgaaaagaaaacatgggcttttatatttattcacttatttaccattcctggcattctttttcccttctgtaaatcctatagcattccttgtaatataggtgacagattctctcaaattttaactgaaaatgtctatttcactcttattttttctttcaacactttaaagatgtagtttcactgtcttctggcctctgttgtttctgatgagaatcagctgttcttatgcttgtctccctgtctgtgatgtttcattttttgttgggttttttttttttttttgagacagggtctcgctctctcacccaggctggggtggatctcagctcattgcagcctccaggctcaagcaatcctcccacctcagcctcccaaggaactggaccacaggttcacgccaccactcctggctaattttttgtatttttgacagaaatggggtttcaccatgttgcccaggctggtctcaaactcctgacctcaagtgatctgcccgccccggcctccgaaagtgttaggattacaggcatgagccaccacgcccagcctaaattctgatttttaatgtttaagtaaatttgttttccttgcaaccatcaataaaatgttttctattatttatatgtaggataatctttttgggtttcttccaagatttttcctttacctttgatttttcagtagtatgaccttaatgtacctggttgtggttcattttatcctgtttgtggttcactgagcttcttggatctggaagtctgtttttcagcagatttgggaagtacggggatattatttctttaaatatttttttctgcctcaatcttattcggtttttcttctaggactcttattacatatgtattaaaccacttcatagtgttcgtaggtgcctgaggctctattcttcttccttccatgttttttttcccactattcttcaaattggttaattttttttttttttaagacagagtcttgctgtgtcacgcaggctggagtgcagtggcacaatattggctcactgcaacctccacctcccaggttcaagcattcgagtgattctcatgcctcagcctcccgagtagctgggattacaggcatgtgccaccacacctggctaattttttgtatttttagtaggacatggtttcactatgttggccatgctgatcttaaatgcctgtcctcaagtgatctgcccgcctcggcctcccaaagtgctgggattacaggcgcaagccgctgtgcctggcccagatttgttgattctgttgacttattccatcacctctgtctgctgttaaacttcccagggaattgttcatttcagttattgtgcttttcagttacagaatcttaactttgttacagtttactttagcagtccccaacctttttgccccagggactttttagcaccagggggttggtttagggatgattccagcacattgtatttattgtgcactttatttctattattattgcactgtaatacataatgaaataattctacaactcaccataatgtagaatcagtgggagctctgaggttattttcctgcaactagatggtcccatctggggatgatgggagacattgacagatcatcaggcattagattctcataaggagtatgcagcctagatccctcacatgtgcagttcacagtagggttcactgtcctatgagaatctaatgccaccactgatctgacaggaggcagagctcaggcactaatgtgagggatggggagcagccgtaaatacagatgaagctttgcttattgccctgtcactcacctcctgctgtgtgacccagtttgtaccaggctgtggacctgggggtatattgggggttggagccccctggtttacatttctcggttcagattccttatctcttcactaatcaaaacactattttcccaagcccttctgatttggtcagactcaatctctgaactattttcattacagatcatgttgtggcttgattttaggctttattggagaggatctagagaagacttactgtatatgtattgaccaaattcttacttagtttatccccttcttgccatataaggggaaagaatgagatgtgaaaacatcttatttttctgtgaattttctttttaaaccagggattatatgctactttggtacttagttctgcctacttggtcataattagggctagagtagacctctacttttttaagaaatgaaattgtaagctatgtgtttcacatgttcttttagctaaatttaactctggtaattaacactgaatttaatagatgaaagatatgttgcttcagtttttgattggatgtctaaagattatattagctcttacagatttttgttctttttttttataagtaagatatacgccaggttctctctgaaatttcacttttctattggccctcaagtaggactgagaaaactaaccttcagattgatgccaaagcatcattggaagtagagactttctctcctttctccattatgtaaagttaaggaagatatcctggacagggctgaaagtcttctaagaaaacctaaagcggccgggcacggtgactcatgcgtgtaatcccagcactttgggaggccgaggtgggcagattacctgaggtcaggagttcaagaccagcctggccaacatggtgaaaccccatctctactaaaaatacaaaaattaggtggtggcacacccctgtaatcccagctactcaagcaggagaattgcttgagcccgggaggcagaggttgcagtgagccgagatcgtgccactgcgctccagcctggccgacagagtgagactctgtctccaaaaaaaaaaaaaaaagaaaaagaaaagaaaaaaagaaaacctaaagcaagcatagatgaaatgtggaatgtcacagctgccagggaaaatacaactttaggaaaattattactggcaagaacttgaagatcttaatgagaagaactctaaagtaaatttaactaaaacaaggtgttgcttttaactgtggctacgggcaaaagaactaagaaggtatttggtttggttttgctttttcttgttctgttattatttttaaggcaagaaatgtatgttttaattgaaggcaagagtaagaatagacaggtttaacttacagataagtagatatataaaagcagcatctcagttcaccgtgcattgctagataggaaggaccaagctaactgttagttcagatgtgactgagcaattttggtgtgcatttggacttttttttttttttaaatggagtctcattctgtcacccagactacagtgcaacggcacaatctcagctcactgcaacttccgcctcccggttcaggcatcaacctcccaagtaactaggattataggcgcctgccaccacacctggctaatttttgtatttttactagagacagggtttcaccatgttggccaggctggtctcgaactcctgacgtcaagtgatccgcctacctcggccttccaaagtgctgagattacaggcatgagccatcacgcccagcctgtattacatttggatttgatagtaaacagagtttgtgaacccagaggtttttaattgctgggacaaagggtattcgtatcactgtttacaacattcaaccacgaagttctattttcttaaacttaactaaaaggtagagaattagacttccctgggcaggtatgatatataaagtacatatttatgtcattagtggaacccagcttgagataaattaatggagcttccataaattttctttattctcattaggagccagcttttggcaaaaaaaaaaaaaaaggcctatttcttctgtgttactcatacttacatgctacccagaagtctctggcctagccaggagattttaaacaattgaaataattcatgttttcgttttagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtaagtacattgttttggagaaaatcaaattgtaacatgttgatgttcaatttaataagttactattagctcattattttgcttatattgagttcccattgatgtctttgtcttttgtagactgaactttgtccttgatcttcctgtcctttggttctgcttcttgctaacaatcatctcagtggcttgagctttagtcgcagatagaacaaaccacagcaggcctgaagttttccagtgtatttccagccctttcagattctaaactattacattatcttataaattccacttgtgtattaagttttttagcattatttatgtgcagtaaggcaggatttgggttttttagactttagcagtattacctatatctatatgtttaattacacatggaaatttttttttagcattagtttaaaaaatgagattgttgtcacataaggtataccacattaaatcactgtgtcttagttcagatattaaatattatgttatcctcaatatgagcactggatggtgctattttcttattttaggaacttgagaaagtgcttatgttaaaaccagagtgttgataaaatagcattacatggtagtacatgttactaatctatatgataagtgattaagagcctagcaatttacggtaaaaacaaaatgaacagcttctattgctattattctaaaaatttaactatttaccattataagtttgttaactctctttgtcttaggaacagcgttttctttataagaaaattttgttcagaagattatatcactgaactgtggtttagaagtcatattgggatattttgtaatggcccagtgtgaattctgaagtcattgttatttctaaaatgttggagtctaaagtttgagttcttccaccaatttcagtggtattagtaagaatataattaaaaaggaagtaccccaaaaatgtaattgctaggtataaattttaaatgaaagctagtcaaccttagcagatcaattttgaaatataaaataaagttttttaaaagtatttaaaaataatttgttaggcgcacactaagttatttagcattccattatggtttgcattacatttattttttctttcatttgttttgtaggtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggtatgacataattttacaaaatacttttatgaactgaaatgattcttacataattgagttaatgttgcaaataaaatacaaactagctagagttattatttctaagaaagggcagtttactagcttgaaggcttttatgttcctataatttatgaactatgaaaactaaaagcaaaatctatatctattgatacttcaggtaatttcacaagttctgaccaatttaaagtttgtgagaaaaacttaaatatgaaataatcttaatatattaccattttcttatcactgtttccactaagaggagttcgttcaaatttgattatttaaaagtcagtatacccgcacctattaacagatactttgtatttctaaggatcttttgacatcattaaagcactttgacatttcttccttcatcttcaaaacctacctataaaatacatgagagaagggtcagttgcagtggctcatgcctgtaatcccagctctttgagaggccagggtggaaggattacttgagcctgggagtttgagaccagcctgagcaaaatagtgagaccccatctctataaaaaatttttttggccggacatggtggctcacgcctgtaatcccaacactttgggtggccgaggctggcagatcacaaggtcagaagatcaagaccatcctggcaaacatcgtgaaacctcgtctctactaaaaatacaaaaaattagccgggcgtggtggcacacacctgtagtcccagctgcttgggaggctgaggcaggagaattgcttgaacccgggaggcagaggttgcagtgagccaagatcatgccactgcactccagcctgggcgacagagcaagactctgtcctaaatttaaaaaaaaaaaatgtttttaattaaaaaataataataaataagaaaatacatagagaaagtattagcctagaagtcaggtcccttgacttctagattttgatgctgcttctgctgtttgtcagttacctagtaaatttatatatatatatatatatatatatatatatatatatatatatatatatgaaggcaatacgtaatgttttaaatgtacattttagttttgatttaaattttaatcaaggatttttattttatacattgcatactgaccactcttttatgttactctggtcctaataaacagaaaataacaatttggaatatatacatatacacacacacacagtgttcgtttttgtttgtttgtttgttttgttttttgagacaggatctcactctgtcacccaggatagaatgcagtggcatgatctcggctcacggcaacctctgcctactgcctcctgcctcctgggctcaggtgatcctcccacctcagcctcccaagtagctgggaccatagggtttcaccctgttgccctggctggtcttgaactcctgaactcaagcgatccacctgcctcagcttcccaaagtgctgggattacaggcatgagccaccatgcccagcctatattttttaatggttagaaatattaagattattttttattctttatagtaaacatatgggaaaaaattttgagaatagtagataattaaatatcttatacctggtggctggaattattccagctctttacctaacttgaaaatgatactgtggcacaattttcaattaaaatcattttgggtatttggcacacaggtgtaatgaataaagaactggttagagtgtcagaatgtctgttttaattctaactctgtgacatgcagtctgtgacactgagagttacttgcaccttcctctggactggagatcctttctagtgcagacattttataattctattctgtatcgtgttcatttaagtagtctgctttatcattacattaacatttatgaaagacttgctggtatcattggcttagcgattatttttccatctagatgctttttttaaagaaatgaagagaatatgtaatgttttaaatgtacattttagttttgatttaaattttaatcaaggatttttattttatacattacatactgatcactgttttatgttaactctggtcctaataaacagaaaataacaatttggaatatctacaacaatgagagctcgaggtaaaatatagcataaataagacatatatgtgtatgaactgagatatatagaaataattaaatgtaacacatcttttggaccataagcctcaggaagctataaggattatttgcattcttacacctgggcactcttcctttttgctgaataccagtttttcaatcttttctatttttgaaataggtaagaaaagaaaataattttctagaatttgaagaaaaatcttaaaacatttgaaattctttgttatgatgactaatataacgaatagcactcaggtttatcaaatattaacatttttccatatttgttatagaatttttttccatatttgctacagaaataatttctttatatatataatacatatttgaacactgattttacttgatacattaatataatgctgatgtgctgagatgaataaatcaaagaacctcttggagctcttggtgtgcaataagcatagttaacgaatataaaataagtgatattttctagaaaataaatactggtctacaatgccttatctgtcatttcaaagtctctaaaaagatctgaaaatccaatgccttttaaaaataaaattacggtaatctcatttgaccacaaaacctgttcagaattgatgtgaggctattaagatatttatttctcttatttattagtgaatattcatctttcactacagaaatactaacgagtttgattacagggtgctttagacttccctcaaggtgtacatatttgctacttttttctaaaatcccaaacatcctggattctgaaacacatctaaacccccaacatgaattaggactattatataaggaaagaattaggaattttgaaagtgggaaatattacttctatctgaaggatatctggaaagctttaggaggaagttaccatttaagccagtcctttaaagtttggtagatttaatatatgaagattgcagggaagccgtccaggttgcagaccaagtgtaaaaaacatgaactagggtgaagagattggtaagtattatgataagtacagggggtgtttgggaagagcaagtgtattgttgtgaaaggacctaggaagtgaactgataagaaacagtaggaaaattagggagagcctgaatatgatctttaaaggcattgctgagctaagttagagaataatcactctttataatagcaaagacataaaatcaacttcaatgcccatcagtggtggactggataaagaaatgtggtacatacacagcatagaatactatgcagccatgtcttttgcagcagcatggatagagctggaggccattatcctaagcaaactaacacaggaacagaaaaccaaataccacatgttataagtaggagctaaacattgagaacatatggtcataaagaaggaataacagacaccagggcttactggagggtgctaggtgggaggaggatcgaaaaactacctgtcgggtactatgtttattacctggatgatgaaataatccgtacaccaaaacccccatgacacgcaatttacctgtataacaaacctgcacatgtacccctgaaactaaagtaaaagtttaaaaaaaagaaaaagaagcaaattatttttttttggcatgtgaaatcagaaaagtccatttccaaagtaaaacaggatctaatagaaatcaagtgctggataattggataaagagtcaagacccatcagtgtgctgtattcaggaaacccgtctcacgtgcagagacacacataggctcaaaataaagggatggaggaagatctaccaagcaaatggaaaacaaaaaaaggcaggcgttgcaatcctgatctcagataaaacagagtttaaaccaacaaagatcaaaagagacaaggccattacataatggtaaagggatcagttcaacacgaagaactaactatcctaaatatatatgcacccaatacaggagcacccagattcataaagcaagtccttagtgacctacaaagagacttagactcccacacaataataatgggagactttaacaccccactgtcaacattagacagatcaacgaggcagaaagtgaacaaggatatccaggaattgaactccgctctgcaccaagcggacctaatagacatctacagaactctccaccccaaatcaacagcatatacattcttttcagcaccacaccacaccttttccaaaattgaccacatagttggaagtaaagcactcctcagcaaatgtaaaagaacagaaattataacaaactgtctctcagaccacagtgcaatcaaactagaactcaggattaagacattcactccaaaccgctcaactacatggaaactgaacaacgtgctcctgaatgactactgggtacataacgaaatgaaggcagaaataaagatgttctttgaaaccaacgagaacaaagacacaacataccagaatctctgggacacattcaaagcagtgtttagagggaaatttatagcactaaatgcccacgagagtaagcaggaaagatctaaaattgacaccctaacatcacaattgaaagaactagagaagcaagagcaaacacattgaaaagctagcaaaaggcaagaaataactaagatcagagcagaactgaaggaaatagagacacaaaagacccttcaaaaaatcaatgaatccaggagctggttttttttttgaaaagatcaacaaaattgatagactgctagcaagactaataaagaagaaaagagagaaaaatcaaatagacgcaataaaaaatgacaaaggggatatcaccaccgatcccacagaaatacaaactaccatcagagaataccataaacacctctatgcaaataaactagaaaatctagaagaaatggataaattcctggacacatacaccctcccaagactaaaccaggaagaagttgaatctctgaatagaccaataacaggatctgaaattgaggcaatccttaatagcttaccaaccaaaaaaagtccaggaccagatggattcacagccgaactctaccagaggtacaaggaggagctggtaccattccttctgaaactattccaatcaatagaaaaagagggaatcctccccaactcattttatgaggccagcatcatcctgataccaaagactggcagagacacaacaaaaaaagagaattttaggccaatatccttgatgaacattgatgcaaaaatcctcaataaaatactggcaaaccaaatccagcaacacatcaaaaagcttatccaccatgatcaagtgggcttcatccctgggatgcaaggctggttcaacatacgaaaatcaataaatgtaatccagcacataaacagaaccaaagacaaaaaccacatgattatctcaatagatgcagaaaaggcctttgacaaaattcaacaacccttcatgctaaaaactctcaataaattaggtattgatgggatgtatcacgaaataataagagctatctatgacacacccacagccaatatcatactgaatggacaaaaaactggaagcattccctttgaaaactggcacaagacagggatgccctctctcaccactcctattcaacatagtgttggaagttctggccagggcaatcagacaggagaaggaaataaagggcattcatttaggaaaagaggaagtcaaattgtccctgtttgcagatgacatgattgtatacctagaaatccccattgtctcagcccaaaatctccttaagctgataagcaacttcagcaaagtctcaggatacaaaatcaatgtgcagaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaactactgctcaaggaaataaaagaggatacaaacaaatggaagaacattccatgctcatgggtgggaagaatcaatatcatgaaaatggccatactgcccaaggtaatttatagattcagtgccatccccatcaagctaccaatgactttcttcacagaattgaaaaaaactaaagttcatatggaaccaaaaaagagcccgcattgccaagtcaatcccaagccaaaagaacaaagccggaggcatcacactacctgacttcaaactatactacaaggctacagtaaccaaaacagcatggtactggtaccaaaacagagatatagaccaatggaacggaacagagccctcagaaataatgccacctatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccgtaaaaaccctagaagaaaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaagctacaatgaactgaaacaaatttacaagaaaaaaacaaccccatcaaaaactgggcaaaggatatgaacagacacttctcaaaagaagacatttatgcagccaaaaaacacgtgaaaaaatgttcatcatcactggccatcagagaaatgcaaatcaaaaccacaatgagataccatctcacaccagttagaatggcgatcattaaaaagtcaggaaacaacaggtgttggagaggatgtgaagaaataggaacacttttacactgttggtgggactgtaaactagttcaaccattgtggaagtcagtgtggcgattcctcagggatctagaactagaaataccatttgacccagccattctattactgggtatatacccaaaggattataaatcatgctgctataaagacacatgcacacgtatgtttattgcagcactattcacaatagcaaagacttggaaccaagccagatatccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaatccaaacaccgcatgttctcactgacaggcgggaattgaacaatttgagaacacatggacacagtaaggggaacattacacatcggggactgttgtggggtgcggggaagggggagggatagcattaggagatatacctaatgctaaatgacgagttaatgggtggagcacaccaacatggcacatgtatacatatataacaaacctgcacgttgtgcacatgtaccctaaaactttaataataataaaatttaaaaaaaaataaagtgctggctagtggctcgagtatctaaacctccctggtgctttgcctgcaatcagagattgcatccatccatcatgctttgtgattcaaatagctggaatttctataagcttatttaactgagagttgatatttttatactcaattgtgctttgaagattagaaatctgttgaaacagttctaacatcattataaacattataaatattatttattcaacaaatgtttatttggtacctattgttccaagtgctagaaatgttacagtaaagaagacaaaaatcgctgcccttacagaatttaacttctggacaatgacacattttttaaaagttagattatctactggtttccttcattttcttcttacattatgagttaatgcataagtgaaactctagtttcgcctaaagtgttctgtggcacttgtcttcataattcactataaatcttttaaaatttgaagtcatttgatcttaagcctttatacttggcagtgagatagaccttaatacttccagtttcgtcagaaaaatataaggatatgccttgttctgattcagtctgttatctgtttatgttagaagttacaaaaacaaagtgacaagcactaatgagagctttacacaaaggtgtaaagtagtgtacatatcagatctatattttatttatctcttccccctttcctttttgccctctcattattaattgttggtgaccctttcaggagtaattctagtgtgtttacatctttaatcattgaattacttacacatcctttcacctcatatcattagcaaaaacggatattttttaaaactattcccgactgcaagattatccttttggtcatgaaagcgtgacctgcaatggtccaagcaaaatttttaacatagttatcgatgcataatgtctttatagatagcaattaagtaaaaatattaagtctaattaagcaattgtttaagttacacaagtctcatgaagtgcattgggaaactttctgctttttctcttctttgaaagggcttgtacagatgagaattacctgtcccttgatagatttttttttttttttgagacaaagtcttgctccatcacccagcctggagtgcagcagtgcaatctcggctccctgcagcctccaatccccagatttaagcaattcttgtgcctcagcctcccaagtaggtgggactacaggcatgtgtcaccacccccggccaatttttgtatttttaacagagacggagtttcaccatgttggccagactggtcgtgaactcctagcctcaagtggtctgcccgcctcagcctcccaaagtgctgggattacaggcatgagccatcacacccagccctacctgttccttgaatgttaagtaaaattcacttgtaaactgggcctggtattttccttgtggaaagattttaaactactgatttggtctctccaaagttttaaatttagattgtttcttagtgggtttggatttttttttccatttttatattggctattaaaaatgtaggggagcttctgtcattcagtttcgcttcatctaaactagaacctaccatcaaaattgctatttcaatatgatgtgtgattcatatttggaacacagttttagaaatgctttttgaaagtaactttaaataaaatattatgatatagttaatgaagatcattttattttgtcataggaggaaccaaatcagatgaaaaagtggacttgagcaaggacaaaaaattagcccaatttaacaactggtttacatggtgtcataattgcaggcacggtggacatgctggacatatgcttagttggttcaggtaatcagcacatttcttctttgataggcttggagttatgggggataacacagattgcttctaaatagtttgggtttatctattagcatttagccaaagtatgaattttattttttactgtcactcatgttaacaaaggtggtgtgaacatgtcgtgattagatatcctatgtaaccttaaactataaaggtaatacttatgtaagaactaatttaaatgttttgtatgagttaaatgtttgaataacattatttaactttattcggggagaggatatgtttacagtttttacactgaatattctgtaatttaccatgcaattgaattactaatgaaatgttaaaagagcatatcatacctctgcctcagttctcttctaagtaagctttttatgtagtcacgcaattaagactgtcaagacatatttgaatttcattttgaatggtgccagtggccctgtgctcctggttgatacagcatttatacccagtttgtcttactagctaatttaaactctgagcacatccctgtcaccttcacaactataaatgaaatatcttgccatatatgtagaaagtaaaaggtatgtgtttcttaacttctccctaaacttcagcttggcagtagtttataatttgatgcttttgatgctttttttctctgggttttagtttctatatttttccaaatgccattttgaaaagttgcattatagatagatataagtaaacaggtgggcacagtggtgcacacctgtagtcccagctactcaggaggctgaggcaggaggatcacttgagcccaaaagtgtgcgtacagcctgggaaatatagggagaccctgtctcttaaaaaataaataaataaataaatgtatgtctgtctaatttggatttttaactgttatttgacctatttttttagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtgattcagacaatagttttaagttcagctgtgcttagatttctttcagattaatttaaaattacagatttttacttttagaattgcagagcccctatcccacactggagaatattttttattactgtctgttatatatgtgtctatgtgtgtgtgtatatttatgtgtgtatgtataaatatgtattttttaaaggagccttttccctcctttgattttaagataagcaatcttttggcataacattatcgtcttcctagaaaagccaagatgaagaatctatcttacaactttttctcttcagtagagaaaaacatgtaccatttcaggtgaacatacaaaattttcactttctaccttttgccttccaatgtcctgatttgtcttcaaaggtttttctccatattaatttgtcatcttatcctcatcacctgagaacattttactgcatacaaagtctatgcaagattatatgtaactagccatttagtataatctatgtcagtgtttctgtgctgtcaaattccgtcctgatttggaataccataccttgttctttccaaggtagactaggaagtgttggggaaatggggtcacttcagagaccattttagatgtaagtttttaaatgtaagtgttactggggctaagtcaggtactttatttaaaacatttttttttctcatttcatagctagatagttgtaagagaaatacaaagaatttacaagatgcttctctgtcatctgccatatgcagagggactgaactaggaattttgtagttgaagctgtgttcataaagagtaaatcttattttatagattttggagaaataaaacaagaattttaagagctttcgtattagcagttttgccttataaaaactaagatttgtcagattagtttgaggtgtaacctaaatattaaaagtagattaaatttattttttaccttgagtgtctgatacataaaacccttttctaggaaaacattggaagtagtacatatttactctaaatgtctcacctgcatgacagtcttttcaaatgaaagacatggtaattgcaatttttttttaaagattgctattaagggtactttttccagccttcatttgagtaaatcttaattgatttcattttattaacatataccctttacctttaatatttcatttgaagtgttcctttcaaacttactgtcttaaatatgaaagtcagctttaagtaatgtcagactcatatgcattttcattctcattagctaaagtaaaatgtaaaattatctcaaatagttacaagttttggaaatacagtataaaacatgaatgtaaagtctattatgtaatatgcttatttgtaatcctaatatatgagggtgacatttttaagattgtatgtatgtgtcaacctcttaaatgttttctgtgaagcccaaacatgcagtttatgtctctggtgtctgttttgcatttcagtgtgcatggacaatcaaattattttctcatttttatcactaagtcactggtatttgggtttataaactcaacaagatactttacctaaacatgatcaatagatgtgtttattaaaagtgtttttattatttttaaaagattgaataaatctgggttgaagtcattgtatctaatcaagaaattatgattcctttacaaataatccacgtgaagtaatattggtgctttttttgatgacagacttcatacttaatattagaagtaacattccttttaggctctgtttttcaattcaacccactttccagaatagttattatcctttaaaatggtatattttaaaagtagcttcccattgtcaatgcttcacatagtaagtatttaaaagaatgtagttcttcatttaattagatgactcaatttcagtcattcatttgactgcaagtagttaaagcatggtctttgaaacataaattataatcctagcctcgggatcttcggtaagtgacttgacctttttgagcttcagtttcttcatatgttaaaagaaagatacagaaatacctacctcagagtgtgggagtattaggtgatgcaataaacatgaagtgccatatccctgtcacatggtgctctataaatggtagtgattagcagtcattgttaccttcattttcatagattgctcatgtatcagtactttttcaatgaatacttatagtataattttaattatagttaaaattataagtataatgaatacttataattttaacgaatctacatttgtctcaagaatgaaaatttccttggtgtgagttagctgaaatagattttcttaaaaagagtgaaaattcccaataatagttatactccaaatatagggtaaacaaaagtagctaagtcctgtctcaaaagaaaaatgccataatttggataaatttatagtattactgtttttgctgcatgcaaaaatcctccaaatgacctcctaagagttaaatgtgatataaaaatgaacccagaggaaaaaattatggcaaatttaacaactgactattgaaaactttaagttttatgtctaaactcttaatttaactacgtttaaattgaactccctaatctggatacttggagaaagtatccaggattattctgtgtactttttctttttctgccattctattacacttgatgttcatttaaattataatgttggggtggtagtgataatttcaaaagtatactgtgagacttgctgtcccggaatagccgtaattaaagctagtgggcacaatttctgacatctgctcagacaggcatcagagaggtaggaggcacatatttgggtcaatatcttgtatcaagtctagtgacccacatcacaatgacagaaacaggccttgttagatagcagctcccctgtccactactcactccttccattacatcatctgccagttttctctcctacctgaaaatgttgtaggttactttgttgattataacaagtagcactttacaaatatattaatttttataaaatactacttttcccagagtacagcgacagaaggaaagcttcccaaggtttttaaaagctaacaacccagatatcaaattaacacaactttaacatgataaagtcacaagtaaaattagcatcaaatgcagcagtatataaattactgttaatgccttttatgtgccaggtgccaagcgcattatcctgttttcgccataaacctatgaggcagttatgccattattgtccccgttctgtaaaggaggcaactcaggcatagggacatcaggtcacttgtcctaggttacatgagtagcaaatacagccaagacttagattccagtagtcttgacctgctaatctgcccttttaatttctgttttctgcttctgtgtactactttgtaggttatatacgtaagagaatgattcactacgacaaagaagggtttattccaagaattaagtactgggtaatattttaattatatttagtattaatataccaaaagagaagaaccacaaagagcttgataaaattcaaaaattgatctcttaatttgtttttgaggtcagtttttatgcaaaggaaatgttttctctccattttctcccctcctgttttactgtctcatacatcatgatgcctattagagaaatactagaatccttctcactatagacaggaataagaagtggatgctgttgtcactggttctgcacatggcaatgaaaaagaagaaagcgaaaggcacacctttgcttcttttccaagtcatcaaaatttgatatggcaaaaatcatagttacaaggcaaacaaattgataaactacaacatttatgacaaattgccttaattcagaaaggacattttcaaagccgaggaaaaaacaatcagtagataatatcaatcaaagacttgtgcaagcaaaatagaactgctgacaaataaatgctaaatcagtaacatgctgattaaaaagtagaatactgttcgcctgactgcatagatttaaaataataggcattttcatggatgtgggaaggaaacattctgagataacagcttatgagagtttaagtcttgaggacaggtaaactgtattaatcagaagccgtaaagagtttcataccctttgacatagtatgctgggaatattttctgagggattgattgcataagtgcacaaagatgtatatttttatgatacggttctacacagtattgtttataataaaaacttggaaacctaaatgtccaataatagaaaagaataaattattgtatatacatacagtgggttactaagaaatgattcaattagtatagatattttcattgacaaaggtttcttaatatattggtaagtgaaagggaagttttaggatagtatatctagcatataaatatatttgtttgggatatggttaatacagaaactttaacagtggccatctttaaagagtggaattttgagtaacattttcttcatatctatctttcatttttcccaataataatgaatatataaatgtacatgcatctctctgtctcactctgtctctcgcgcacacacacacatacacaccatatatgtatatactggcttttagaaaagttatccatgaccttgtatcttgttattaaacacagtgaaacaatcatatgttaggatttattctatgcggtgaaaaaacaggctacaagatgttatgaaaatttggattgagatctaattgttcagaaagcattttctagatttcttactctacactagtaatatacaagaataacaagatatagtcctctcaattcttcattacatttggaagtagtgcattatgttctccacttagcgtattgggaaatgaatatgtaaaataattctgatttccctgagcttagtggtacatgattaataacttcatttcaatattttttctcctatatcttcgtcatgagatttcctgactcctcttttttggctctgggtctgtggtgggaaagctgtcctcctctatgtactgaatttatgtgattattgtccagtctaatctggcatgcactttgctcaattcatttccaataatagcaggttatttaggtttaagtgatgaattctgaacatgcctgtgtgtctttgcttcaccaaaacacagaaccatacctacgtgtgctggacagtgttaaaggttctgatgttaaaggattgatggcaccatagttgccttggaggagttgtatgtctaatggaagaggcagatccaggcatagttttcagcagattcaaatctattaagcttaatatttacaactgctatagcatttgcataaaatgagtatcattttagcatctctgcaagccagaaaatgtctatttgattttctcattttggactttaaaaattattttccaattaaaaataatttgaggaaatagagatttccataacgtttttcaaaaatgtaattttcttactcatctactaatggcacagtgttttaaaatgctttgctaaaaaggcagctttaggattaaaggataatttatgtaatgttagaaacagcagcaataataattcagtagagactttcatcattcaatttatgaaaagcatattgccttaacataatttcttaactggaaatttagatgcaggaatcaaattagtctcttaaaatataaagtcacaaagacaagtctggaggagcatttgaagggattaatgtctcacagcttgaaacatatatgtaagaattcatgcaaactatttatcttacatctttttatttaaagaattttagctccatctacacataagaaagcctggagtttgaaataatagttgtccaaattcatgcttatccagatttatatcacattgcagccacatattttgctgatgatagttaaataagaagttgctactgtaaaatgtaaagctaagtatcctttttagcaccatgtattatttcatagtaaaaattggaatgttacaatattcctgtggtgttatgtcaaaaaaatattttcatcgtcaatttgaaaacttttattatgcattaagtaggtatacttaatatttgaacaactatggatgtgtatctttatggtacataaatgttcccaaaatagatgaagatgtgtatttatgaagcaaacatattcagcgatgtgacaaatgtgagagaagtatctcttgataaagtaatacttctttaaaaattaatatgttttatcatttcaaatcttctgatctttttcttccattcttcaaaaatggaatgtatggtcacttgtcactcttagtacagattagcatttttaaacatagacggctttctgaaatacattaaatgctttttggaaaattgagtgtaactctttgaatgaatgctaagatactgttggcttccaaaagagaatactccagacagggtacattttttctctttttctactggaagaaccagacacaatttagagacaagtaagctgaggacagattttcaaggtcatctgggaacaactactcttttagaaacattgtattgttttttaatatattttattgaattttgttacttctgtcttcagaaaatgttatatgaatacagaaaatgtatgttccctgtggggacctgggaaattaaaaacgtgtatcatcctgataaaacatatctcatgggaaaaattggccaaaacagttagttactcagtatatctccaggtttgcatcttctacttcttatgtattcatttagagtcctcttccagtgtgtggacctctgcagattctagataacttttcaaatatgctagattttgagctgtatattttttctcaagcagagacatctgcgcatagtgaaaatcaattctcagagaccaaaattgccaagcatacgtgacggaactgtagggaaaaagggcataactttaatcttcaaagaagcttaaaaatagctccacagttattatgcatgaggcctgacaattgacatttctcattttggcagcattcacctacagcaccctatcagcaactgaacacattcatctctggaataaatgattaatgagctgcctatcatttccactccttttgtaccaagtggtggaggcttcagttgatcatattgcagccatcaacatcattactgaaattgattctgccactagagggttgtgctaggatcatcaattagcatttaaattaaaaagttatggcattaaaaataacaaaaaaataatcccttctgagtcactctgtcagacctggtaaggtgattttgtttttttgctcatcagacagcatcacaaaaccttagattgaggaaggaagcatggaaggattgtttttgtttcaagaacaaccctctaagatttccaaactttttattaatcactgtcatgttccttgaaatgcagatttatgaaatgctacaatttgcattcaatagtgaccaatgaagttgccaaattatttccttcagacaaaaagtcaaaggatagagttaggcatttttgaaaggtcagaatttatccagaaagggggaagttagaggaaggagatttacaaatgatactgagatacagcaaaataaagtttttcttatatttcagcaggcagatgtgagaatgaagtgaaaagaacatcatcatttagatgtcgggatgatgtgggctgcatttctaaaacagatggcagataatgtgggtctccatagtcctacaaaaaagtgacagattgtagttttggtaaaatgatacatcaaggaaaatgaatggtacttggaataggtattttagcatctctttctgctcctgggaccaagttcctcaagttctcaatattactgagcttaaactccttcctcatctatgttcatcttccagcatggctttctcctatttcctcattgtttcctctctcttcccctgttgaatttcaaattcaaatataaacagttggttttggttttatctgcctctgaattaagacactacctttactacattgtattggtcacccaattgaagtgcatgtgcattttcttcagagctgagacgcattgattatacaacaaaatggagctatcataggtcctcaatccagctgctctgtcctatacttgattaatattctttccacaatctgttggtagtggtattgtgacttttcatttctgtctttgtgaaattttaagaagaagctaacaaaggctgctttgaggactgctaagtagaggacatttttacctaacattgattaatgtagatagctgagacttacttgtattttgaaaaatgggaagaaaatggtcatggtaagaagcactgggtgataagaaaaacacatagtaacaagatttctacatgtgagccaatagcaaacttcctctatgtgttaaaattctccaatgagaaatacagcaactcgtttcagacaccatgagatggacaggttaggccaagttgtgcttgacctagtggtgaatgaccacacacttctttacctttggcacaagtggttcatcaatctcccactttccctcagatcctttttcagcgtagtattctaggcaccaactgccaactggccagtgttcacctgtttgtcattttcagcttaactaccaatttggacaattggagaggtattcgaaccggatggtaaagctgaaattagatctcaagtctcttcactgaagtctagtactcttatatttcatagacaatgaactggaccagatgaattcttctgttagtatgatgtatatcatatgaacttccaataattttaaagctaactttttattataaaaatgatacaggctcatggtaaagtcactgtgggaaacagtatggtgtttcttcaaaaaattaaaaataaaattaccaggcagatgtggtggctcacacctgtaatcccagcacttggagaggccatggtgggaggattgcttgagcctaggagttcaagaccagcctgggcaacacagcgaggtcccaactctacaaaaacaaattccaaaaattagttgggcatggtggagcatacctgtagtctcggctgaagcagaaggatcacttgagcccaggagttcaaggcttcaacaagccatgcttgtgccaatgcactccagcctgcgtgatagagtgagaccctgtctcaaaaaaaaagaaaaaaaaagaaagaaaaaggaattaccatatgatccagcaattgcacttctgggtatatacttaaaataattgaaagcaatcttttgaaatggtctcaaagagttatttgtgtaccaatatttatagcagcattattcacgatagttaaaatgtgaaagcaactcaagtgtcctggacagatgaataaggaaaatgtggtatacatattcaaagcaatattattcagccttataaagaaaggagctggatatggtggctcacgcctgaaatcccgacactttgggtggctgaggtaggaggattgcttgaggctgggagttcaagaagagcctgggcaacatggtgagatcccatgtctacacaaaatacaaaactgggccagacatggtggcacatgcctgtagtcttagctactcgggaggctgaggtggaaggattgcttgaacctgagaggtgaaagctgcagtgagctatgatcacaccactgcaatacagcctgagtgacagattaagaccctgacaaaaaaaaaaaaggaaattctgatatgctgaaacatgaataaattttgaggatattatgctaagcaaaataatctaaccaaaaagacaaatactttatgattccacctgtataaggtacttagattggtcaaaatcatagaaagagaaaatagaaaggtggtagccagagactagaggggagggaatggggagttactgtttaatggatactgagtttcagttttacacaatgaaatgagttttggagatggatggtggtgatagttgcacataattatgaatgtatttaatatcattgaattgtatgcttaaaaaaggttaagttggtaaattttatattatacgtattttgccacaataaaaaattgggaaaaaatgcaggcttatcacaagaaaaaaaaattacataaagtataaagtggaagtaaatatcttcttagcagtttgccccattatcttcctgctctatgtgtcacctccctaaacgccaactctcactttctaggaaaagctgctttaaagtctgtacacatgtaaggaaatgttctttacataaaccacatctggctgtgtttgtctgcgttcatctttgcctctctctctttgcctggataagatcatactgcataaactctcctctaatggttttttcctatctaaaatatgtattttgaagagtttcccttattagcctatatatatctaatttttaaaaactgactgaatggtgtgtgattagatgtctatatctcccattgatagaaatgtagggtatttccattcgtttttacaaatgatactgcagtgagcatctttgagtataaatctttgggtacttgtgagtgagttaatttctcagataaattaggtggaattatgagccaaaagttatgtgtattttacattttgatagatattgacaaatagccctccaaaagttgaactaattatctccctataaactaaacagcataggaaagtgcctgttttcccaacaccttcaacgctaagcattataaaatttctacttatagccatgtagtagatgaaaatattgaaaatattttaatttacatatattcaattctgaatgaggttaaacatagattttatatgactattcactgtttgtatttatttacaatgcactgcttgttcatttccatgctcaattttaatggtgtttactttgaggaaaaaaaaacacctatatggaaaagccctgaattatatgtaattccctctttctacaccttttctgctataatttgaaagttagctttggtcagttttttcactgtcactgtttctttcctccctctcctccctctcctcccttcctcccttcctcctttcctttcttccttccttccttgacagggtcttgctatattgcccaggctggagtgcagtggctattcacaggtgtgatcctagtgcactacagctttgaactcctgtctcagcctccttagccgctgggagtacaggtgcatgccactgcacccagtgccttgtttcttttatgataatcatttctctttcaatgtttaaccagattctccacaccttgacagcaattagggtgaggaggactaatagtactgccaaaggcccctgatggtcttgtttcagagataatttttgttacaacattgcttagcccattatgctttataatcttcttgtcagtaactgtgtgtccttggtattcatcttgtttctcagtcatttctactatagaaagaatcatattttcgagaataacaaaatgtctgataccctgttttcaggataccttcatatactaacagaccaaagtgactggacttggccaattcagttacaatgaatcctattgaaaaatgaacctggtttacctgagggctaaccattcaggaacaactgtttatcatgaagactttttagtttaattttcaaataggaaatgtattcacgtgtgtattaggttctccagagaagcagaaccagtaggatacacacatacacacacacacacacacacacacacacacacacacacacacacggggattatgggaactgacttcatgactatagaggctgagaagtcccaggatgcgccatctgcaagctgaagaatgaggacagccagtggtgcaattcagtccaattccgaggtcctgagaaccagggtagccaatgatatatctctcagctgaaggcatgagaacatgtgtgtgtgcgtgtgtctgtgtctgtgtgtgcgttggggggtgcaagtcctggagtccaaaggtccaagaaccaagagctttgatgtccaaaaacaggagaagatggatgttcaggctcaagaatagaaaaattcattcttcatccacctttctgttttatcctggcactcaatagactggatgatgtccactcacataggtgaggctggattatctttactcagtctactgattcaaatgtgaatctcttctggaaacatcctcacagacacacccagaaataatgtcttaccaactatctgggcatccgttagcccagccaggttgacacatacaattaaccaccacaacgtggctcaaaagtcaagaagtataaagaaaacaaagtgaaaaggtttttttttcatccccatccattatcttccagtttccccaccctatcctcatggagtttgtagtatattgaacaggtagaccaccaagaaattataataaggtacattcagtcttctcattatcagtaattttttactacgtttctgggttctgggaggagggtgttacagaatgctgagctgggaagcttcaatcatgagattttaatatttatcaatgaagggtttaaaaagatggagaatgagttaaaggaattaactgccacagagaaaaataaagtggtcccttgtcctacatcttggaatctctattgcgataattgctatgtgtgtggcaacttcctggaggttacttattaaaaatgtaccctgaagtaattcatatgtgtcatgctaatgccctgtccacttcttactaaaatgtatgggttaaaattaacagtaatacttttgtctggatactgaatccaactaagtagaaattactcatttctaagttgtaatgtattgtatataaatgtaacattgttataatacaattatatgtatacaatgtaaaaatgtaatatattgtgtatatgtacaaatgtacatttgttgtgaaatattgtgcaatataattgtaatattttcaagccctatatgaaaaagctgttatttgcatgactgtatcctatgaatagttatggaaatgaataaataagctttttagaaacagtttacagagtcataaacacttaaatatttgcgcctgaattttctcatcaattctttaggtgttttcccctaaacaaaagaatctgtctttatttttcatgaaatcacttttctattttggcatacatttctttttcattttaaagtctgcaatcttcattatataacctgcaggctatatgagtgaggtaatccactctccctctctgttggagggagaatgttttcctgtgccactctgtaatttgttttgcaacaattattgctatttgtaagcatatcttgtaatcacaagatacatgtagctgaatttagaatctgttgagaacacagaaggcagcagcagtgtttctaaatgtcactgacttaatgattttaactaataaaatttttaaagattcaaatgcatcaacccaaatcatccatttctgaaatgtattttagataaatcccttgaagtgttcttttgttgcaaatgggtgtcattatgcattagtttctttctccaaatccctgcaatcccctaacctaatttccaataagacaatctatcagacaatttatctctagttcctgtgttttaaaattatggaagctaaatgttgtgttccagattgtttagggagtcatacctagaagcattttgtgccttatacttctttctactcttttgattaagaaaacataaatgtgtatataactggtatattttccaattattttaggcgaacgtcgcaaatgtattttggcccttttgcgggggcctatttttccttttaaaaagtaccaaccattcaactttgaataacagattatacagtggagcattatttttttgaaaaataaattatcttaggtagaattttagagtttgtatatactcatcatttattttccctgtactgcttaaaatgtattcttaaatttgtatgttgggtcaggcgcggtggctcacacctgtaatcccagcactttgggaggccgaggcagatggatcacaaggtcaggagttcgagaccagcctggccaatatgtgaaaccccgtctctactaaaaatacaaaacattagccgggtgtggtggcgcttgcctgtagtcccagctacttgggaggctgaggcaggagaatcgcttgaactcaggaggtggaggttgcagtgaatcgagatcgcaccactgcactccagcctgggtgacagagtgagactccgtctcaaaaaaaaaaaaaaattatgttaaataggtttaggttatgagatgaagagaaagtaggaaaagcaacatagaacatattttattgctattgaaatgttatttttattttccttgaaaagggataaagtgggatattagtgccaattttggcaggtgagtggtctggtgacaaataacacagtaataaattgattgtccccttatatctccactgctaactgaagtttacattgggcaaagaagatagaagcctttgcagctgccttaaattctgctgtggaaacaagtgttgcatatatatataatttttttttttgagtcacagtctcactctgtcacccaggctggagcacagtggcgtgatctcagctcactacaacctccaccttctggcttcaagagattctcctgcctcagcctcccaagtagctgggattacaggtgcatgccaccacgcccagctaatttttgtagttttagtagagacgaggtttcaccatgttagccaggctggtcttgaactcctgacctcaggtgattcacctgccgtggcatcccaaagtgctgggattacaggcgtcagccactgtgcgcagccataaatatatatgtgttaccttgagttgttttcatgacttacttacactgtggagagtgaaggaaattgctcagtgggtcaattccttgaggtcaccgagtcccaacagaaatagtccacaaattcccctggtttagaggcaatgatttctaattcctagctccccacttggtccaccgtatgttcatctggaaaacatttagtcatttccaaggagattctaaaatgaggcaactcgtggtcaactgtctgcctttcataacaggtcaatcaaatatatgaccaacaaagacatacatttctgagccatatggaaaaaataattgactaaatgggaccctgatcacttaaaagaatagatgcgtctcttaaaaagaaaatgtattctctcatcagttccaatattttcataacatttaaagctctcaaatgctaaataaaaatatgaaaacatttgagtgaaatgtggcactgtttctgattttctgtaaggttatgataaatttacttgacacaatttaactttaaatgatcatgtcgtgttaagcagaattaaattaatgaaaataaatgtcaccatctaaataataaatatttcctaattgagtagctaaggtaaaaataatgctaaattatctagttttttaattagtaattattcaacagaagatttctccctgctaattatctttcaagattcagatgaaaagatactaagatcttttaacaaaaccattcatttaagcccattattaaacagactatattaccttaacattttatggtatgaaattctcacagtcaaaatcattggcttgttttcctgggtaatatttcaaactcctgtgaaaaatgaatagttgcttagaaaagggggctaattaagtcatagtgtcatttacggcattgcccaaaactgtcactctgctcacatattttccttcaacttacaggcctcgctattttctgataactgtttggaagttttctgaattttgcatcttgaatacctcactgttgttctttatctgcccaccgaagagacaatcatgttgaaattgcattttttaatatgcaaaagccacagtatttgtctaaaatttacattctgtaatatgtaaggaaacaatagtatgcaaactacagttttatccttgcaatcaatatgaatgtattacactacaaattgtttatggcctacacttctggccttcattagccatctcaaaatgtcatgctgtaggtcaaatggggtcataaagaacataagtggcttacctcaaaccaacatcactattagaaagtaacttaaaacacatgctttgttggtattttagatttaacatcatcttcttaggaaagataacctgtggttccagaattattaatttttttagcaacctatcagaatcaaattctatgcaaattaaataagaaaccaaattggagtttcactaaatagaacctacagaatttgcttgttgttaatgctggtggatttctttgaaaccttagactagttaaatattaaatagctagtaagagtggagacatttctagagattatactagacagctgtcgactgagatttcatagggcagattttagaccttatttgtatctccagtagttagcccaggatttttactcaaagtgcttgttaaataatataatgcatattaaattaataccttaaaaagacaacctcactctagaaaaacaaaagacaacctcaaaattctataaatttagtaataatactaggtgatcattcagagcacttaactcaccttatgaagaggtgctttcggagttgtgttcaattttgtcactttcagatgaaaataaaagtgaacactggaagaacatttgtaaaattacagctaaagacaaccatattgtagttcatcattcattccctacattagattgtgcttgatatttcttcaaaaattcaatgttagtaaaaagtttgattgtcctagtgaatttaatgatattaaaactctataacctattgttcttttcctttcttagcttcccaggaagactcggggctaaattcaatgcctaattatattttctatattagtttgggtgtttttgtagttaccatttccttttttcaatgtttccctttttatttttatagtttaatcctttttagaaatgtgtgctgtatattatgaattaatgtcagttttttattcttaatcctcatttttcaattgtttgtttttgagctttcaaaacacattgttcactactccttgaaactttttttttttttttttgagacagagttttgctctgttgcccaggctggtgtgcagtggcacaatctcggctcactgcagcctccgtctcccgagttcaatgaattctcatgcctcagcctcccgaatagctgggattataggtgtgcaccaccatgcccacctaattttttgcatttttagtagaggcagggtttctccatgttgcccaggctgatctcaaactcctggactcaagtgatccaactgccttagcctttcaaagtgctgggattacaggtgtgacccaccacaccagctgaaactctctcttccttgcctttcactatattctttcagtcaacaaatatttattgaatacttaattgttgtcaggcactgttgtgattcctctcccaattcaatgatcctcttcctcatcccacttactctcagttctgccccatatatggtgcaggtccaccaaggttctgtcatttattttatgatgttctcaattctgcactctgtgccttgatttaggaacacaatcccttacttgaaacttttgaagccacatatgcttcaaaattctgaatttttggattttagcaaagtcatagattgtaacaaccatatattttgtaacactttacacagagaggggcagcactctttaatcaaatatattaatatttctgcaatgaaatatatgaatgtttacacaaaccgagatagggactatgactactatagtagtatatatagactataaccctcactgcattttttttttttttttgatacaggatctcactctgtcacccaggctggagtacagcggcacaatctcggctcactgcaatctccgtctatggggttcaagcaattctcctgcatcagcctcctgagtagctgggattacaggtgcccaccaccatgcccggctaatttttgtatttttggtagagatgggatttcactatattggccaggctggtctcgaactcctaacctcaggtcatctgcccgcctcagcctcactacaattcttaccaggtgttgcggctaaatgagttctgtcttagaaaatgcttttgcttttcaaaccattttcgattttgagattgcagataagggatgatttacctcttaaacttttcctactttaaatatattaagcaaattttgtctcgaatctgtctggtcctacatttccaaataccttctagacatctttacaaaaggacctatcaaatactttaatttgtaccaaagcaaatgtattgccttctaacccactgatctctttcttggttgtcattctgtttaactctttagcatcatcactgaatcctatggaatccatcataatagttcttgaactccttgcctcctatcacccgccccaatattcacgtaggttcttttctattttccctaagcttcggccagcttgagaaataaagggaccgagtacaaaagagaaattttaaagccgggcgtccaggggagacatcacatgttggtaggttccatgatgccccccaagccgcaaaaaccagcaagtttttattagggattttcaaaaggggagggagtgtgtgaataggtgtgggtcacagacatcaagtactttacaaggtaacagaatatcgcaaggcaagtggaggcagggtgagatcacaggaccacaggaccggggtgaaattaaaattgctaatgaagtttcaggcaccattgtcattgacaacatcttatcaggagacagggttttgagagcaactggtctgaccaaaaatttattaggcaggaatttcctcttcctaataagcctgggagcactatgggagactggggtctatttcacccctacagcctcgaccataagagacgggcacacctagggtggccgtttataggcctatacccccaggcgcatattctctttcccaggcatgttccttgctgagaaaaagaattcagcgatacttctcccatttgcttttgaaagaagagaaatatggctctgttcagcccagctcacaggtggtcagagtttagggttatctctcttattccctgaacaattgctgttatcctgttcttttttcaaggtgcccagatttcatattgctcaaacacacatgctctacaatttgtgcagttaatgcaattatcacatggtcttgaggcaacatacatcttcctcagctgacaggattaagagattaaagtaaagacaggcataggaaatcacaagggtattggttggggaagtgataagtgtccatgaaatcttcacaatttacgtttagagattgcagtaaagacaggcataagaaattataaaagtattaatttggggaactaataaatgtccatgaaatcttcacaatccatgttcttctgccatggcttcagccggtccctccgtttggggtccctgacctcccgcaacaattgtcacagttctgacaatggtgcaggccttcattacctctcctctcagttttgtgacttctcaaactaggctagataggctaatttattcatgcactatgttagacattggcaaataccaataaggcaggcttaacttcaggttccccatttatagggacctcttcttagtggggaaggctaattaaaggattaaataaattagggaacgtttggtacaatgggctattttgcaaccattaaagacaatgagattattctatatgtcagttgccaagacatattaagaaaaaacgcgtccgggcgtggtggctcacgcctgtaatcccagcactttgggaggctgaggcgggtggttcacgaggtcaggagattgagaccatcctggctaacacggtgaaaccccgtctctactaaaaatacaaaaaaattagctgggtgtggtggtgggcacctgtagtcccagctacttaggaggctgaggcaggagaatggcgtgaacccgggaggcggagcttgcagtgagccaagatcgtgccactgcactccagcctgggcgacagagcgagactctgtctcaaaaaaaaaaaaaaaaaaaaaaattgcacattgcagaatagtgtattgaggtcctatgaacacatagtttgcctatatagagaaagtcctggaaagctatatacaaaaacatgcatattaaattaatacctttaaaagacaacttcactctagaaaaaacaaaagacaacttcaaacttctataaattttgtaataatactagttgatcactcagagtatttacctcaccttatgaagagatgctttcagagttgtgtttaattttgtcacttctagatgaaaataaaagtgaccatttgaagaacatctgtaaaattacaactaaagacaaccatattgtagttcaccactgacagcactgtctctggaaagacaatgtggactttattttctgatttttccttttttagtgttgtaagttttaaaagaatatgtattttaatctgaaaagggattatcaaattaaatgtgatgagagatatgaataaataaatataatgaagaaaggaatataacacgaagtggccgggcacagtggctcgcgcctgtaatcccagcactttggtagggcaaggcgggcagattgcttgagttcaggagttcaagaccagcctgggcaaaaataacaaaaccctgtctctaccaaaaatacgaaatattagccaggcatggtggagcacacctgtggtcccagatacttgggggactgaagtgagaggatcgcctgaccccaagaggtcaagactgcagtgagctgagatcatgccactgcactccagcctgggcaacagagtgaggctcttgtcttaaaagaaaaaaaaggtggaaatatagcacaaagtaactaactcaggctaagttatgaaaatcttagaaaatgctttcctttgagtacagcaacagacattccaatcagagcaaacagcagattcggtggtactcatttcttaaagggtacagtgtgtctgggaacagcagattgggtgctggagagtagcttcaaggggaaaccagatttgacactgatgttagatatggaagatagtgaaaaggactggagatagtcaagtgtttctgggcaactgggtggcttatggtagctttaaaagaaacagggctaatcaaaaccacagtgagatgctacttcagagccattagtgcagttataataaaaataagtcagtgaagggtttcaacttttggtaatatggacctgctctagtcagtggagagcctctggaggttgttgatttttaaataaaatactttttttttattttggagtaattttagatttgcagaaaagttacaaagatagtacagagagttatcatataagccctcaaccagtttgtctcccttaatgttatcttacgttatcacggtatatttgtcaaaactaagaaaccaacattggtaaattattattacctgaatgccagtcttcattcagatttcaccggtttttccattagtgtgctttttcttttccaggagccagtagaggatcccacataacatttagttgtcttggtctctgtaatctcctcactctgagtttctcttctcagtctttccttgtttttcatgaacttgacagttttgaggggtactgatcagaaagtttgtcgaatatccctcaatttgggtttgtctgacattttctcattattagactggaggtacgggttttagaaaaaatatcacacaggtatttttatcacattattttagaggacacatcactgctgatgttaaccttgatcacttcatttaggatgtttgctaggtttttccactgtaagcttcccagaaagcttttcctttccatgcttctcaggcttttaagctttacattatattacaagcagtgtttaatgcgatttttttggctggatgatgggaagagggtggaaaaaagaaggtcagttacatagctaaggttgtcgtaataattcaagtgacagaggacaagcacttggacttctagtggctatagtagatagtaaaatggattggagatattcaagtgtttctgggcaactgggtggcttacggtagctttaagagaaacagggtaagtcaaaaccacagtgagataccactttatacccattaggaaagttataataaaaagtcagataataagaagtgatggtgaggatgcagaaaaattagaatccatatacactgctgatgggaatgtaaaatggtgtggccactttggaaaacagtcaggcagttactcaaaaaattgaacattttactatttgatgcagcaattccacttttaggtacatacttgagaaatagaaacacaggtacacataaaaatgtatacgcgcatcttcataatggcattactcattataaccaaatggcagaaactacccaaatgtccatcaattgatgaatgaacaaaatgtggtatatcttattcagccataaaaagggtggaaacactaacatgctatgttacaacacagatgaactttgaaaatgctatgctaagtgaaagaagccaatcacaaaagaccacatattatgattccatttgtatgacatgtccagaatggagacaaatctagagacagaaagtagattaatagttgcttagcactgggggagtgggtggatggtggagggatcaggctatgacagggcaaatggtatgaggtttccttttggggtgatgaaaatgttttcaaattgattatggtgatggttatacaaccctgaatacactaaaagccatagaattgtacacttgaatttcgtaaattgtatgatatgtaaattacatctcaatgaaattattaccaaaaaaatctgtaacacatggcaggggaaccatacttgttcaaactacactcattcaaatcaaagtgctggtgggacacccaggtggagcagctgaaaacttaggttggggctagagatatggcaccacaaatcattagcataaaggattcactcagtagaaaacaaggtaattcatttagtccaatttactaaatatagtagctgaagggaaggtttcaagcagggcaacttcaacatttaatagcactgaattttcaggggttaacacagaactgaggactgactctgatatggtttggctctgtctccccactcaaatctcatctcaaactgtaatctccatgtgttgaggacagaggtgattgaatcatgggggtggtttcccccatgctgttctcatgctaacaagtgagttctcaagagatctgatggttttataaggcagttttccctgctcttgcttgctctctctctcctgctgccttgtgaaggtgtctgcttctccttctgccatgattataagcttcctgagacctatccagccatgtggtactgtaagtcagttaaacctcccttgtttataaattacccattcttgggtagtataatatctttatagcagtgtgaaaatggactcatacagttaactggtaccagaagtggggtactgctataaagatatagaaaatatggaagtgactttggaactgggtaatgggcagagtttgaaatagttggagggctcagaagaagaaaggaagatgtggaaatgtttagaacttcctagagacttgttgaatggttttgaccaaaatgctgatagtgatatggacaatgaagtccaggcggaggtggtctcagatggagatgagaaacttattgggaactggagcaaaggtcagtcttaccatgctttagcaaagagactggcagcattttgcccctgctttagaaatctgtggaactttgaacttgagagagataatctgaaattggaacttatgtttaaaagggaagcagagcataaggtttggaaaatttgcagtgtgactaagagatggaaaagaaaacccattttctgggatgaaattctagcaagctgcagaaatttgcataagtaatgaggagccaaatgttaattgccaagacaatgtggaaaatatctccagggcatgtcagaaatcttggtggcaacccctcctatcacaggcctggagacctaagaggaaaaaaatggtttcctgtgcagggccaggtgcccgctgctatgtgcagcctcagaacttggtgccctgcatcccagactttccagccccagacacagctaaaaggggccaaggtatagcttgggctgttgcttccaagggtgcaagcccaaagccttggcagcttccacatggtgttgggcctgcaggtgcacagaattcaagagttgaggtttgggaaccgccacctagatttcacaggatgtatggaaatacctggatgtccatgcagaagtctgctgcaggggcagagccctcatggagaacctctgctagggtattgcattaggaaaatgtgggattggagcccccacaaagagtatccactggggcacgcctagtggagctgtgagatgagggctaccatcctccagaccccagaatggtagctccactgatagcttgcaccttgtgcctggaaaagccaaggacactcagtgtcagcctgtgaaggagctgcccaaggccatgggagcccacccccttacatcagcatgcccacgatgtgagacatgaagtcaaaggagattattttggagctttaatagttaacgactgccctgctggattttggacttgcatggggctatggggttttggtcaatttgtcccatttggaatgggagcatttatctgatacctgtaccaccattgtatttagaaagtaactaacttccttttgattgtacaggctcataggtggaagggattgcacttgccttacctcagataagactttggactgtggacttttgagttaatgctgaaatgagttaaggcatggggggctgttgggagggaaggcatgattggttttgaaatgtgaaaagacatgaaatttgagagaggccaggggcagaatgatacggcttgctctgtatccccaaccaaatctcatcttgaattgtaatacccattatccccatttgtcaagggagagagaccaggtggaggtaactaactatatcatagagcggtcctcccatgctgttctcatgatagtgagtgagttcacaatgagatctgctgggtttttttctttgtttgttttgagatggattcttgctctgtcagtaagcgggatctcagcttactgtaacctctgcctcctgggttaaagcgattttccttcctcagcctcctgagtagctgcacgcaccaccatgcccagctttttgtatttttttgtagagatgaggttttgccatgttgggaaggctggtcttgaacgtctgaccacaaatgatccatccacctcggcctcccaaagtgctaggattataggagtgagccactgtgctcagctgatctgatggttttataaggcagttttccctgctcttgctctctctctctctcctgctgccttgtgaaggtgcctgcttccccttccaccatgactgtaagtttcctgaggcctccccagccatgtggaattgtgagtcaattaagcctcctttgtttacaaattacccattctcggggatcatctttatagtagtgtgaaaatggattaatgtagactcctctggcattcaagacaacactgttattgagactgactgatgtctctcctcattttcaactagtctctgaatgagaatacattctgagaaatgaaccattagacaaattcattatcgtgtgaacctcacagaacatacttacacaaacttagatgatatatgctattgctcctgggctcaaacctgtacagcatgttgttgtaccgaagactttgtgcagttttaaaagaatggtcagtatttgtatatctaaacgtagaaaagatacagtaaaaatatggtatagcccaggcacagtggctcatgcctgtaatcctagcattttgggaggccgaggtgggcacattacttgaggtcagggatttgataccagcctggccaacatgacgaaaccccatctctactaaaaattcaaaaattagccaggctcaatggtggtcgactgtaatccctgctactcaggaggctaaggcaagagaatctcttaaacctgggaggcagaggttgcaatgagccaagatcatgccactgtactccagtctgggtgacagagcaaggctccatctcaaaaaaaaaaaaaaaaaaaattacagtatagaagattaaaaaatgagttcaagaccagaccgggtaacatagtgagaccccatctctaccaaaaaatacaaaaattcactggatgtagtggtgtgtacctgtagtcctagcttctcaggaggctgaggtgggagacgcactcctgtctgagcaacagagcaagaccctgtctttaaaagaaaaaaaaaaaagatacacctgtatagggcacttaccataacttgtgcttgcagactgaaagttgcttccaggtgtcagtgagtgagtggtgagtaatgtgagggcctaggacattattgaaccctactgtagactttacatacttaggccacactaaatttataaaaatatatttttctttcttcaataataaattaactcttgcttattgtagcttttttaatttatgcacttttaaatttgttttaacttttcttttttggatggggtcttgctgtgttgcgcaggctgaagtacagcagcatgattgttgctcactgcagcttcgagctcctgggcttgagctatcctgccacttcagcctcccaagtagctggggctataggcatgcaccaccacacatagaacacaaaaaaggtacagtagggcaggtgcggtggctcattcctgtaatcccagcactttgggaggccaagacaggcagatcacgaggtcaagagattgagaccatcctgcccaaccaacatggtgaaaccctgtctctactaaaaatacaaaaattagcggggcatagtgacacacgcctgtagtcccagctactcgggaggctgaggcaggagaattccttgaacccgggaggcagaggttgcagttagctgagatcatgccactgcactccagcccaggtgacagagcgagcctccatctcaaaaaaataagtaaataaataaaaaaggtacagtaaattttttaaaaacatttcactctttttgaataacacttagcttaaaacacgctgtacagctgaacaaaaatatttttctttgtattcttatgaacttttttctatttccaaaattaaattttctttttacattttaacttttttgttaaaaactaaaacacaagcacacacactagcctaggcctatacaggatcatcaatatcactgtcttctacctccatatcttgtcccagtggaagttcttcaagggccataacatgcagggaactgtcatctcctataacaaggtcttctttgggaagacctcctgaaggactctcctgaggctgtttacagttaccttttttcctgtaagtaggggtacagtttaaaataatgataaatagtaaacacatagccagtaacatggtattttattatcaagtatcatgtaccatacataattctatgtgtcatacttctacatgcagcctactgtgcggcttgtttacaccatcatcaccacaaacatgtgagtaatgcattgtgctaagatgttacgatgcctttgtctttagacaggaatttttcagttccattatgatcttatgggaccaccatcatatatgcagtctgtcattgaccaaagtcattatacagcgtataaactgtacagttgtcttcatttcatgtaacagaatgctttaccgtaaatggctatggcaatgcccctcaagtaatgagcagagtatttttggatgacagaagttgaaatttaagattacactaattaaaactaagtatttttggtataatttacaataacctatatggatttagaattatttccttattcaagggaatgggtcaagccataaaacttaactggccacgtaggtcatcggttattctatactaccttattccaaatctgccacatcttccctgctcacccccaacatggtgctagagagagattccatactaaagattagacaggtgaaaagaataaaaagaaagtcaaatgattccaccaactctttcaatgatcatatattccttgtttggaatttagtaaatgctattttaaaacccaggaaggctgggcatggttgttacacacctgtaatcccaacactttgggaggctaaggcggtaggattgcttgaggctaggtgtttgagtccagcctgggaaacacagtgagaccccatctctacacggaaatttaggaaaatctagctgggcgtggtagtgcccacctgtagtctgagctacttgggagactgagcccagaggttcaaggctgcagtgagctatgattgcacaaccgtattccagcctgggcaatagagtgagatcctgtctctacaaaaacaaaaccaaaccaagccagaaaaagagatacttcacagattacagaagatgtaagattctgtttgcctttttttgagacagagcttcactcttgttgcctaggctggagtgcaatggtgcaatcttggctcaccgcaacctccgcctcccaggttcaagtgattctcctgtctcagcctcctgagtagctgatattacaggcgcatgtcaccacgcccggctaatttttgtatttttagtagagacagggtttcatcatattggtgaggctggtctcgaactcctgaccttaggtgatccacccgcctcggcctcacaaggtgctgggattacaggagtaagccagcgtggccagtctctgtttgcctttttaatgtcatctacttcattttgtaagtagggtatcaaggaaataattatcaaggtatagtttgggaaaaggtgagcaaatccttaacacagctggcccaaggttttatttggtaggtctaaatcttgaccttatggctatgaaatttcaagtttgtgcttgaatacatgattaaaagaatgaaaatgaaatgaccgatagtacgtaccattttagtttttattaataaaatagaaacttagactcggacaactgctttattcttgcatctaatctgaccatatattggagtagcaattctttataaaaggacttcggtgagaactgtcaatatatcagttccatcaaaaactctaggttggaatatcttaaaaacagcaaattaaatatgagaaagcacagaaatctctccctcaaacaagaagggcttcctttaatagactttaatatagctcatttacaatcgtatgaaaatccatcaagatcaatcatgttgcacaatccctaaaggataaaactgagggaagtcatggataattttcacagcttcattgtaaagtccaagatctgaaagaaacatttaagcaaacatttaatctacaatggaaagttgtaacatcaattattatctaagatatttttacctatttcctttttctcacccttttggaagtgagtttctaaaaatggagatatggattatggattcttgtatttaactgtggcaccaaaaaaaagacatgggagtaccatccattttgatgttcattatacaggcagtttctgcctggtagtgttttgggtgttatgcattattcaattccttcaattcagatattacaacaaaaaaactaatactatttttgttatatttaaaaaaattatctttcaacaaacattaattaatctttactgagtttcttacatatataagcactacttaaaagcaggccaaaacaaaatgtacccccatttgcctttacgatcacaaaattctatagaaattgaaaatgtggcagtactaaaactctagaccaatatatatcaaactaaaaataaaactgttttcctgtatgtttatgttatgtaattgtatgtaatacatacaattttgtatgtaatacaaaatgtatgttaaaacatagttatataaaactgtatgttatgtaattacatacagttatataaaactgtatgttatgtaattacatacagttatataaaactgtatgttatgtaattacatacagttatataaaactgtatgttatgtaattacatacagttatataaaactgtatgttatgtaattacataaaaccagtcaatactagaatgctttatttaccaaaaggatggctatcttctttaaactggacataagatgtacacaagatggtggccttggcggttactcttccaaccacttccacaattccagagatttcttcatcaagctaagacacagaacaagacatcgatttggtgatatcacattttcagttgacaattattttggaaaactgttatacaggttactaatctatcacttcaagtaacaaagtaattttaagaattaccagtgtaaaagttaaaatgtaacttgttaacaaatgtttgagtacttaactgtcagcatgttaaaattcctgctacctttagcagtagcttcaagtccaaagctacaattcaagttaaagacaaaatcactattgaaaacgtccagcatttctataagcagtaatatcctatgagaggaatcttctataatctgtatttcacaatgtgttctgtatacattaaccaaacagcatatggatttgtcttcacaaaataccaaaaaaagttttaagtatgttaaacataaaatgcaaacataaataagtaaaaactggaaatatatgaacaaaaatagaaaataaaataaaatcgaaaactcttgaggggctggtcgaggcaggaggattgcttgagaccgagagttcaagaccagcctgaggaacatagggagatgccatctttacaaaaaacaaaacaaaacaaaacaaaacaaaacaaaacaaaaattagccaggcatggttaagcatgcctgtagtcccagctactggggaggctgacatgggagcaacttgatcttgggaggctaaggctgcagtgcgccatgatggtgccactgcattccacccggggtaacagagtgagaccctgtctcaaaacaaaaaaacaaaaacgaaacaaaaaacctcttgaggaagaaaaaagcaacgtaaatttttcttatgtgattttatggtctttcataaggaatgagaattgttatccaacatttatgggatatgttcaaaaatcatgacgcccaaaaaatcattggttaaaaatgtaaaaggaaatataatgagagaatagtacaagaattaaattttacagccagggacgttttaccagctcatcctttttaaatccattgcaaaaattagaaacatcggcaacaaaccaaatcaagatgaagaattaactataatatataagagacttattaacacttaaacatacgggttccatcaactcgatggttccattttttccttctccatctgaaagaataaacatttttccggtgggatgaatctaaaaacgaaacatataattaaaatctcactaaaacaacaacaaagtttgactaaagatgagtacattgatccttagttgagcacaaatcaactgtttcttgaacagtttattcattcagtttattcaacttattggatcaaattataatcttatgttatcaaatctgttcatggaacacacagttaatttctgaatttcagataaacaaggattttttttgtagtgttaagtaggttctgtatttgctaaatatggcaaccctattctgataacaaattaaaggatgcccaccctaaaagtgaaatctgctggcactcatgatttagacagtacatatcccacggagggtatgttttaaaaaacaggcatgatgaagtaaaaggagaactggttgctagaatatctgggtcctactcctgggaagcagctgtaaagagcgctgtcagattgcgtttgaatgccagctttgccatttgccgagtttctgagcattttagtcaaccacctaccactcctactcagtttccctacttgggaagtcagagcaacactcatttaaggaagaggatgtgtggatgaaatgagctactaaataagtctttatataatagttttcttttcctcagcttttcaggtcactgattccaagactttgggcctgtttctcgcctgtagaatgagggaacttcactttaatactggggttaaataactcgttactacgggacccaaagcggacaaccaaggcatgttttacagagaagcgatcacaacgaggaaacgaggtttgcaaaaataagtaatttcagaagagaaggaaaccagcagattagttttgtctgcgtccgtcacgtctgagtaaactaagaaatctgaaggtagatgtgggagtggtgtttataatttcccttacgtaagcacggctagaacggaggcgacgggcactggaatttagaactcagcatttgaaaacactttgtttccgtgccataaaagagcgccaaaatggggctacaacggctaaagaatttccaaaaagttccttgtgcaaaataaaggagtcgggggcgcagtgatcggaggctttccgtcctttttcatcccccgttatccaggcggggtccctccctccagctacggacttgggagcccatgattgcgaacccgcacaccttttccagcctccctacgaagcagacaggcttgtcgatgaattgagctagcatgccggcgttgatgcgcgacctgggcaagtccatcatgtccaccatgattatggtccaagactgcggctggcgggaaacccacggacgactgaaactgtgcgccccgcgggtgtctatggggcagatttctcggcaccaatcagcgaagactagcgctccagcttcgccaattaaatgcgcggaaacctaaatcgcaatcgcgctgtctctgaaaggggtggagaaggggctggatgagtccggaagtggagattggctgcttagtgacgcgcggcgtcccggaagttgacagatacagggcgagaggcagtggaggcgggacttggataggggcggaacctgagactacctttctgcgatcacaggattcccggcggtgacttgaccccggaagtggggtgtgaagctccggtgctggtgcggcgggggactgcggggccagcctcaggtacctcgtctcgcgggaggcgccgcaaccttactgtttccccattcttcccgcgaacagagtcaaaagagctaggcgggagtcggcactagctgctgccgcggtgctgtgggtgctgcgtaccagctgttcactgctgtctcgccttccctcttgccagttctgcgtgggaggcgcgggagttttgcggaatgatacgtggtgtggcgtcggggttgtgatacccgcccccttggagatgggcagcggggtcatcagtgatcttgatcactttcttcaggcttttgccacttgttggctgagggtcgatttactcccttagctgcgtcactctactttctccactttctccacctgtaagaagagagattgatccgattacttctaagacgttttttagcccaacctggccacactgcggaggcgccggttctttcaccccgctaacccctccgtgttggcagccaatagaagcacttaaggatgggtaacggggaagaaccactggccagtactaggggagacaagcttaaatcgttgttagaccccgagctagggttccccgagctagggttctcccttctgaggcgtgttttccccatctgcaaaacgaagggttaggcggaatgatttgcaaggtcccagttgactctgacttttggccatatgtttgactcaacagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacggtggaaattggacagaagttttaattgggtattataacgttgtggaaactgagtctgtgaattggcccaaagctacagaattgtcatcgttcaaattcccttaagcaaaaaagatccgatttgagacttcacgtggcaatttaagattggaatctcatgtacgataattaaatgatagtctcccttagtgtttccttagcacttaataggtttgtcttagttttactcactaacggtactttaaaggatttcattaaacagatgtagaatgtgtgtcagtggtgtataaaaaagttgtggttgtattggtgcaagtcagtaaagtctattttatattacagctttaagtcttttgtactttagcattgttttgcaaagcaagttgatgtgcattatataggggagagtacacacatcaatgtctttaatagcatttttttttgaggcaagatctctctctgtcacccagactggagtgcagtagcatgcacatagctcactgcagcctttaactcgtaggcttaagcgatcctctcacctcagcctgccaagtagctgggactataagcacataccaccacacccagctaataaagattttttttttgttgtttgtttttttttgttcagatggggcctcgccatgttgaccaggcttatctcaaactcctgggctcaggcgatccctccctcccccgtctccctcccaaagtactggaattacaggtgtgagccttggtgcgtaccctgtaatagtgattttttttttttttaaagagcactcctgtgagtaccagatgttaatgtcgttgtttacctgcagttagaaagaccacttttaagcaaaggctttcttttaaaacagggagatgagcaggaagataatttaaaacagctttttcgtgtatttttgagtcacttaaaatattataaaatacatgatgtacagaaaaaagtatagctagccgatttgcatagttttgagagaaatgaaatgaatccatggggcctgtcattcagctgaagaaatggaactttaccagttaccagtaaattttaccagtttgcacttccccaatgaagccctccttgctacagccataagtaaacactatcttgaaatttgtgttaagcttcctaagcttttctaggtggttttatcacacatgcaggcgttgctaaatggtatgttgtttaatattgccagtctttgacctttatataaacagaaacgtatgtatcttctgacttcttttgtttgtttttgagattcatctatgttgacgaatgtacgtagatcatatttttttttctgttacaggtaggcatgagtgggacagtagtgggctctcccccaacccactagaaatgttgggggatggtttggcaattaccgaatttgcttctctaaaaatgataattctgcagcgccagggagaggccatttcctgatggtccacacctgttatcaaaatgttaattgaatgtagacccgagggagaaacagcttcctgggcatgcatattaagagacaaaaatggtaaagtatgatcttccaggtacactccaccggaaaaaggaaggaagcctcagatgggcgtgcatgtaactccctaaaaacacttcccaaggctaaggagggctctgtgcctgccggcagcctatcctaaggaaagaatcatgggaaatagacaagcttgtaaaagtcctaggatcagggccgggcgcggtggctcacgcctgtaatcccagcactttgggaggctgaagcgggtggatcacctcagatcagaagttcaagaccaccctggtcaacatggtgaaaccctgtctctactaaatatacaaaaaagtatccaggcgcgatggcgggggcctgtagtcccagctactcgggaggctgaggcaggagaatggcgtgaacccgagaggcggagcttgcagtgagccgagatcgcgccacttcactccaacctgggccacagagcgagactccctctcaaaaaaaaaaaaaacaaacaaacgaaaaaaaaaggatcaacggttaaatcggacacttgacctactctctttaaccttcacattcccgcttgggtctctaacaagcacaccttcctttcttcctgttttaaggccttttaaagtaaacttccattcctgctctggaacttgcctgggtctctgtttctgctttatgcccctcagtcaaattttttcgtctgaggaggcaaggactgaagttgctactgacccgtgaggataggccaccggtaacttggggtaacttggatctctgccactagtaaaaaaatgatttccccaaatggtggtaccagtttactctcttacctggagtataagacagtttacagttattgtatattcttggcaactcttggagttttttcccccaatttgatggatatgaagtgtttttttgtcgtgaccctaatttgcactccctgattactgaaaagtttgaacattttttcagatttttattggttatttatgtttatctttttttccttgatttttctttttcttactgacttttaagagctttttattagtgagatattgtaatggtacaagtgttgtctgtttttggcctatctttccgtttccttccttcattccatcctttttttttttttattaggaagacctcttttaatatagttaaacattttcccccttaagtttaatgtaggagaaaagtccattaaaatctcatttatgaattctttgatacatcgtactcttaaaggtattctatttttcctaaaatgtttagagttttgcctttcatatttaatagtccgtcatctagaattcactcttcatgtatgttgtcagataagtctccaatctctgttttgttttaatttcagttgtcctaatgtgatttgactgtatcacctttttgccaccttcacttgtcaccttaagtttacagatatgtgtggagtcaattctattctatggatctatttttctatccctgaaccactacctattttctttaatagtgtagcttatcataacttttgatgtctggggctgtgttctcgggaatgtcttggttatttttgtctctttgctcttctgtatagaatgtagcttatgaatttccaggaaaaactgtgttggaattttgatcaaaattgcactgtatccttggatgtatttcaggaaaagtaacacctgaatgtcaactcttactatccttgagccattttggtcctcttaaaatctttccaaaaggtctcatacttttctacataaaagttttgacttttagcttagatttattcctagataccttgtttttgttgctattatgaatggtatcattttttaaattaaagattttaactgattgttttggtatatagaaatgccattttaagaattttctatcagttttttttggaattttctattcatatttgaataattatagttttgtttcttaagaattcttacatattttatttatctttcttaccttttgcctaggatagagccttcagtaccattttgaatagaaatagtgtttaagtcaagatggggtttagctgcataaacaaaagtatctttaatgcacaaacgcttattctcacatgtgaaagaagtccacagctgtgcaacttagtacttatgtggtagtgcactaagactcagggccccaggttctttctgtctttctgtagttctacattcaatatctagttccatatttatggttatctcataggccaggtaagtgatggagcttcagctatcaagtaaatccacgttctatgtggcagagaagtggacccgcattcagcttcctttaaggagtattccccgaagtccttcccaacttgaatttctgtttattagattaaggaattttccttctattcctagtttgataagcattttaattgaattgttacggaatttgatcaaatgcattttttgccttaattgagatgattgaaatgagtatgtatttttcagtgtttgaaccaagctcacattcttggaagcttggttatgatatattgtcttttatatatattcctggatttgatttgctgttgtttttgtttaggatttttttttttttaatctatgttcatgagtgagattggtctgtaattttccttttttgtatagtccttgtcaaaatttggcattatggttataagacaggagaattccctggacccctttgtgggacttggaaccagggtgtggctcgtttgctcggctgccgtgtactcaaaccccttacgggagagggagcatgcaggtgagcaggtgcaggagttggggtgagtgatttgggcctccagccccatggcagtgtctaggggcgttacagtgctcttttagccctgccgtctgggaatggcttaagtgttaaatagctcagtagagtcagtgtgacagcctttttgggttcccacacccagtgcatcctgaattcttgtctagcatcgaggaggaatcaggttacatgggcttgaaagatggtgaatgtgggcattttattgagtgatggaggtggctctcagtgggatggtgatacggtttggctgtgccccactcaaatctcatcttgaattgtagctcccataattcccatgtgttgtgggagggacccgatgagagataactgaatcatggggacagtttcccccatactgttctcgtggtagtgaataagtctcacgagatctgatggctttataaggggaaacccctttcgctggatttttttttttttttttttttttttaattctctcgtctgacaccatgtaagacgtaccttttgctttccgccatgattgtgaggtctccccagccacgtggaactgtgagtccattaaacccctttttctttataaattacccagtctcaggggtgtctttatcagcagtatgaaaatgaactaatacagatggggagctggagaggggatggagtgggaagatgatcttcccttggagttcggctgtcccatggccaatctcctctctgaccgtccccagccaaactcccctcgacactcagatgcttcctctcttctctcctctgctgcaccattctgctgctctgccactcttctgctcatggagcctggggtttggggtttatatgggcacagaataggggtgacatattgggccaaaaggcaacatttgggtgcaaaaacagcctgttcacatttagggctatgggtccaggcttaagggtggagccctcgccagggaccccacccttctgccgcttgtccgtatcagttacactagttttgtgaaattagtgtggagtgtttcttttatttattctccaagattgtacataaaactgaaattatctattgagtgtttggtagtgttcacctataaaaccttttagatcactatagttatctttgactagagctttagacatttcccacaagtttttataagcaggtgtacattaagttctaggtattttctagttttcagcatatttcttttttgacccatgcattatttttgtttcaaaatgtataggttttattaaagttattttgataattcccagtgaaactgcattataatctgagggtatggtttgtctaattctttgcaattatatgagactaattctttgaaattatgtgaggcttgctttaaggcttattaggaacatggacaatttttcatgtgtgcttggcaaaaaaatgtattttccagttgttggatccagtgtgtaaattgcactgttcacataattctgttttctttttgtctgcttaatatctcaattatcgataaatatgtgacatagcctatagatggtagcattgtcaaatttctccttgaagccctgatgacttttgctatatatatacatttctttaagagacagggtcttcctctgttgctgaggctggactgcagtggcgtgattgtggtgcaatgcagccttgaactcctgagctcaaggctcagctttctgagtagctgggactgcaggcacgtgccatcacacccagctaatttaaaataaaatctttcttttgtagagacgggttctttctttgttgcccaggctggtccataactgctaggctcaagcaagcctccctccttggcctctcagagtgctaggattacaggtgtgagtcactgtgcctggcttggctttaaagtttttgttgttgttgtttgctactattatagacgtgccagctgtgttttggttagaatttatttgtcttatcgttttccatcctatatctcacctaggggagacaagacccatgggcttgaatgctcattttctcatttcttttgtagcttagctgacagctggcctgggaggtctcagctgaaggtaaaaacaggctgataccagccagtgggctccagtggcctccttcttcttaaagaagtcatttcgttctaaatcaggagatttccattaggacttaattgcctagatgtatgggggatggattcctttctaagagagcactagcgtttgacagatcatgagtgatttgctgtttctctgcttaagttttctccgcttaagttttctccagtaaaccatagactttatactgtgtggcccttctgttatttgtgtttgtgttggcctgacagctttaactttttttgtattcttatgttccaggtgtgtctgtcttgtaaatagtgcatatagctggcgattcattttttctctcttttgtccatttatattgattgtggctactgatgtattatgatttgtcttagtctatgtagtgttgctattacagaataccacagactgggtaatttataaagaaaataaaattggcaggggaattggctcactcctgtaatcccagcactttgggaggccgaggcaggtagatcccttgaattcaggagttcgagacaagcctgggcaacatggtgaaagcccatctctacaaaaaatacaaaaattagctggccatggtggtgtgtgtgcctgtggtcctagctacttgggaggctgaggtgggaggatggcttgagttcaggaggtggaggttgcagtgagctaagatcgtgtcactgtgttccagcctgggcgacagagtgagaccctgtctcaaaaaagaaagaaagaaaaaaaaaggccgggcgcggtcgctcacacttgtaatcccagcactttgggaggccgaggtgggtggatcacctgaggtcaggagttgagaccagcctggccaacatggcaaaaccctgtctctactaaaagtacaaaaattagccaggcatggtggcggatgcctgtaatcccagctactcaggaggctgaggcaggagaatcgcttgaacccaggaagtggagattgcagtaagccaagattgtgccactgcactccagcccgtgcgacaagagcgagactccatctcaaaaaaaaaaaaaaaaaaaaagaaaagaaaagaataaaaaaggaaaggaaatgatgtcttatagttctagaggcttggatgtccaaggtccagggacccacatctggcaggggcttgttatgaggaagacagaaaggcaagagaccatgagagaaatgtaagggaaggggactaactaatgctttttttcaggaaactactcccccaataacttaacccactctagcaataatggcattaatccatttatgaggtcagagctctcataacctggttaccttttataggtcccagctctcaacactgttgcattggcaattaagtttctaacacatgaactttggggaacatattcaaaccacagcaggattaatttccacgtcagttttttgcttcctatgtgttctgttttgttgttattttttcctttcttgccttcttttgcattgatttttttgttacttttttcttctttaatgttatcagtctgtgttaatttgaatgttatacattctgtattcttgttggtgggggggcccaccctacaaattttaacctgctgccatggtccgaatgtttgtctctctccccccacccaattcatatgctgaaatcctaacccctaaggtgatggcatatagtattaggaggtaaggcctttgagagggcacatgaattggattcatgcccttataaaagagtcagagagatcccttgctccttcaaccatatgaaattatagtgaaaagatggctgtctgtgaaccagaaagtgggcattcatcagacactgaatatactggagctttgatcttacactttccagcctctaggactgtgagaagtaaatttctgtttataagttacctaattcatggtattttgttatagcagcatggacagattaagaagcatgcatattaatcttgaagtcgaaagttactttgggtcaagacagaacctgtaattccatttaccttttcccaatttttatgctgttgtctagagatttagttctgttttgatttcttgtaatcccacaatttacgttcttgtaactctgcctagacattattattgctttatgcagttaatatttgcttgaaattacccatatatttatcattttctttacttaatatttttacagcttcatcagttcatgtttgtttttctgagtgtttatttcattcgagttctcaaagcatagttttattatctttctgtggtatagaattctaagtggatggttaatttcttccaaaactaatgtaatgataatattttactcttgtaatgtctgctttgttttaaattgtgattttgctgtaggcttacatgtctcattatttgcttgatcctcagttgtaacaggatggtagtgatggctgcaggacagtgtgaatgtacctaatgccactaaaccgtacacttaaaaattgtttaaatgataaattttatgtagtatgtttattaccacagttaataagtaaaacaaagtttaagctggttaaagtggcaatgttacttgtgccaaacgcaccttgatttactaatccagccattctgcatcctgaacccagaatggtccacctaaaatatcagactgatcactctccatccagtgatttcctccggcatcactgttaagtccaaactccttggcatggcatataagaaagacattccaggttctggccatggcttacctttacctttaatgctgtccctccccaacactttattataaccttcactgagatcttggttaatgtatagtcagatttgttgtactcaggaaccagcagaatccccatatttgctctcttaaaagagcatttgtggtacaaaaagccaggtgcatgacctttgagcaacccctctgtagccaaagagaaagcccaaagcaataccagagcacatttttctggtaatatagcaaatcagacattcagagaaatcactccctgtacagtccatctaaaaaagttggattaaatatttttaaaaatatatggctaaatcaataaaagatttcaaaaattacatagaaaccagaaaggacaaggatctacaaatccacaaaagtatatgttagtactagagctaatgttggagagttccctgaacctccttgcaggacttgtgacaagggtgggcttggcttgtcttttggctggggtttggggtttataagggtacaggatggagggtgtggcaggccaaaaggcaacatttgggtatggaaacaggaatgcctgttcccatttagggctgtaggttttcaggcttgaggctggggcctttgccagggaactgtcctcttctgtctcgtattttcctgcctcctgtccatattattttccctatggccattgctttgggtacgtatttttccatcctcatgttgatctcattctggtgatctctaattgaaggagagactgtgtcagattactttagtctccctcacttaactttttattgctggcagcttcttgtttctgagtctggtcctgaaagtcagagggatgtacacatttcctggttcactcaattcccaaaggctaacaggcattcatcatatgtgactctgctgggtggaaattgggtcttccgagactcagattttaaaaggtctgtgagtgagttgaagaattaggagcagtttacagttctttgaacttgaaattcaaccttctttctttcttctgctcagagtttttcctgtcttgtactctgttttacagagtcctccttgggcagttacacaccattcaaaccactgccctcctgactcctccctctctccccttgcaagagctgtgacttctgaatggaagtgggagaagatcttgtcagggaggggtagaaggaagggaggaaatctagtcctgtaagactttggggtctccatgcagtgggatgtctggcagtctttttttctggtagatatagctcttgtattttataattaagctcaggcagtggggatggacaaagtattttccacatcttctttgtggttcatgctcctgttttacattgctcgtttgctcacttggccatttattcattcctttgataggatttccgagtaaagcagtatactcttggtcgattgtacttcttggtcaatacccattgatcatgcagttcgtggaagtttgactcagactttgagatatggtctctgattttcagttgatatagttattaccaatttttttagtgtgtttctttacatacattttgttgtaaaacagctggctgtcttgtttactcagcagtctgaagcaagtcattagacagctagcaatatttttgactagactagaatgtgagtaacattttgcatggttaatgcatggttgatgctggttttatacaggacttagcaccttgctttgtgcccattgacattgtgagaggtggtagagaagtaggataaagaggcaggaagtagattggttaattccgtgaatttggagaaagtgacttgtctaattttgtttgtctagggcctaccacagtgcctggccaattttgggccctcaaaagatgttggttgaatgaattaaatagtgaacaaacaaatgactgagtgttaaaagaagtttgttcttcaatggggaggaagtagtaagccttctgatgatgcagtcaggctatattgaaagtcaaataatttttagttggcagtttagggagtgattctttctggatgttgaatgtgatggcttctattttgtgtaaacattaaaatgagcgagcaaatagaatattttaaagacccatactgaataatgttttatttatttttacatttattcttgctccccagtgctctagagagttgtaaagaggtgtgacctcacatcccatgacttaattctcccttaggacattatttagatgtgttttatgatatttgttttatgtggagagatgctttttgttagagttgtctgaattcttttgcagggtgttttttcattttcaaaatgcaacaccaaatgaagttgcttcagaaattcttcttgtacagtagtgttatttacactcaaatcaaaatggtttgtggcagttatgcagttatatttgtaactttcctaaaacatataaatgtgtcactgtatcattaatttagatgactcaagatgacactaaaggctgtaaattgccttctttgtcagtgattgagatccaaatgataaattcttagtgcagtttgtttataagctctcaaaaaggcagtaatcttatcttctaaaccttatcttctaaggatgctagttagcatccttctttaggaaaaaaactgtggttttcacatgtatagcattacaaaaaaaacctcttgaaattaagatgttttctgactgaagtgcatcacgcactaggtgatcatacccattcacagaggagttacaacacattttttattattcactgtcattgttcacactgaagaaaagggcagtattctgagagttctcaggtgaagtctgacgctcccagacctaggggaatgtctttacctagagagtgctgctgagtggttaatgttgaaaaagaagtccctttcttgtaatgtcttggttctccaccaggggcggttttgtcccctaggagacattttgcaatgtctgcaggcatttttggttgtcacagctgggggataggaaggcacttagtgggttaaagccagagatggtgctaaacatgatacagtgctaaggacagcctcccacaacaaagaattacctgatcccaaatgcttagagtggagagattgagaaaccttggtccaatgtaatatgagatttcccccctaaattagtagattgaggggagactttattattccgttctgtttttcatattgtgaataagaagcagtagagaaaaaagcagtcatttcttatcactgctaggctacccttcttgattctgaaaaccataggaccatagggcattcaattaaaaagaaaacaaacacagatccttaaatccatcaacaacaaaaccaaaaccttccctgactattctctagtagatactttgaggctcaaatttatttacaaagtaatggaggagagtaaaattgtttgacgtctgttttacccaagtgaggccatctgtattcagtgatggaaataggatctgacaagaggggaggttctgttctaaaattttcttaggtgaagttgttagttttcaagatgactttatcatatggatatgggaagtgattctgtagagacagtacagttatccttcggtatccctaggggattggttccaggacttcctgctgatacccaaatccacagatgctcaagtgccttttattaaatggtatagtatttgtatatagcctttgtacatcctcccatatgctttatccctaaattccttagaatatctaactctgtgtaaatagttatattttaaaatttgggctgggtgcggtggctcatgcttgtaatcccagcactttgggagcacaaggtgggctgatcacttgaggctaggagttcgagaccagcctggccaatatggtgaaaccccatctctactaaaaaatacaaaaattagccaggtgtggtggcgggtgcctgtaatcccagctactctggaggctgaggcaggagaatcgcttgaacctggaggcagagattgcagtgagccaagattgtgcccctgtaacccagcctgagtgacagagtaagactctgtctcaaaaaaaaaaaaaaaatttgtgatatttttaattgttgtactgttttttatttttttgactatttttgcttcatagtaggattgcaggacctatggatctggtgggcccactctattctagaaaattagtaattctggattatgtaatgcttgctatgctagcaggatttactgttatagtaacagcaatgattccagacagttcctggtagtagatatcttacatgctaatgatgagtagctggcagttgagattatcaaatgatgcctctggcctgctctccatggcagacagagccagccattaaaagtcatccagtcgtgggaataaactagactgccccttcccccagtactcttttcacctaggatttcctgtattgcgtttaaggatttcatgtttgaaatccacgtgtctcatttggaaaaagcttttcctgcctttaatttagtataaagtaaaataagaaaatgattgaaattatgaggatcaagaaaaaataaaataaattaaatgaaaagtttcagtttggctcctgttgaaccctatacagtgaagttctctggaaccctctgcattcctccagagtcctccctggcttgatgctctataattgatttgtagctcaccatcttccaacttcctaagtattttagctgtgctgttttggctaaaagtaataacatttaaattctcagttggctgaaagcatctataaggttatattagagaagttttattaactcatataacttccctttttaatggatgctatatatgtgtatgatgtgacattacatttaggggacgaatgaaaagattaggagtgttaaattagaggacaggctcttttttatgtattttaatttaaaaaatatttttgtaggtatatagtaagtgtatatatttaggacagtctctctctctctctctctttgtttttgtttttgagacagagtttcgctcttgttccccaggctggaatgccatggtgtgatcttggctcactgcaacctccacctcctgggttccagcgattctcctgcctcagccttccgagtagctgggattacaggcatgcgccatcatgcctggctaattttgtatttttagtagagacggggtttctccatgttggtcaggctggtctcaaactctcaacctcaggtgatccgcctgcctctgcctcccaaagtactgagattacaggcatgagccactgcgcctggccaggacaggctctcttaaaagtgaggttaccgccactacttttattcttctgtatacaccattgtaaaagctgcgtggttctgagggtggaagtggagtggaaatacgagttgaaggagaaaaaagaacaatgtaaagtctcttgctgttagtaaagaacttgttcatgtatttaaaaaaattttttttttgttttattatacttaaagttctggagtacatgtacagaacgtgcaggtttgtttcataggtatacacgtgccatggtggtttgctgcatccatcaatctgtcatctacattaggtatttcttctaatgctattcctcccctagccttccaccccatgacaggccccagtgtgtgatgttcccctccctgtgtccatgtgttctcattgctcaactcccacttataagtgaaaacatgtggtgtttggttttctgttcttgtgtttgtttgctgagaatgatggtttccagcttcatccatgtccctgcaaaggatatgaactcattcttttttatggctgtatactattccatggtgtatatgtgccacattttctttatccagtctatcattgatcggcatttggtttggttccaagtctgctgttgtgaacagtgctgcaataaacatacgtgcgcatgtgtctttatggtagaatgatttataatcctttgggtatatacccagtaatgggattgctgggtcaaatggtatttctgtttctagatccttgaggaatcaccacactgacttccacaatggttgaactaatttacacttccaccaacagtgttaaaagccttcctatttctacacatcctctccagcatctgttgtttcctgactttttaatgatcaccattctaactggcgtgagaatgtatctcattgtggttttgatttgcatttctctaatgaccagtgatgatgagctttttttcatatgtttgttgtctgcataaatgtcttcttttgagaagtgtcagttcatatcttctgcccactttttgatggggttgtttttttcttgtaaatttgtttaaattctttctagagtctgggtattagccctttgtcagatggatagatcacaaaaattttctccctttctgtaggttgccagttcactctgatgatagtttcttttgctgtgcagaagctctttagcttaattagatcccatttgtcaattttggcttttgttgccgttgcttttggtgttttagtcatgaagtctttgcccatgcctatgtcctgaatggtattgcctaggttttcttctagggtttttatgattttacgtcttacgtttaggtctttaatccatcttgagttaatttttgtataaggtgtaagggagcagtccagtttcagttttctgtatatggctagtcagttttcccaacagcatttattacatagggagtcccttccccatgcttgtttttttcaggtatgtcaaagatcagatggttgtagatgtgtggtattatttctgagggctctgttctgttccattggtgtatatctctgttttggtacccataccatgctgttttggttactgtagtcttgtagtatagtttgaagtcaggtagtgtgatgcctccagctttgttctttttgcttatgattatcttggctatgtgggctctattttggttctatgtgaaatttaaagtagttttttctaattctgtgaagaaagtcaatggtagcttgatggggatagcattgaatctgtaaattactttgggcagtatggccattttcatgatattgattcttcctatccatgagcatggaatgtttttccatttgtttgtgtcctctcctatttccttgagcagtggtttataattcttcttgaagaggtccttcatgtcccttgtaagttggattcctaggtattttattctctgtagcaattgtgaatgggagttcactcatgctttggctctctgtttgtctattattggtgtataggaatgcttgtgatttttgcacattgattttgtatcctgagaatttgctgaagttgcttatcagcttaaggagattttgggctgagacgatggggttttctaaatatacaatcatgtcatctgcaaacagagacaatttggcttcctcttttcctattcgaataccccttatttctttctcttgcctgatggccctggccagaacttctaatactgtgttgaataggagtggtgagagagggcatccttgccttgtgccagttttcaaagggaatgcttccagtttttgcccattcagtatgatattggctgtgggtttgtcataaatagctcttattattttgagatacattccatcaatacctagttttttgagagtttttagtatgaagggctgttgaattttatcgaaggccttttctgcatctattgagatagtcatgtggtttttgtcattgactctgtttatatgctggattacgtttattgatttgtgtatgttgaaccagccttgcatcccattgatgaagctgatttgattgtggtggataagctatttgatgtgctgttggattcagtttgccagtatcttattgagtatttttgcatcgatattcatcaggaatgttggcctgaaattttctttttttgttgtatctctgcctggtgtcgggatgatgctggcctcataaaatgagttagggaggagcccctttttttctattgtttggaatagtttcagaaggaatggtaccagctcctgtttgtacctctggtagaatttggctgtgaatccatctgttcctggactttttttggttggtaggctattaattactgcctcaatttcagaacttgttattggtctattcagggattcgacttcttcctggtttagacttgggaaggtgtatgtgtccaggaatttatccatttcttctagattttctagtttatttgcgtagcttgtttatagtattctctgatggtagtttgtattgctgtgggatcaatggtgatatcccctttatcattttttattgcatctatttgattcttctctcttttcttctttattggtcttgctagcagtctttttattttgttgatcttttaaaaaagccagctcctggattcattgatttttcgaagggtttttcatgtctctatctccttcatttttgctctgatcttagttatttcttgtcttctgctagcttttgaatttgtttgctcttgcttctctagttcttttaattatgacgttagggtgtcgattttagatctttcccactttctcttgttggcatttagtgctataaattttcctctaaacactgctttagatgtgtcccagggattctggtaccttatatttttgttctcattggtttcaaagaacatctttatttctgccttaatttcgttatttacccagtagtcatacaggagcaggttgttcagtttccatgtagttgtgcagttttgagtgagtttcttaatcctgtgctctcatttgattgcactgtggtctgagagactgttatgatttccgttcttttgcatttcctgaggagtgttttacttccaattatgtggtcaattttagaataagtatgatgtggtgctgagaagaatgcatattctgttaatttggggtggagtgttctgtagatgtttattaggtctgcttggtccagagccaagttcaagtcctgaatatccttgttaattttctgtctcgttgatgtatctaatattgactgtgagttgtcaaagtctcccactattattgtgttggagtctaagtctctttgtaagtctctaagaacttgctgtatgaatctgggtgatcctgtattggaggcatatatatttaggatagttagctcttcttgttgcattgatccctttaccattatgtaatgctctttttgtctcttttgatctttgttggtttaaagtctgttttatcagagactacgattgcaaaccctgctgttttttgctttccatttgcttggtaaatattctttcatccctttattttgagcctatgtgtgtctttgcacatgagatgggtctcctgaatacaacatactgatggatcttgactctttatccaatttgccagtctgtgtcttttaattgggggcatttagcccatttacatttcaggttaataatgttatgtgtgaatttgatcctgccattattatgccagctggttatttttccagttagttgatgcagtttcttcatagtgttgatggtctttacaatttggtatgtttttgcagtggctggtacctgttgttcctttccatgtttagtgtttccttcaggagttcttgtaaggcaggcctcatggtgacaaaatctctcagcatttgcttgtttgtaaaggattttatttctcatttgcttatgaagcttagtttggctggatatgaaattctgtgttgaaacttcttttctttaagaatgttgactattggccccactctcttctggcctgtagggtttctgcagagagatccactgttagtctgatggacttccctttgtgggtaacccagcctttctctctggctgcccttaacattttttccttcatttcaaccttggtgaatctggcaattatgtgtcttgaggttgctcttatcgaggattatctttgtggtgttctctgtatttcctgaatttgaatgttggcctgtcttgctaggttggagaagttctcctggataatatcctgaagagtgttttccaacttggttctattctccctgtcactttcgggtacgccaatcaaatgtagatttggtcttttcacatagtcccatatttcttggaggctttgttcattccttttgattgttttttttttgttttgttttctaatcttgtcttcatgctttatttcattaagttgatctttaatctctgatatcctttcttccacttgattgattcggctattgatacttgtgtatgcttcaggaagttcttgtgctgtgtttttcagctccagcaggtcatttatgttcttctctaaactggtaattctagttagcaattcatctaacctttttttccaaggttcttagcttccttgcgttgggttagaacatgctcctttagctcagaggagtttgttattacccatctctgaagcctccttctttcaatttgtcaaactcaccatttttgttcccttgctgctgaggagttatgatcctttggaggagaaggggcattctggtttttggaattttccgcctttttgcgctggtttgtccctatctttgtggattcatctacctttggcctttgatgctggtgacctttcagtggggtttctgagtggacatcattttgttgatgttgatgctcctcctttctgtttgttagttttccttctgacaggcccgtgtgctgcaggtctgctgaagtttgctggaggtccagtcgagaccctgtttgcctagggatcatcagcagaggctgcagaacagcaaagattgttgcccgttccttcctctggaagctttgtcccagaggggcacccaccagatgccagccagagctctcctctatgaggtgtctgtcggcccctgctgggaggtgtctcccagtcaggagacatgggtgtcagggacccacttgaggaggcagtctgacccttagcagagtttgaatgctgtgctgggagatgtactgctttcttcagagctggcaggcagggacgtttaattctgctgaagctgcacccacagctgccccttcccccgaggtgctctgtccctgggagatgggagttttgtttataagcccctgactggggctgctgcctttctttcagagatgccctacacagagaggaggaatctagagaggcagtctggctacagcggctttgctgagctgtggagggctgtgcccagttggatctttcccggcatctttgtttacactgtgaggggaaaacggcccactcaagcctcagtaatggcagatgcccttccccccaccaagctcgagtgtcccaggtcagcttcaggttgctgtgctggcagcgataatttcaagccagtggatcttagcttgctgagctccatggggttgggatccactgagctagaccacttggctccctggcttcagccccctttccagggcagtgaatggttctgttttgctggcgttctaggggccagtggggtatgaaaaaagaaaacactcctgcagctagctcgatgtctgcctaaatggccgcccagttttgtgcttaaaacccaggtccgtggtggcataggcaccggcgggaatctcctggtctgtgggttgcgaagaccgtgggaaaagcgtagtatccggaccggagtgcactgttcctcaccgcacagtccctcaaggcttcccttggctaggggagggagtttcccaaccccttatgcctcctgggtgaggcgacaccccaccctgtttctgttcgccctccttgggctgcacccactgtctaaccagtcccaatgagatgagccgggtacctcagttggaaattcagaaatctcccgccttctgtgttgatctcactgggaactgcagatggagctgttgctattcggccatcttgccagcaacccctcttcatgtatttttaaaatggttaatggtgagtgttaaaatgttgtggtgtttagattttgttgaataaatttaaaagaaagatataatgattttgtttcaacatgtaaatatttatagtatgctagaaactatgtcctttataattttcaatggaaagttttagatgtgaaattaaaaagtacataattttctcaaaaaaatttaaagaagtgtgtgagtgctttgaaaaagccttttttgcctgtagcccaaactagaaaatagatttcttattataacccagcacaggcacccaaatgcgaaagtttataaagcattagttaccatgtataatgctctcaatctttttgccttctttccctcttcccctactttttttttcttcctatttcattccattaaaaaaaaaaagtctggtcttgacctgctaaattgtttacttccactcaagggttggaacttgcagtttgaagcaaacacctaaatctaagatagttttttctttctttgtttttctttcattttttaaaagtctgagcataaataagagaggtggaagtaaaatttatgttaatcaatttaattaattagtttccaagctgttctgtggagctgaaaagtgacatcagtttaaatgtcttctcttgcttatcctctcaggcatctgtacctcttccccattacaccaatatcaaaaactacaaaataaaaaacctaggtgggacggaaaaacagggggagagtctttatgtaatactaattagtagtctaactgatactaaaggataaattttaaaagaggattaaatcaggtctctactatgaatctaaaatctgttaaatactgaacttgttaattaaggagagaactagtgagatactgcaactggttcaaaagagaactcaaagcctcatcacacactgataggcaaataaggaatgtaaaatttataaatggatgcaaaattggttagtatccccggggcaataacgaatgcattttaccagaagcatttttatggataggaattacatgcatgactatcagttttatacaactgatctcctattcctacagatttataaaatagcctagtcaaaacaagcaaaggtgggaataacctgaatgggtgagctagccaggaaatctactgaattctaaagtattaaacaatttttccttctactgattagatttaggctattaattcctaacctaggtctaaaacactttgccacctgaaggccaagtccagttttagaggatttctaccatctgcacagtatttgtaaacatcgtgaatttcttgctattatttaaaacctagatttttacataatagctggatttccagtttgtcttggaaaatcagattgaaatggaatttactattattttcttctcttaagataaagtcccctacttttccttttcttattcataataccacttttccatatcatttctgtacatcccttcttttctcattcaaacttcacccatcttaatccagtcccgtttcagtacaactgtcttaacttcttggctccaggctcttctcagtctctctagcatgctattttacatttaatctctcttaaatactttgctcaagactccagactgcccagtaatgtccaacaaatcctgttttgccactctgaatatgctgacactttcctgacgcttacaactcttcagtaatttatttcttcccttcttttgcagtcttgatttctgttgcttatctacatggttccttcctctagtgaggttaatctctttgctttcctctatacccactatgctttttgttcatgttgatccttcctacaggaaaggccttccttctcttctttgtttatacacatcagatgaagttaaactcaaggctacctagtctgcgcagcctaccagagttctaattcacattgatctttctggaatgttttatgctttctagcgttgttttaggttgtgtattcttatcactcaagattaaagctaccaaaagcatggcctaccttcctctgtactgtattggtatctctgaggagaaattagtaaacttgttgtctaaatttttatatttgcataatcatgcatttcactgtacaaaaggaggaaggttaaacatcgttcaggattttaatttttcagcactgtgaaatttacatatttattgtatttggaataaaatgtgtgtgggtgatatatagatatatatatatacacacacacacacattcatacacatgtatttacattattctgtctatagacagtagctgcatcaatcacacaggaattttagtctatttgatatatttacattaactagtagtctgttgaaattcaaaggagataatcaaattgagaaaaccatgttgcctaatccttttgtcatggataatattacttaaaagggaagccttggagtaataggaaaaaagaaatatattctagtgctctcctacctctattctgaacaataggatctgccctgctaagcaattaggcaggcccttttatacgcagtctgtgtataccattaaaagtcaatacagtgtccttttattttctagttttgtgtgatgcatgcagaaaagaaacattttgctttttatataaagactgtccctgtaacacaaagtgggttaagagatttgagacaattttcccaataattgtgaactaaaacttacatgtgacatctaattgtgtcaataaatttttaaagaactttattgagattggatcagtaacacattgaaaatatacaatttgatgagttttgatgtgtgcttatactgctgaaacagtcactgctgtcaagataatgaacatacccatcacttccaagagtttcctgctactcccttgtcatccctccttcctttgttccctctgtgttcctcccctccccaggcaacctctgatatactttctttcactgtacactagtttgtatttttgagaagcttatataaatggaatcatatagtatgaacttttatattgtctggcttctttccatcagctttttttttttttgagatcgttgcatgttgtagcatgtatcactattttgtttcccttttactaccgaatgggatgcatatggcagtttttaaaaatccatttacctgttattggacatttgggttgtttccattttttggttattaaaaaaaaagttgttacaacatttgtatacaagtgtggacctacgttttcatttcctaagggctaagttatatggtggatatatgtttatgtttttaagaaactgccaaactgttgtccacagtggctgtaccatattacccttctaccacaagtgtacaagagttccagttgctccatatctttgccctttgccaacacttgggaaagtgttttttgtttgtttgtttgtttgtttgtttgtttttgtagatagggtctcatagccctgtcacccaggctggagtgcagtggcatgatcttgcctcattgcatgctcgacatcctggtctcaagcaatcctcccatttcagcctgccgaatagctgggacctcaggcacacgccaccacacctggctgatttttgtatttttttgtagtagagatggggttttgccacgttgcccaggctggtcatgagctcctggcctcaagtgatctgcctacctcagcctcccaaagtactggaattacagatgtgagcccctgtacctgaccggggcaaatctttttaattttaaatattttaataggtatataatggtatctcattgagattctaatttacttttccttgttgactgatgatatgggtcattttccttgtggtggtttgctgttcatgtatcttgctaggtgaagtggctgttcatattttttgcccggtttttattgagctgttttttcattattgagttttaagagttctttatatatcctttatatacattatttatcaaatatgtgatttccaggaattttctcccatttttgtggtttggacagatgaatttatttatttatttattgtttgagacgaagtttcactcttgttgcccaggctggagtgcaatggtggggtctcagctcactgcaacctccgcctcccaagttcaagtaattctcctgcctctcagcctcctgagtagctgggattgcaggcgtgcgccaccacatccagctaatttttatattattagtagagatggggtttcaccttgttggctaggccaggtctctaactcctaacctcaggtgatccacccgccttggccccgcaaagtgctgggattacaggcgtcagccactgcgcccggctgacaggtgaattctttatcccccacctgtatagaggtagctccaggatccctgagtattaagatgcattataggttgggttctagctcagataggtaagttgccactagctaataatgggtttttgagaataaaatttggtatgtttcctgtttataaatgtaaaatttgctcattgtagacaattgaaaaaaatactgaaaactacagagaaggaaatgagactggagtattcttgggaactccaggcggaagtccagctgtcaaggccatgcatatcagaagcaagagtgcttagagcttaccgcatactaggcttggggcagcaggattatacaggtcccttccacttaaattactcttaattctgctaaggattgcctcagaaatatgatgggcagaggttgcagttttttttccctaaatgtaagttcactgctacacctacagttttggatcattgtctggcctatccacttaatgaatgtttatattataaaagtatgaagtaagtgaaggtcttcatagatgttgtgcaggtagtaaatgtcttcacagcatagagctgagcaaggcttgggaaagtagggactgacaaagacagaaatggaattaatcaaatgtatttgactaacattgagaaatattatattaaagaaagtccaacacagacgtcctaagtgttaagtgtttctggtctctgctgctttactgatgaaaagcattcagttttggtgccaatagaatttggtttaagattgtgctctactctactagctatgtaaacttggaccaatacttaacctagtttttcacttcagttcttttttgttcatttaacacagggtcttgctctgtcacccaggctgcagtgcagtggctcactttcacccccgccttctgggctcaagcagtcctccaacctcagcctcccgattagctgggaccacaggcacacaccaccacagctggctaatttttttttttgtagagacacgatttcgtcatgttgcccaggctggtctcaactcttgggctcaagcaatttgcctgcctcggtctcccaaagtgctgggattacaggtgtaagccaccatgcctggtcctactttacttcttttacttacacaatgtgaataattgtgtatacctgtggggctactgtaaggattataggagatagagcatacagtagtcccccttcttatctatggttttgatttttttactgtttcagttacttatggcaactaagtaaaaaaatttatgagtacagtactataaggttttaagagagggagagagagggggaccatattcacataacttttattactatatattgttatagttctattttattattagttattgctaatctcttagtgtgcctaatttataaattaaactttatcatagatgtgtacatacagtaagttctcacttagcatcatggatgggttcttagaaactgactttaagtgaaacaacatgtaatgaaaccagttttaccataggctaattgatataagcaagagttcatttcttatggcatatttctggtcctaaaaacatcaccaacttctaaataaagataaaaacttttctaatgttaaacattgaaatgaatgttagtgatacatacatttaagaaatattaataaaacaagtaagataattatttacccaattattctagttaagtgctacagctggccagaggctcttctggcagcttaagccctcaaggcctcaggaggaaccagctctggacaggaaaccactctattgcagggcactcacacacccacccacactcactcagaaaggaaccatgtagacatgccagtccacctaatggacatagctttgggatgtgggaagaaactggagtactggggagaaaacccacacagacgtagggagaatgggccaactctacacatatatagacagtggccccagctgggaatcaagtttttttttttttctcatcagtattaaaatgaagcaacattacttgggggaaccttttgtataggaaaaaacatactgtatatagggtttagtactattgttggtttcaggtgtctacttgggatcttggaacatgtcccccatggataaggaggaaacgattgtatacggtattttgatatagggtctgacacactgtaggaactcagtaaatgttagtggcatttgtagttattccccttcgcctttccagttactagtcttaggcagggtaactaaatcttgctgtacccctcatagaggggagatctaagaatggtatttgccagtccttttctccactgtaggttacgtttttataccactgtgtgtttttgagtgatatgaaaagaatatcatgggattaagataagctgatggcagattttagtgctttagcatatgttcttttcaggcatggaggggattactcaagatacatggttagactgaccttaggtacctagtggcatgagtctttagcatcagcagcagtattgatcatacaagggaatcccaagactcttattgtaaactaggaagcatgttcccacagaacaacatcttgaggtggactgtagtaggggaaggagttaagttggtggtcagattggtggagtgatagacacgagggtgactgatgcctttgtaataatttcggaactgtctgaaattatccaaagcaaatctttgttgccattctcagttcttttctatagtctctgcctcctttgccttattcctgacctgtttttttccatgcctacacgtttcttgacttttggagcctaaattatccctccttctataatatatttgggatattataatgttctgatgtttggaagtgacagattataatgttatgctttgccagtaagtcatgctatgtaacagactgctgcagccagtgtgtttaaatttgatgttttaggtcattaaaaattttaacgtttcacttaattacttgttataaattccatacacaatacttgggttaaaaacaggttgtttgttttcttatactacacttgagtttagtctggcttttataacaacttaaacttttggggttggagaatgacttattaaaactacttttgtgatatccgtgtttgttccatttctgacttgtggccagacatcaaaaggcattggaaatttgagtccttctgttaaaagactgttattcatatgttagaagaggagccacttcgtaaagggtctctctatatatacaaaagttcttgtagcactctaatggcatgtggcacagtgaacaaggcaagtcacatggccacatctaactccagggagggaagagaaaactgtcctattatgtctccataaaacagagctggtaaacagccctaacgattcggtggttctcatttgtgttcaccatatattcagatctgtctctctactactataggcaaagtaactcacccctccccaaggcagtctgtctcattgccccattcagatatagcatcatgctcaaagttcagtgcctctggctgatacacaagagtctgttcatcatgttcagatgtggtactcttggtctggagacttcatgaactaaaaagacaagtaatctgcccctcctttacccttacaccctggtggaactggtaagcataattgccaaaaccactcccatttacaaaggcgaacaaagggagagagagaacagtcaaaagttgtagcaattctgcaattccacagtagaattttgggggacccctatcttgggcccaagaatgttccttaattatgtccagattctgcttcctgggagaggctcctccatccattgtcttccatgccattggcttcaccctgttggaattttttccttttcggtaacttccttggctacaacggaaatgggcactgggcctccttgggggctgaacagttttctctggcagcttcttatctgtagaaaattggtgtctaagggttgttttaagcattcaataatcatattactctttgaattgagaccagattatttttgcagtacaactctcaaaaattttgttggtttcttatctacttaactttagtcagcttcgtgtgtcaatagccagacctaaaatttttgctagatgtaattcttagatttcctgtatttcttatctttttcacctctgtgcatgcccccctcttctctttatttatttgaggatatcttggctccacaaggcttcagttggagacccacacccttagtctcttttttctgaaccgttttatcccaagagaaagaatttactgagtgccacattagtctacactgaggttttaatatcagctatataccctttatttgatccttagctgaggctgagttttaattagctgttgttccttaaaggccttctcagttttgtttttaactgttcgaggttgaaaagtagttgccttttccaattgtgtaagtcgtttaatttgaaatctattgtcttacatttctgcttgcaaaccaattcttttctgacctcattttttccttgtgggggtttccctttatcttattcagttactttttttcatttgattccttgtcttttcatccttttcttttgctttttcatctaatcttgtttttcaccagtttcattagaggccatctctccttgctctctatagagagtgccaaactgttttcaaacttttcttttgtatctattactatatccagtaagcactttctttaaggatttcagaagctgttccttttttctaattagaatgttttcttcttcacatgacttgtgtttttcttctccattttgaattccttttttaaaagtgaaatctgccagatatgttttctagcaaccaatagattccttttaccattcacttatgttggggttcatatccttctctgatctacaactcaggtcaggccaaccagcacaaatcccagtataattttcagttgctagaaggctttcactcacattaaatcctcaccctcccttcttggttttctgctatgggtgaaatatatgaaaactaaaacttggagcacttgctgccaccaggattattctttgctttctcttttatttttttggcttgtaaggaactgtcctcagaatcctatgtgtccttgcaagtacccttcaactttctccccagttgttttctagaaattgttggcctacttgaatgtataacaatgggaatagtaggaaaagagggttgtgtatgtgtgcttgtatttgtgtgcgtgtgagcatgtgtgtatgagggatggtcacaataatctcaccaacgcaaggatttgcactgatgggaatttaaagttggctgcaattttataatgggtactgatatggtttggttctttgtccccacccaaatctcactttgaattgtattaatgcccatgtgtcgagggcaggaccaggtgtagataattaaatcatgggagccatttcatgttgttctcgtgatagtgagtgagttctcatgagatctgatggttttataaggggcttggcactcattctctccctgtcgtcctgtgaggaggtgacttcccctatgcttttaagtttcctgaggcctccccagccatgtgaaactgtgagtcaattaaatctcctttctttataaatcactcagtcgaggatatttcttcatagcagtgtgagaatggactaatacaggtacagtgcttgagtgtctcaattaggtaaccatcagtaggggatgtttgatgtgttttcttttctccagtggccttagtcttatgaggcttaaggtagtcacaacatgacaagaaacctggacaggtctgtttattttattttttcctatcacccaaaccagtgtctgttttatggttagcaagatccttccagattctcgtgttatctgttgatttgagttttgtatgtagggatttcctgggttattttctgaatcttcagaacttgagagaggttgcactgtgaacttcaaaggatacaggagtttaaattggaagatcattttctagctttgtcggctgacatctagagaaggctcatggttttacatgtggccatagaattcctaagagtaactattgttatatcgttatgctgaactttttgctaaaaagggtaagagttttacagttgcatctgaatttgacattgtgtaatgtttctatttcaggtagcagcagcagcagcagcagcagcagcagcagcagcagcagcagcagcagcagcagcagcaatgtttcacttcttcagaaagcctccggaatctaaaaagccctcagtaccagagacagaagcagatggattcgtccttttaggtgagtctttttaagaaacaaaataattagatgaattatgttctctttaaaaaattacttgaaaattatatgattgattttaaattatttcttataatttcagaattaatttatgtgtttaatttttaaagcgtaaaatctgtaaagatgaaagtcatcaattacttggaatagtgtcatcaagtgagacttttcttccgtgttgatttggctgtgttctccaagttaaatgtgtaaaatcacttctttttccccccctttttttttttaactgtggaaaatctaaagtcttcaagaatccttgatgaattcaagttctgtcttataaatagtactaaccttgtttcataaattagcatctgaaattaaattaggcatccaataaatatttgctgaatgaagtagactttaaaatctaaatatgttaaatagtgtttcctgtttaagactattttctattataaaattaatacctgcaaattttaaaggttttagtgtctttaaaaaatatttcttacaatcaaatacagtgttcttcaccaggggagttctgaaaagtaaaatttcctccatgtcatgtcacatttcttcccctgaggaaaagttttgcacaacatctttgtatgctcttcccagaaattctctttccaaagtatggtgtggggtagtcaaacccagtgtttccttgtggttctcatccttttccatgctggacctcctcccaccaaattcctactccttctctgagaagatttgcattaactcatatggtcttcactccctggaatgtttctctgggtctccttttccagatactggtttcctacctcttacttcctttatcttggccccatcagactggcatctgctagcatcagccaatgctctgtaggctttgagaaataagggatgtttcccttagatttaagggtaatctctgtgagaccagaatagagtttttctcgtggataaactttactatagaattttccatcatttctacagccatgttctggcaggcctgttgtttttgagaacctgtcttgtatgtccagggacaggagcagtagctgggaggttgctcagaattgttttcttcagaccagatcccttatacctgaggtaaaaatagtggggcttagtctttgaccagggctgatgatttttctgggtagccttctgactgggataaggtagggtgcagtggacttaattgctaatatgacccttccttcatagtgtgtcaggaatttatgccttggcttccaagtcagaactgactctgttaactccgattttagttccttgaaagctgccagtgttacttttttcacacttcttgaattagcctcgctaacagaaaacttcaggggtacatcaggcctcctgtgaagtttctctttttcaggagtttcacaataaattcttctctcagaattttttccaaaaaactcttgttttccactctgttatatattcctgattttaaaatacctctgaagtcttaacacatatacagggaactctgcttttttctgttgtttttattatatatgtatttaaaattttttttaaaattatttttaaagaaaatagagatggggtcttgccatgttgcccaggttggtcttgaactcctggcctcaagcaatcttcctgcctcggccccccaaagtgttgggattacaggcatgagccaccacgtccagcctcttttctgttgtctttatgattagaaattgacattattctttttgttatcaaatagccatttagaggctgtaagttgggtgtactggcatctttgaaagcacatagaattcctaatgctggaccttaaactttttattcatctactttatccctacttctctgccactttgtaggatttctgagacaaattttaaccaccactgcagtggctcctggtgctgctaagatctcctccaatttctggtagcatgtagtcctgatgagacattccattgcatgtcttgtagctatctcagtagaagcccagtttccagggccttctgcctccgagtattatctactatggatctcctttccctttccaggaaagactagtttaagaagtagtctttctttaactgagcctcagaaggcacacaaacttccaaatttcgtattttaagaaggaatttccgggacctaattactctaatatgctctcagtaccagctgctccatctgagggaattttcccaggaccatcttggactagcataattggtgtcgtacccagcaccatatgtctagcagttgaacagtcatggtgaggaatcacttccgtcgtagttccaggatagcagtttaatttgcagtgcagctggtgctgtacctggttcaaatgacccaaacaaatcaggtccgccagatgttggctgaggcctcgttgcccttcagctcctctgtctgctgatgcttgtctctgtttagcctcatttccccccaggtgcaaagctccaccccttcaccattttcataaaatcctctgtacatagtcttctgtgggtaccattactctcctgaagttttgatggtatcagtcagcatcatgtctcagctcttacttcctctgtcttcgttctcttttcatcattcatcccctcttccttcttccgcagaagcatctcagaggctctccagtgacgtgctgttaaaagtgctgaccctgggtcagaccctttgggttggcttcgtggctccacgacttactctctacccttggcaggttagttacccttcccagtaccacttagcatatctaggaaatgagcacgatatcggtacctaccccatgaagttattgaggggaataaatgagttaatgtgtgtaaaatgtttagaaaaaccctgtgagtgaggtagtactattatatcaccatacacaggctaggatttaatgtttccaagtttctccagttagtatgtagcagatctggaattagcccaggcaatctgacttcagaacctatcctctaaaccactgaactatccatctttttgtaaaaaaagttatatcatcagttttaattctaagacattattgacatcctaacctctttgttttttaaaaaaagttgtattctctacaattgaaaagagaaagtgctgttttttatttgttttaataaaagaaggttggtggttgtaatactgttcataaagtttggcttttattttggctaacccaaactttttactatttaatagtttaaatgtttttaaaatattttaaaatatttcagaaaactccttgatgaagttgaaattggaagttggtatatatggtttaattagtgaaaacatccttcagtggtgaagaacttaactgaattgacagataaagatcttgacagattattaggaatatagttaattgtctttaaagttatagttaattatcaggtaaactcttttttaaaaaattgatttgctctgctaggtttctctttttattatatcattctatactgacatatataatatctactttagtctcagagcatactgtataaaatattctggaaaaagtcaagtagatcaaatggtaaatagaaaatgcttttaatgcttttattaacatggacacatacttgcacacatctgttttgttttaaattttttatttttaatcattatgggtccgtaatagttgtatatatttacagggtacatgtgatgttttgacacaggcatataatgtgtagtgatcaaatcagggtaattaggatatctatcacttcaagcaattatttctttgtgttagcaacattcaatttccactcttttagttatttaaaaatatacaataaattattgttaactatagtcaccctattgtgctaccaaatactagatcttattccttctatctaactgtatttttgtacccatcatccatccccattttatttccctctttctgctacccttccttgcctttggtaaccatcattctattctctatctccatgagttcaatttgaaaaaaactgagctccctcatatgagtgagaaaatgtgaaatttgtctttttgtgcctgctttatttcactttacatgatctcctctagtaccatctatgttgttgcaaaggacaggatttcattctttttttatggctaaatagtattccattgtgtatatgtaccacattttctttatctattcatctgtttttttgtttttttttttttttttttttttttttgagacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatctattcatctgttgatggagacacttaggttgattctatatgttggctattgtgaatagtactgcaataaacatgggaatgtggacgtctctttgatatgctgatttcttcttttgggtatgtacccagcaatagaattgctgtatcatatagtagttctgtttttagtttttttgaggaatctccatactggtcttcatactggctgtactaatttacattcctgccaccagggtatgaggtcccttttctacacatccttgccagcatttgttattgcttatcttttggattaaagccattttaactgggttgagatgatatctcattttgattttgatttgcatttctctgatgatcaacaatattgaacgtttttttaatatgcctattggtcattttgtatgtcttgagaaatagctattcagatatataaaaaaatatatttatatattatttaatatatatttaattttatataataaatatatatttatatatttaatttatagataatatatatttatatatttaatatagataaatatatttatatacttaatttatagataaatatatatttatatacttaatttatagataaatatatatttatatacttaatttatagataaatatatatttatatacttaatttatagataaatatatatttatatatttagtttataaatatatatttatatatttagtttataaatatatatttatatatttagtttataaatatatatttatatatttagtttataaatatatatttatatatttagtttataaatatatttatatatttagtttataaatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttataaacatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataaatatatatttatatatttagtttatagataatatatatttatatatttagtttatagataatatatatttatatatttaatttatagataatatatatttatatatttaatttatagataaatatatatttatatatttaatttatagataaatatatatttatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatttatatatttaatttatagataaatatatatatatatatatatacacacacacatattaagaggcaataactcactatgttactcaggccactttcgaactcttaggctcaagccatcttcctgcctctgcctcccaaagtgctgggattacaggcgtgagctgctatgcctggcctgcccattttaaaattggattattttattttttcctgttgagttgtttgagttccttatatatactgattgttcatccattgtcagatgagtagtttgcaaatattttctcccattctgtgggttgtctctttactgttgattaatcatttcttttgttgtgcagaagccttttaacttgatgtaatcccatttgtccatttttgctttggttgcctgtgcttgtggggtattactcaagaaatctttgttcagattactgtcctgtagcatttgcccaatgctttcttctagtagtttcgtagtttcaggtcttagatttacgtattttatccattttgatttgatttttgtatgtggcgagagataggggtctagttttattcttctgcatatagatatccagttttcccagcaccactgattcaagacttccttttcccaatgtatatccttggcacccttgttgaaaatgagttcattgtaaatgtgtgaatttattcctgggttctgtatttggttccattcgtccatgtgtctgtttttatgccggtactgtgctattttagttactatagctttttagtataatttgaagtcaggtagtgtgattcgtctaattttgttgtttttgcttagaacagttttggcttctctgggtcttttgtgattctatataaatgttaggattattttttccatttctgtgaagaatgtctttggtattttgatagtgattgcattgaatctgtagattgttttgggtagtatggacattttaacaatactgattcttccaatccataaatttggaatatctttccatttttttttatgtgtgttctctttggttgctttcatcagtattttataatttttattttagagatctttcactttggttatatttattcctaagtattttattttactggtagctttataaatgggattactttcttggtttctttttcaaattgtttgctgttggcatataaaaatgctattgatttttgtatgttgattttgtatgccgtaaccttactgaatttatttattagttctgatagtttttttagttgcatacacatgtatcatggttagcatatatccacataactttttttgtggcatcgtgtgcaatacgtacattacagaaaaataaatatattttgttggtttgtgtgtttgttgatgtctaaatgataaagctaagtaaaaacttataaacatgattatatttgtagcaacaactttttatcaatatggacaccacagaatttgttagattatctccttatgtggcctttataacccatttctagaaaggtcagagtaaattatgttgtttaagctataaattatctatttttttccacttgagaataccttttcccctaggcaagcatttctgcttaacacaaataggttttaggtcacaattattagatggcattgcagagttgatggaatcaacacatcatgacttgaaattcaggtctgggcagagtctagacacttgttttggtaataggaatatctgggctgttcatatacagttagctcacatttggacagaaaacctttctccgcattaagatttcgaaagcttttagcctctgtaaaatgtctagtggtgccgaataagaataagggaaaaaagttcttgtagaaaaacatcctttcccttgtaaccagttcctattcacgtaagaaggtaatagctattccttcattcagtaatgaagttgaagtaatcctccagggtactcattttacacaaaaacaaattgcagttttcatttgcatcactgggtggcgatttttcatagccttatactactatttaaaaatccagcaagcatggcactattcgtaattaccagggttttctcctgttatgacatgtttaattgtacttttaagacattatctttaagttgattacaaatttactagtgtagtggcaagctcatagttattttaagttaggaaaagggatattgcgtaaatgttaggatataattccttccaaaactaagacaaaagcatgaattagcttattatgttatagcaaaaagaaggaaaaataacaacaaaaagtaataggatataaatgaaaaggaacaatttagatattgttgttggttcactaatattgttgaccaaatattgaatataactttgaagcaggcagaatgaaattgggcaaacactattgtagagattaaaggaattgggttacagtacaagggaaatgcatcatggttttcagaatatgcaggtgcttcttcaagtagggcataagaacttctagtttccattaagctaattattttgtaacacttgctgaatttagaaccagaatttaataattcacagcagcttggatttcaccttttaaaatacttaaaacacattgaaatatgtaatttagtctcaccttctgttttccagtctcaatgatcagtcagatattgaaaataagtgagttatttttaagattatctcctatggaattcctcattctgggaaccaaaccacatatacatacttcatttaaactatcatatttttatatggaacttttaaaggtagtctcttcatcgctgtgttgtttcctttatttaaaagtggaaatttagctgtatacataaaaatttacattctaaggaatgagggacagtaagtcactttgattctgtctagggttgaaggctttaattaaaacagtgacaaaaactaaacaggttttcaacatgtgcttcctatttttattgcctgttcttacaaaaaatgtataccagatctttaaaaaattagagtgtttatggattaaaaagtaacttaccctatcgctgtctccttacccacgtatcgggatatccagaaaaactcgatttacatttaatttacttagcagtttttgtgtttttacttttgacctttaaattgcaaagcaagtatgccaggatttttcaactaacttcatgatgtagatgcttgtttttctattaagaaatgtggagttgtgtgtctaatggatagaattaacagtattttcagtcactgttacctgattctggtttacctgttaatctagcagcgtttcagtttcagtttttcggaggtgaaaaagttaggttaggccatccccgtgtggggtacaccacccttccttaactccttgaatgtacagtgaaaggcaattgcatgaaggaagaggagaggtgccaactgtactcagaggcagaactgagccttctgtttggcacagttaattgtgggaaagtcattcatttttttcggggactcagtggatttagttgactcaaacgtaaattagggatctatctctctgtgattctaacccttctgtgcattaggggatacttagaaaaaaatactggtgctgggacccattcctagattctgattaaaaggtcctgggattaggcccaggaattgattttttccccccagagttctccagatgattctagagttcatgcaaggctgagaagcactacagttcactctctaataattgtatgtcatcaaataatgtgttgagacactttgaaaaagacttcataaaatataaagttacagtttcttttttagttgagccataaacaaaaagcaaataaaaccacagaatttctgggtaattacatttccttcaatatattaaatcattaaatagaaaaagagcagaaagcttcatacatgatcctatgaaatgaaatttgttttcttttccttttcttttttttagacggagtttttgctcttgttgcccaggctggagtgcagtggcatggtctctgttcactgcaatctccgcctcctgggttcaagtgattctcctgcctcagcctcccaagtagctgggattacaggcatgcaccaccacacctgcctaatttttgtattttggatagagacagggtttcaccatgttggccaggccggtctcaaactcctgacctcaggtgatccgcctgccttggcctcccaaacagctgggattataggcgtgagccactgcttccagccaaaattcattttctatgagtaatatacagttttcccttggtatctgtgggaaattggttccaagacccccgctcataccaaaatccattgacgctcaacgctctgatataaaagagcatagtttttgcatgtgacctacatacatcctcccatatactttaaatcatccctagattactaaaatacctaatgcaatgtaaatgctatgtaaacagttgttttactgtattgtttgaggaataatgacaagaaaagaagcctgtacatgtttagcacagatgcaattttttttttttttgagacagtgtctcactccatcacccaggctggtggcagtggcacaatcttgactcactccaacctctgcctcccgcgttcaagcaattctcatgcctcagagtcccaagtaattgggattacaggcgtgtgccaccattcccggctaattttttttttttgtatttttagtagaaatggggtttcaccatgttggccaggctggtcttgaacttctggccttgagtgatccacccctttcggcctcccaaagtgttgggattactggcctgagccaccacgcttggcaaccacaagcaatttttttttctgaataattttgatccactgttggttgaatccacccatgaggaactcatggatacggagggctgacagtttttgaaaccttagatgttttttgaaaaatcagtggaacaactgggaagcattttattaaattaattatacaatgtgaattccaactgatctatgactctttctggctttagccatagtacaactatgaatttatgtgaaattatttgacagattaacacccgtaaacttttcaaaccaacatctgaggtaccttttaaaaatcagactaacgcattcaagcagccatgttttaatacaactatttgggggtagttgactgtttcactatggtactatttccttgaagggtgcttattccatacaacatctgtagggaaaacattgtaagtatgcataccatgttatgtacatggaatttctcctactgtttccttacaggctttactaatgctgtaacttcacattttgtcagatttaactcaaaaattatgatgagtggctttcatatttatttaaactttattatttcattatattaaagatatagataatgaggatgagactctaagtaaaatgtacagtatgaatattctaccttgtatgagtaattcatatagggttggaagacctgaatgtctttctggtaatcttagtactacaatattcttttatacttaagtaattatcatattgagcatctgttttttttattcattgcatgcaaccaatgcatattatgaagggaagaattattattgggtttacacattgatcttttttttttttttgagacggagtcttgctctgtctccaggctggagtgcagtggtgccatctcagctcactgcaacctctgcctcatgggttcaagcgattctcctgcctcagccttccgagtagctgggactacaggtgtgcgccaccacgcccaccaagttttgtatttttagtagagaaggagtttcaccactttggccaggatggtctccatatcctgacctcgtgatccgcccgcccctgtaatcccaaagtgctgggattataggcgtgagccaccgtgcccggccacattaatctttataaatgtgaatttctaaaaaatttaagtgttggcccacttggtttctcaagttgcctgcctgaccctcttcgaagttgtacttttcttcttttctttcctttccgtactattctaaagctttttaataaactttcactcctgatctgaaaaagaaaaaaatttaagtgttttcttccttcattatatcatgatagaattatggtcttaccttggaagaatagtatctcataaaataagtaagaagaatgtggtaaattagtgtcgtatctttttttgattgtagtaatcagtaagtgaacattcttgagcactttctctatcccaggtgctctcctgcttggttagggatgctccagattcctgggccttgcccacacctagtgaaacagaattttgggagctatagccagagaatcagcattttaagcaagcaatgcatttagtatagctacttgggaagagttgactgttttactctacagtatttttatgcatactgatgtctgagaattgctggaataattatttttataaggtatggtagaggagcaaaactattctaggtggtggggcagattgtgtaaagttatatagcttcagaagaatctgatacataggcagggccagtattcttggctgaatagagagggtgtatcagggccactattgggaagtgtgtccagaaacatggtttgtgggccttgtgtggccttctcaaatgttagaatgttatcccattggcagtaaggaactatcagaccattttaaagcagtaaagttatgggttttgtttttttgtattttttatcagaaatttattgacaattttttaaaaatgtagataatttttatagtttcagcaagattgagaattatcttttaatgaaaaaactaattgcagcatcatgtcctgaatgcattactgagaaggcatgcacgtatactcatacgaggttgacagagtaagtcagagaaaccacaacaacaaattaataaactttccagaaccatcatgctgcaaagttatttttctgaacacctgataatttaaccttttaaatcttctttagcttcactgtgatatggggcagacactactagtccctcaatatctgtttccccctttatctttccatgtggccgttttccagttaggtgtgaagattatgatgaagtttctggccaatgggatataagaagaaatgttgtgttgcagattctaggaaatcttttaaaaacacactgctgtgtaccttccttactcctctcccctgcccccacttcccttatcctggaatgtggatatgatgattatgtagaattctagccagcatctaagaccatgagaactagggtacgttgtaaggatagctgaagagtgaagtcaaagagttgtgaagttgccataccagtcctttgaactttcctttgaacttcctttatgtgagacacaaagttctgttctgtttgagcaactattttattatgtgatttgcggatgaaccaagccctaagtaatacaggtactgaactggaaataatagtatttggattctatttaagttctgtcatttacttgctgtgtgattttgagcaggctacttaccatttcagcctcattttccttttgtgtgaaatgttaatgatatcatggtgtcttcattacattgttgcaggagatgaagcaaaaggaaactgtacacagatctgcactgacaaaagggagtacaaagaacttgtaattcttttgctgaccctgggcagttcagtgaaatgcttgggagaatgattctgaggtagcacttagtttagctggagagaatttggggatcactaatgatgtatgttgtaggcaaaggaatggtgtgcaccctgccagggccacatataggccttccctcaactcagactggaaggccgatctatgcttatatgatcagtccaccagaaagtctattcacacccactaaaagctgaagtgtttaaagtgtgcattaactagcagaacattattaaagagaattgctgccaaactctggttgtcagttaaatttgaaaaggattcacttcctacaaccggtatttccatcaaaaatgatatgtacttttatgactatacatacacacacatatttttaatgataagtattaaatacatgatattcaaggtttacactatagtgttactgatttaaaggagtaattgctctgaaaattttaagtattctaagtcaaataactaagctgtaaatttatggaacgacttatttttatttctggcatccatcatttcctgatgcaccagctgaaaatatgcttggcagcaccaaaggaaaactgtaacccctgaaatagcttgttgatggatggcttgaagaagttgataactgagataagcagccattgtccctgttgctgttgctatgttaggggttcttaacccatgttgagtttggagggctgcatgcagtggtctggaaacttctgacactacatgtaaaattttaggtttgtatttttggggggagaacattccctgcattacatcagattctcaaagatctgtaacccccaaaatattaagaattacttttttagatgttgctttggtttactagctccttgggctgtgatttcttaggatatttttatcttaatggtaaaggtgggagagttgttgtcaggtggggcatatctcattgggtacctttactagtttggcgtcagaaagtagaatgtgagaacctttttacttgttatcttaaaaaggaaaacttacttataattagtagtgattatttgctcatggtttgccttttcactgattatccgaatccaaggtgtttttctgctgccttgccctcagccccgtgtttcctcatgcagagtgcccagcttgtttcattttgtctgtgtcgtgttcagtgtcaagatctcagatgaaatctgtctcgaggcttcctcagtttctagatagctctctttttgatctcatgttgtaaatcttctatcatttatttgcttcttaatcacatggtattttgtagcagctcctatattattgttttgtaatgttatttacgcctttatttttgtatgtcttgccaattatgttgtaacctcctaaaggacatctaacccgctgcgtattttataaaattgtaagcacatgactatcaaaaagctgatcctcagtctgtatattgttaatagcttttgtaatgacttgtaaaccatttaatatttggttagaaaacttggtaatatcttctattaaggtattttctccaatgaaaataagtctttgttaacttatctattacttggatttaaattatacttactttatttagttatataaatgcaaattagtaagcattcagactaagcctgccttactctggggaggaggggcttcctttacttccctacctctgcttgaccatgcgttttaggagagccaaccttattcccagccccagaaagtcagtgctcatttgcctaagccagtcacggtagtctaattcaccttgccagtgattggcttaggaatgggcacccatcacatttctgactgcgacatgaaggaagatcaactgagagactcatgggcagatacagacagaagagactgccacctcttctcgtggcagttatttgatctggatgaaatggctgatgatgttttatctatcattgccaactttgcttaggagagctagcttgagacagaggtcacatgtcgaagatggcagagtaaaaggaggaagcaaccatgatgacattgttgaactgacatattcactaatttgggagctgtttacctctggactttttaggtgagataataaattcccgcattaaagtttaagccacttttagctaggtttatgttacttgcagctgaaaatgtctgcaccgatgtttgacagatgtgcttataatgctatctccctggataatcttttcttggtagagcccctgtttttcatgcccagacttcatggaaatgtatttatatgtatatctcagtaaagctcttcagtctgtgtctatatagaagacatttatatttatgtctttctaaactcaaaacaattggaaatagtctggagttcaattttaaatgaaattaatagattgtcagagtcataagtaaacattttgaatggtatactcactgccatcagaaatgttgtgcattttggatattgctggtaccaagggagaccatattactgctacaaagcagctagtgattaacaaccatagtaattggtgatcaggaaacaagttaaacatgctcacataatagtttgctacttatatataggtgtttttactgtgttttagttatgtcttaagaaattggttgagggttttagatgatatattccacattgtaatttttcccatctaaagtgatgggaaataagcttgccattatattttcccacccatttgattttcaggaacgtattactgatattaggcagggattcctttactaatctggaccagctatgttattaagtcagcaattctgctgatgataatgtagtctttaactagcaactcacctgtatccctcacatattttaaatgttacatatttggaaatgtatttccaaaacgctgaaggcaataaatgaaaccataattttttttttaagcatggaagttcaggagaaaaattgaagtgtatatgtttccttttaccatcccaaatttctagttacaaaatcactttataaagtttaaaaccaagtatatattatgtttttactggagttgaacattaatcatgcccagtatgtcagatgtgaaagaagagttttaaaggtaatgaaaaatattgtattaatcttatttttaaatgtttacttttttattataaattgagctgcagttttttaatattttgcaattataaggtgggggtgatgccgcacctaagttttagagctaaaaggacatcttagggataattctaaacagccacatatgtaaatatttctgtttgatagttatatattgagaatactttaatatatctaaattcttttgtttttgctaaggagagaaaggaaggtaaatatagtattgagctaccttatatgagttgccaaattatggtatgaaccaattatagtgaaagcattcccttcacatataaatgcttttctagcctgtaggcatcttttcattgctaaagttgggttaaattttcaccacagaaattcaattatgacttatacctgttatgaaaatatgtaaatacatcaaatatattttaatgttttaggtccagatatatttaaatgttttttatcccctaaaggagtgcagtttctttctgctccttctaggtctccaaagttacaggaccttgaagcatgtagagctcagcatggtacaaacctgtatttttcaatttgtgctccatgtgacccttcctggaactgagcagaagtgttatgctgccaacattgaataatggtggtcttttcacagtttgtaggggaaaaaagctgatggaattttaggtttttcattccaaaattttccttaaattctagaaagagccaccattaattttcaagcaagtattaggcaggtaaaatgtatgtatgaggaaaaaatggttattcaaggaaaaaaacttgtaaacaactgataatatctacttttataactgttctttagatatttgtagtcgtcatcattattttatattcaattaaaataaaccaaacattaatagcaatttaaacttagaattactaaatacataatttcatctaaaatgatagtttgtatgatagaatttaaaatatcagtatttactactgtcctgcaaagagcattttgacttcaagccttgcatgacattcactatatgaagagattacatttcgaaggagaagatgggaactctgctgcttattttctttctcatcttacgcatttcagatcattttgctggggcatagattctctatccagtgactgaggaagtaaattggatttttatctctaaagttttcttagaaagagctttacattttagtgacccttttttgttctatgtatttaaagagactgacaaatccctaatttattctaatctttatcgaattaaaatttgatggtattgaagtgttttctgatacatggagttctttctcaggagggaaaaaggtggttcaccagctgccaaacaaaagtcatgaagattttttagttaaaattttatctggctagtagctcagtttagccttgactaatcttgtattaaaatactcatgcaaatgtggaaggaaaaattttataactgttccaaaacttaggaatgacagtttaatgctagaaactgaggtgaagttagattgagaaaaaactaagcttctacacatagtacagtatgttgataactgcagttattaacagctattcctctttacccctggggttccattctgtaaatgaaacagagtacttcgccccctttttctgcactctcgcacacatatcaccatcttcccttactctggaaagcagctagtcagcaggtagagaagggactggtggtggtggtggtggagggtgatggggaggtatagtctagtcctcaccaggaaaataatgtgggcaggaatagagacaaaaattggtgctgctagtagtcatgaggagaattataacttttttcttgtactcctgcagaccacgtggtagaaataggaggagaaagacattccaagagagaagaatgacactgaatgaaagcccagagaaaataggcaaatggattgaatgctatgggcacccacctgcctctaagctggtggaaatttatattcatacagtctttgtggaagacaaattgtcaatatgtatcagaagctttaacaaggtagatcgattccctttgccttagaaattccacttttagtaatttatcatcaaaacacaagcaaatgcattttttgtttgtttgtttgtttgagatggagtcttgctgtgttgccaggctggagtgcagtagcgtgatctcagctcactgcaacctccacctcctgggttcaagtgattctcctgcctcagcctcccgagtagttgggactacaggcctgcgccaccatgcccagctaattttcgtatttttagtagagacggggttcaccatgttggtcaggatggtcttgatctcttgacctcgtgatctgcctgcctcggcttcccacagggctgggattacaggcatgagccaccgtgcctggccaaaatgtggcttttaaaatggtatatttcatgtgaacctttttgttatgtatattttatgtgtctaaaatagctgtaggaggaaaaacatttacctaaggaccatatgattacaggtaatttaatcttttttcttcctgttgattacttatatctacttcattattctgtaatgaacaagtattacttgtataactccaaagtcaaaaggaaccccaaaggtatatatatgtccctgaattcttgaatctctcagggagctgtagttcttctaaaagcagaagtacattttactattactactgaaattgtactgtgcttcttgtttccagtatacaattcaccaaacatttactaagtaaatatgaatagttactcttaaaatatctttatctatctatctatctatctatctatctatctatctatctacattatttcggtagacttaaggccaatgtataatataggaaaatctcatctgaaactttcccttcattctgcaatagcttagtaatgtatagactttccaaggggaaaagatgttttgggggaagaagttaaccaaatttttatttgggtttctctctcatgttttcctggatgtcgatagttcttttattctcaaaagagcttcatgaaactagaacttccagtgtatcaggaggcatcctttaaacattaaggtctattttaaggtgaaattctactatattttaaaaattgtttatttaaattctataacttttagtggattgcacaaatttatgccttgtttattttataatgactttattacaattttaataatttagcaatattatatgaacgtgaagttttatatccttctttaaatattttgtaagatgtttatgtgatattttaagtttaaacttataaactctaatcatattaacactacttaccatgagtgtatgtaataatttttcctctgtggtgggtttttatattgttaataaagttatatttcatattatcttaaaatggcaattattaaaaagaagagctttccctctgaggactgagatctctctttttgttgccattattgtcagttgttctggaatactaatgctttgttgatataaggcaactgagtttttttcaactgagtcattagacacttgaacaagagcaaagctttagatttttctccatacctatagaggggcactatgaagtagttggaaatttgtctgtgtgagtcatatttgagcattccaaagaaggaatgaagcatgttttctttttctcctcatgactagtgataattgagtatcttttcttgtacttattggtaactttttatttttaatttttatgagtatatagtaggtatatatatttatgggttatatgagattttgatacaggcatacacatataataatcacatcagggtaaatgggatatccatcacgtcaagcatttatcatttttttgtgatacaggcactccaattgtaccccctcagttattctaaaatgtataacaaattattgcagactgtagtcaccctgttgtgctatcaaatgccagatcttacttattgtatcaaactatgtatttttgtacccattaaccatctccattccccaccccacccccaccactgtccttcccagactctggtaaccatcattctactctctatctctctgagttcaattattttaatttttagttcccacaaatgagtgagaatatgtgaagtttatctctctctgcctgacttatttcacttaacataatatcttttttccatctatgttgttgtaaatgacaggatctcattcttctttatggctgaatagtactccattgtgcatacgtaccacgttttcttcatccattcatcttttgatagatacttaggttgattccaaatcttagctattgtgaatagtgctgcaataaacatgtgagtacagctatatctttgttatcctgatttccttccttttggggatacacctagcagtgggattgttggatcatacggtagttctatttttagttttttgaggaacctccctactgttctccatagtggttgtactaatttacattcccaccaacagtgtttgagagttccccttttgccatatccttgccagtgtttgtcattacctttcttttggataaaagccattttaactggggtgagatgatatcttgttgtaattatgatttgctttctctgatgatcagtaatgttgagcaccttttcatatacctgtttgccatttgtacgtcttcttttgagaagctcgctgtttccaagtagagaaaatcactgttgctgccaaccaagtagccgtgcaataatttgtttacttgctgtcaacattttccccaccacagtttatctcatagagaattctcaagcccagccaactttaagatttcatttgtaacacagaatgattatgttatattagataagaaaggctgtagagagagaaaaatctcctaaccttgtctttctgtcttttctagacataatacgttgattttttttactctgattctgtccatttaatttttattacatgtttctcaaccatggtctttccttgttactttcaggcatagaacttcctaaatgtttagtctcagagcaagaacactcaagcttttcatgttctttggcactagcagccgtaacacattgaatttctggcagtggaatttctactcacaggatctgacccctcacaccatggccctgaattaaaaaagacattgcttctgagcatatgcaactcagcaaggatcctcaacaacttgtgtcctatgtagacctagcatctttaatatctatgtatgttgggaattatctgtcaatgtgtcacctttaggttctttatttttctacatctgtcttctgtggtcataaatgctgattataagttaagcagcagtgtgcacactacatcttatgcactaatggttggatttagtatccaaccatggcaggagtgtgaaacagtgagatggatcattgacctttgtctataggaggctcttttaaaccctactgtgtatatctccgttttttttttttttttctgataaacttaccagtgtaatttttttttgagatggagtctctgttgcccaggctggattacagtggtgtgatcacagctcactgcagcctctacctcctgggttcaagcgatcctcccattgcagcctcctgagtagctgggactacaggcatgcaccaccatgcccagctaatttttttattttttgtagagatgggggttttgccatgttgcccaggctaccagtgtaatttgttttctccttgaactcatacaagactcactcttttagccaaagttggtaagaattattaggtagattaaaaaaaaaaacaccccaaaacaaatgtggtctgatggtgaagtatcacgataaagacaatttgtaaaaactgtgaaatcatattagatcttagtataaaattctaattttctataaaaaaatacttcttagaagtcctgagcttagccactggaactggccacaagacctgatttgggaagaggtaacctgttatatgaatttagttagtaaaattgtagaaattcagatgtcatttgatcccagggaagtgtatttctccccagctattaaccagtgtcaactgtctgaaatttattgatccgaaggctcttcctcatttgttgccagtagctctccctcatacagaacaaatgactcacatgctcaagctaaataaagcactccgtaaagatttttctgcctctagaactgctcaaagtcagctctcaatagtgggcactgattcttgccaactggtttacccttattaactctataggtagggccctgtgaaaccacactaacatgtagatgttctctctttttctttcttcttctttttttttttaaaggctgcccttttcagacattccttctgaaatctgttaagaataacataagactagtcacagatttattgatttttcctgggcatttgactatgtgaagtggaaccagctatgacctaagcttagcaagctcagtaaacaccctctctttgctccaaggtctgtataacttctgtcttagtacacatgccaagcagtcagcaggaacggtcttgtggtagatgagatgattttcagtcaggataagtcagattgttttgcttttctttttatttaaaaaattattttttcaccctttaaagtcttgatgatcataatccacttcttgatggaatgtgtacctgacactttgatacactttgcaacagtcctgattggctttctgaacagattccttattatctaggaatgatatcttctatctaattattttcccaaataactgcttagtgtttattgctttaatatcagaatcctctattctgccagacaagttgcagcatttaatttgttttcttctaaaacacctatgaaacagataaattatccattttatttcatttcctgtaagttattttcttaaaacaggtatcttatgggtacatactggaaactttaaaaaatggctaatgtaaaattcattttgaaatatgattgtggcttccttttgtggcagtcctgctcaaaattttccaagtatctcaggaaggaagaagcacgaatatgtacctgctaaagcccttggggtgggcacctaactttaaagatatttttatttttttaagctgatattatcacattcatgtgacattggcacccagtgtgtaatagagctgtggttattttaacataaaatgctttaaattatggatcatcaggtagtaaactggaggatatgagatttactgtattttttccttgtcattatgcctcttttcacatggtgcatgtactcttgggtatccatcttccaatttgagacgtataaatcagagtttttcagttgcttaaatgactctctgtttgagaccagaagtgttttcagaggaaaattttgatattccctcagctcaccttcatgagggctgtgaaataaaaactttggggagttgcctggattggattccttagcaagctgaccccactactcatttgattgttagaatgtgcatttcttttaattagaaatagagaatttctgcacttcacgttctggctagacaatatgttatctgaatcaaatacttactaaatgcccatgagttagacactgtgctgacaggcactaagaataaacaggtagttctatatctgatgtgatattatttattttgaattgctatatgcttcattagtgtttttggatgaaatttagtaagatatagacagggcagatttatttctgtgagaagattgcaaaatataacagttcccattcttgaagtaactagagaaaatttttttagtgctttttaaaataaggtttatataatggtgcgtttcctgctgcatctctgccatcaatttcaaccaaactggtagaagttttgattgagaagtagctgtaagttgactttcagtgtttttacagcttagccttttccttagaagtcacttctagaaccagatccacctgatttaacaaaatgtgtttgaggttgaatcattgcaggctttattctgtctaaatgtttttttcttttctttttttttgtagtatttcgtagaactggagatcctgtttaggcagttgattccacagttttgactatcaagtaacccagttgtaatgtgggtgctacagcctcagcttcttaaatttggtttggagcatcctttcaaccttctttctccagctcttaataattacctgctccacttctttaatgactatttagtggtaaggtaaataggaatcttgtcttaagatgaattcatctcaaagtgatttggagccaaaaaccagaccatgacatttctggctgtggatttcgtttccaccaactcaccctcttgtcttttttttttttttttttgagacagtctcaccctgttgcccaggtctgataacagctcactgaagtctcgacttccctgggctcagtgattctcccacttcagccccccaagtatctgggactacaggagtgcaccatcatgcccagttaatttttatatagtttgtgtgtgtgtgtgtggggggggggtagataccaggtttgctatgttgcccaggctgatctttgcctgccttggcttccaaagtgctagcattataggtgtgagccaccgtgcctggctgggttcccccaactctcaaggggtgctgagttgactgattatgggaatgccagaacagaattctgagaatgcatttgtgtttttccttcttatcagactcattttaataatataacagatttaatttttagttttcattgactctttatccaactgatttaaaatttaaatatatttatgctttaatcactcataaacttggacctcaagttaaaaatttaatatccttagttccttagaattttgtaagaatttttgaattagaagtacaattttgtttagtttttacttacactaaaataggaaaatcattaagctgtttaaaaatagtggcaccagactgaactaaacaggagcagtggaaagtttcactttagaaactgctagagaactgaatccctagggtggtccctggatgtgatggtccaatctgtaaggtcatcttggaaatagatttagttctaagtttaggaccagaaaagactacttccttcctccaggcttttcacatttatccctaaagctatattgagtgagggcagatatatttttcaattccacaactgctggtgcaccacaacttgtaaggttctgtaatcttagtgctcatataatgccttacacatattaagtttttagtaaatatttgttgggggagaatgagtagatgaattggcatggtaagaactctaaactgagctctgggttataagtaatactgtttatataagtggaaatacgtgttttgtttattcatagattatagccagaaaactacacttaaaaataaattcctgaagtgaaagtaaaaattaatgttttcttctcatgaagtaagtgtggtgatacttacaagttattcaaatatttagagatgctcagtaaataactacttctgtggagggtgtcttagtcagtctgggctcctttaacaaagtgtcatagattggtggcttgtaaacaatagaaatgtatttctcagagttctggagactgggaagtccaagatcaaggcattggcaaataggcagtctggtgagggccttctttctgttcatagatggcactttctccctgctccccacatgttggaagggtcagggtggctttctgaggattattttattccattcatgtgtacttcaccctcaataccaaagtacctcccaaaggtctcctaataccatcactatgaggggtaggatttcatttcatgaattttgagggaacacaaatattcagtgtagagaaaacacctgaagtccaaaaatttatattaagaaaaagtcaggctgggtgcagtggctcatgcctgtaatcccagtttgtgggaggccaatgtgggaagatcgcttgaggccataagttctagaccatactgggtaacatagtgagacccccatctctacaaaataaaaacaacaaacaaacaaacaaacaaaaacaccaaagggccgggcgcggtggctcacgcctgtaatcctagtactttgggaggcctaggtgagcagatcacccaaggtcaggagttcaagaccagcctggccaacatggcaaaaccctgtctctactaaaaatataaaaattagccaggcatggtggtgggtgcctgtaatcaaagctactcgggaggctgaggcagtagaatcacttgagcccaggaagtggaggttgcagtgagctgagaatgtgccactgaactctggcctgggtaacaagagcgagactccatcttaaaaaaaaacaaaatgccaggcatggtggtgcatacctgtagtcccacctacatggaagactgaggcaagagaattgcttgagcccaggagtttgaggctacagtgagctatgatcacggtactacactccagcatgggcaacagagggagaccttgtctcttaagaaaaagaaaaagtcatacaagtataattcacacttggatctctatcgccatttggttaatattccagttgtgtattagacatttaataaacatgttctgtattcttgtagaggaagatgtgtgaggaggaatggaatctatcatacctatttaaggaatgaactgtatcatttcctctctaactgtggggcttagagccctaaaacctcatgtaaagataaatttgtggctgagaaagttaaaattttaaggggaaactaggttaggggaccttaaattgaaggtatgtgacagtttttgcatttgctagaagaaaacaaagcacactacagacaatctatgtgacattttatatatcttaaattagtaatactggaactgtcctgctcaacttcatttgccatccgttgtttgctagagactttctcagtgctcactcttacatgcttgtaaatctgtgctgctttgtgaagatgagagatgtatgaagtagtatttttctgaaccttcccctctatttaaatgctctgtgtctgtgcttttctgattcagagttgaccttatgggtcttgcttataaggtcctatatttcatagtgaaatatgattaggaggctgattaggatgattaagagaatgacagggtatttacttatgtttgcctcctatctgtttatcagttccccttcattctattcaggtttctgcagctgtgggtcctcccatggttatttcatgacaagccatttacccatgtctcggatgactgtctgccctctgaggatgcctgggtgtatttgctttcttcagtctccatttatctttcctaataattcactgcaaccatttctgccatctctctgccatcagctatacctcccttttctgtttctgacctcttttctcttcttaacgaattttccaaataagagtggctcatgatttgtaaaaagtagaactgaaattcatattgaaattcagatagagaaggtatacagaaatatattcacatatagttgaatttaatgtaagggatgtcaaggtagggaagtgattactatgtagatgttttctattgtgtttgtgattgcaaggaggattttatatgatagtcatagcttgtctttaaaagtttggtatgtgataatatcagaacagtaaaaggctatttcacattttaaaactaaatctttattaaataattatttcacaagttagtaattattgatattcttcttcagggactagagttcctatgcttcctaaactgacttttaaggaaagatgagactatattcagtgcagttttaatatgacatattttattatctcttattttttaaattgatattttatgaaggagtctatggactataatacgaaaattctggttggggaggcaggaaacctggctttcaagtacactccaatagcttttatataaaattcaggtgttctttttctctaatacttgaaatagctattttcattttcatgtcattttctgtacttttcctgatacttttaaacattgttttattttcaaatgaacagccctcaaagatgaaaataaaaagcaaaagtttcttaatgtcttaaatgcttttgtgtatattaagtgactttctttaaattgaatcttacttttccactgacatctatgatgatttctgaaatgtgctccggtgagtaaaatttgacaagccactccatctgccagtggcctgggtttttgttgttgttgttgttgttgtttttggtttgccttttgtaaaaaatgcttagagacaagtcaaccagtttgtttgctgatgaacagttattgcttcacccacctgtacaacttcattgtcctagctacaggggaaaatcatttatttttcacttgcgtcattctccagtcctgttgtcgtgtaaacttatcatgtgctccttgaagccatgcgagcaggcagagcagaatttcaggagaatgccttcagctagtcttctagttagtactacactgagtttactgcctgctttttagaacttccttgccaaaccttcactgaatgactcttcatataattgaatacagctgtagtttattttatttgccgaaaataattactggtgcccactaaaatggtgattaaaatccacttgatgtttgtactcttttttgctgagattttaaaaatgtgcttacagtgaggcttctataataaaaataatgtagtttcctgaattatggaattcgtgtgttctcatttaaggttgcagtttaaattgatcttttatcaaaatttagactgaagaagagattttccatctaatttatttacctatagaatttttaactttttagtatgaagtaccattttgtgagtgctctaatttcttatttattaaataaaaagaaaactaaattttattcattgtgtggatatagcacatacacataattttataaacatctttttgtaacctatattgaatcccagaggtcctgactcaggtttcagacaagctcaaaatacaggcacttacaacacaggtgctaacaacaatttgtcctaatcagttcagggccaaagttcagttccttcttctctggccaataggatgttttaattatgaaacgcagacatctcagcactttgggaagccgagactggcagatcgcttgagcccaggagtttgagatcagcctgggcaacgtggcgaaaccccgtttctacaaataatgcaaaattagccaggtaatgtggtggcgtgcccctgtagtcccagctatttgggaggctgaggtaggaggattgcttgagcctgggaggttgaggttgcagtgagccatgactgtgtcactgcagtgaagcctgggcgacagataacctgtctcttaacaaaggaaagaaagaaggaaggaagggaaggagggaagggaaggaaggaaagaaaagaaaagaaacatagacataccttagagcaacagttctcaaggagatactttgatggaatcccagacatcttccttttccaactaagtatctgtgtgtgaggctgtgttttctttattgtatttcaactaaacaacacatcatgatagtctgaatgcagaagagaaaggccaactgttttctgttgagctagaaattaaggatatttgtaaaattataaggctactctttttactacctttctttttgttttggaaaatatagtcatttttcatagaaacattcatgtaaatatgtaaaacagttaacttaataaatatatttaaaatttgttttgaagttttgatttctaatatgaaaaatattaacagatataactgacgtaagagtcctttgggtcctcagtaatttttgagagcataaagaggtcttggagatcacagagtttaacaactgctgccataaagaattgcttctgggccgggcgcggtggctcatgcctgtaatcccagcactttgggaagccgaggtgggcggatcacaaagtcaggagttcaagactagcctggccaatatggtgaaaccctgtctctactaaaatagaaaaaaaaaaaaaaaaaaaattagctgggcatggtcatgcacgtctgtagtcccagccattcagaaagctgagggtgagaatcacttgaacccagggggtggaggttgcagtgagctgagatcgcaccactgtactccagcctgggtgacagagcgagactccatctcaaaaaaaaaaaaaaaaaaaaaaaaaaagacttgcttctgtacttaaatgccagtttaacttatagattgtctttaatcacaaaagggtcatcaattgaaaaaaaacgatgtgttttatttgggtaaagtaaaataggcctagaagatgggcagattctaaacagtattcatcatctgaatgaaaagaagattctggataaactcagcatgcctttacagatacagaagaggaagggcgctgattgtgaaccatggtgcttcttggcatctgtaacacaggactactgacattctttctggcattgttattattctgaattgaagggagctcctgttctgacatgttgtaaaccagtctttgtttttgaactttttatgcaatgatgagaagagatctcaacttaggaatcttgttgacatgcatggaataggaagtggcatataaacttccaagatgattgtaacgaagttcgtatagttgatgcactgtgatttagttttgtcattaagattctgttttggaaaaatatctgacttataaaaaaatagaatcttaaaaatgtttaatcataataaccacctacattattagagtgctttggagtttaaaaagtaattttacatgttctaaaaatgtaagcacgataaaataactatgtaggtttaagttaatgtaattggtttgggtcactgctctgtacagcctgcacccagtgtttatattcagtgtgttattacaaaatgcttaatacatattgtatgtaatcatctggctctaagtactatgcttgtgtaatccattgttttcataatcatattagtatttctattatagggataatgaattagagttcaagatgaaacagtcgaacttatttataaacagagaactgaatgtttttaggatttttagggtagtgaaactactcttatgttaatatattggtgggtacatgtcattataaatttgtccaaactcatagaatataaaataaaaagactgaaccctaatgtaaaatatggactttggtgatagcgatgtgtcagtgtatgttcatcaattgtaataaacattcctttctggtggggaggttgtaaatgggggagggtgtgcatgtgtaggggcaggagttatatgggaattctctgtaccttctgttcaattttgctatgaacctaaaactgctctaaaaaataacctctgctttaaaaaggtatgtgtactctataatcttttattagaaatctttgttgctatttttacatggaaaaatacaggatgaagtcattattccctagaataaattatggaagtcaccattcaaagttatgatggagtcaggatgctacaaagaaagtagattatctcaatagtgttgtgtatgttgactgatttggggaagagagagtaattagtgaaaatatgtgaagtccatgttgagtcagaacaaaacggataatcaccttctgagatgaaaaaaatcatcaaaaagagtctaaaaattatctgttggtacagattttgggaaaatctagaagaggtggaagtagtgaggctgctcatgttatcaccctagtctgggtttgctggttagagcatgtatgattggaagagagagagagaagttcaggaaataccaacagagcatgggaactgtactaggttcagtgattccaaaaccaaaaatgaaacctatataacaatgctaacaatatatgtaatatttccagagtttccaaagcctcatttaaattgtgcctgaaaatgttagatatcattttttaaaattggaaaaaatgaggaatacaaaacttaagtaacccatccaaaggcacatactagtaggtaataatgaagataactaataataactcatttacataagaactctaagaacttagtactattatttctaactcacagatgggaaaacaaagtgtcgatgaggttgactaacttgcgtaagagtgcgtggttagtaagtgacagctgggattttaaactagattgtctgagtctgtgctcttaatccgtatgttctacatcctatctgttggttttgttattttttggatagagcatcttgacttacttagatttaaaataaaatccattgcagcacaaacatttgcaggggtggctaagatcctaacagaggcccagggagatgacagcaaatctttcctaatgccaggcttatattcttgtctcattcttgtctttgaagtcaaaacatttttagtcagtctctagaaacagaaacatgactgtgtcaggacactaattaattagcattgaggagttgttttctgattataaatatataactattgtactaccattccctggttggtaggattgctgtttgtgcacattatttgaggagatggaataaacaggcaaaatcagtttttacaaccctgtgtgaatactggtctgtacagcaaagattatattcattatggttataaactccttgtctgcctacaatattaatatggaatgaatgttatcaccaagttactgtaactcagaagacttcagaaaatatcctctaggtatcaaattaaatttgtaactacggtactttttgcttgccttgaatgactttccctggaagccagaagccttgtgttcagtttctagcaccatcagcaatgttaccttgggtaaatcatttaaacatgttgaacgtatgttccatttggcagtgggaatgccatatgctctcaaattgcttcagtgtgattttgtaaaagtgaaattgattttaaaatatgaatatataaagtgatttcactacttattaagtagaatgcattgtatacttcataaagctaacaaataataaaagactaaatgatattttggaatttaaaaaagacctctttagttttctgtgatccaaaatctggcttaattttgccttaaagctattcttagtgttaatatataatgctttttaaaaatcggccaaggtatctttgggcatttgtagtccttttctgttcagaaatgtcattaacttgaaatataaagatgctttctaaggaaactggtttgcctagccagatcttttaatgtagttattttgctatgtgagctgtaaaacccaaacattgaggctgctttccacaatgccttgttgcccagacagtgatgtcatgttttaagcatgtttagtttgcaaaggtcctgcttttgatcctttagttgtcacttttttaatgcggctcctcctgaatcacaaaggtactgaaagtaatttgcttcattaaggtctgttgctgacactgttgtatttcagtcgtcattcttctcttagcctccttcattaagaccttattcaaatttggatcatggttctgctgcgacatccacgccattatcatctaaatagcaattacatattcaaacacaacagcttctccttaactgtctgtaacttaacattttacatagattcaagtgggaattaagaataaaatgaatcttttcttcgtgatttacaaccctccctttcacccttggtttactagttaatgttgaataagctacttgtagacgaaggaagacaaaattattgattgctcagctttagttttgtagagagatatatattataaattgtttctgtattaaacagttacccaagtgtcagtgacccttattcaatcacccatgtatttattagacagcatttaccattttggatataaggggatcaggtctaacactctgttaagaaattaataggatcttttacaaaagcagcagtgctttataacttgaaacattgaaaggaaacctttaaaaataagtcaacatatttgtccttttgggacagacctcaaaaatagaagcaaattccattaaagtagtaatatacttttcctactacttcgttttggccatcttaaaattatattttataattagtaaataagctgatttgactgaaacgagcaactatgtttattggagacagacccagcttttcaacagatagaatgttaggactttttttgcccattaatatgtggtttaaagggaagttataacaagacaccaaatgcatatgtatatatacaaatacaggcagttgtatgtttttaagaagtttttaaccagcaaggggtgtgtgtttgtgtttgtgtgtctgtgtgtgtgtgagagagagagagggagagagagagaaagggagaggaagggagaaagtgtgggaggaaaagaggagaggaggagaagacagaagaggaaaacagtcctaactattaaaaataccaattaactacttaataacacatctttcagtgtcttgcataataatttcttagatattttgcaaaattcggcatggttaagggattttgtaatggttaaataattttattagttgtttgaaattgactgtctttgttttcctatctgtgtgctgagatttatctcaattatatgtgtgaataatgttatgcatggggttacttttaatatggatttaactgagattctagactatattctttgtaaatatgaacattagaaacttgttcaattgtgggtcgtcattaattcaagtcaggaaggctcaccctttgtcctcacaccatctcttaagaagataagtcctgtggataagctggagaggtcagatgttggtgttgacttaaagcattgccacccgaggagggcagaatgctgtaaaacaaagcagaaggaactgtgtggagagaaggtgaatgactgggggacttgaagttgaaagaaaagtcaggcgctgagcctgcaagggcaaaatgaggcttgtgggataagaatggtttgtcagaagtcacctgtttgctcagaagtcatctttccctaacaagggtctgtttggtatgttcctgtattacaatttataataactgtttttttacctgctgagggtaagatctttaaagtgacatcttaccagctattattcttagctcttgcttatgcaaatctcaatttgaaaaataaccttttaaagtttttttttttaaataatgagaacatattcagaatgacaatgtgatgaacacctgtgtacccaccaattggtttaagaaatataatttcttgttaaccttgaagttctctaagtcttctccttactcccacctcagaggtaaattccactctttaaattctgcttttttggggtctctttttaaatagtgttaacatatttttcatatgtgtagttttgtatgttttacaaccatatataaatcgagtcactcacaatgtatgtacaatatgttcttcagcaatttgcctctctcactcagtatcatgtatctggtctcatctatattgctctatgtatctttagttctttcatttttatttgacattccattgatgaatataccacaatttatatatctgttctgatgatgaacatttggggttttgttttgttttcctaaaaacagtgctgttactgaacattagtaggcagaagaaaaaacaaaacaccttgatctgtgtctcacactttatgcaaaaattgcccaaaatgaaaggactagtccctagaataagtacttgcaaaactcagcagtaaaaaacaaaaaacaaaaaaacataaaaccaaattagaaaatgggcaaaagacatgaagagacatttcactgaagaggatatacatatggcaaataagcacatgaataagtgtcattagccataatgcaaattaaaaccataatgataggtctctacaaacctgtatcagaatagctaaaataaatagtaataacaccaaatgctggtaaggatgaagagaatctggatcacttattgatgataggaatgtaaaatggtacaattactctggaaaatagacagtttctgaaaagctgaatatgcagttactatacgactcagcaattacactttgggcatttatcccagagaaattgaagacgtatatgtgcataaaactgagtatttatagcaattttattcataatagacccaaactggatacacaccaaatatccttcaacaggtgaatggttaaatctatggtatatctatatcatggaataatactcagcaagaagaagtaacaaactgttgatatatacaacaacctggatgaatctccagagaattatgctgagtgaaaagagccaatccctaaaggtaacgtactgtatgacttcatttatgtagcattcttgaaatgaccaaactgtacacaaaaaatagagaaatcattggtcgccggtgggtaaggatggggtgaaagttagaggcaagtgtgtgtggctatagaaggataacactggggattctggtggttatggagatgttctgtatctggtctgtgtgaatgaaatatcctggttgtggtattgaactatagttttgcaagatgttgccattgtggtaaaccaggtagaagctacatgggatatttccatataatttctccaatctgcctgtgaatctagaattatctgaaaaagttcaattaaaagacaacatgatgctgttacaaacatccttgtacatgtctcctggtgcacatatgtgagctttcctctagattttatttccgggaggaattacaggctatgcacatgttaactttagtaaatcatggcaaatttttttcccaagtggtatatgaaaattctatccttttcatattatactctatcctttttaaggatattgtacttcaaggatattatactctatcctttttaacatgtaatactgtgagacttaaatttttatcagtctgttggttagaaaatggtatcttgtgtttttaatttacattttcttgtttataatggaattggacatttttatttatgtttaatagtcatatgtggtttttttgctcagtaaaatcactattgatctcttttccctgctgtattgtctgtcatttaaaaagttgattctaaggggatctagttacaaattttgttgcattttaatgacttatgtttttctttttatctgttaatgaagagacattttgatgtgacagttttaaaatatataaaacttttccttaactttcatatttcagtctgatttaaaaagtcccttcttggagatcagaaagtcatcttcctatagcatcttcttatagctctatggttaactttggttatagtgtggtatagcgatccgattttaatttttttttgtagggataacctattttcttagtactattttggattaattcatcttcttttcttcacgtatcttccaagcttactcttacatatatagtatctttggttctcctactttatgaggctatttttctctctcttagccaatgtcataaagctcattatattaccatcctttaaaaccatctcaaccttcctttgttctctgcttttctatataatgaagcatcagttgatcttatgccaaataaataaaaaatgaataacagatggataatcactcaaacctacccactctgatgtgatttttgttgaaattttattgaacatatagattaatttaggggagaattgctatatttacaatatttagtcttcttcagaaatatatttctgtccatttgcttaggtttccttaatacatttttgtaaaattgccatgcatttttcataaaaatcacatttctgcttttgtcagatttattcttagagtgcttttttgttttattattatagtaaatatttttaaagttgtattttctgtttgttgccagcatagaaacatgtagctgatacttgtagcaaccatcttgataaaatatttacttcccataattcatctttagattcttttgaattttctaagtacgtaattataacctctgtgaatagtgagttttgtttcattcaaatccttgtggtttcattttatcttttggtcttactgcatggtctaggacctctagtatgttgaagagaagtgtcaaagaaaacatcttttccccacttttgattgtaaaaagaatgcttataatgtttgcaattgtgaactactacatacaatacattttgtttttttgggttgctcctggttggctaaaggcttattgtagaaacataataggcatagagtgttgttagaattggtataagatttgattttaatagaattcacctgtaaaaattatcttggcctcgtgtttctttagtgggtagcttttatgtaccgaatgaatttgttgataattgcagactagcctattgtgtcaatttggtaagatatttttctaggtgattgctcattcaaaaaatattctagggccgcgcgcggtggctcacacctataatcccagcacattgggaggctaaggcaggcagatcacaaggtcaggagattgagaccagcctgaccaacatggtgaaaccctgtttctactaaaaatacaaaaaaaaaaaattagctgggcatggtggcgtgcacctgtagtcccagctactcaggaggctgaggcaggagaatcacttgaacccaggaggcggaggttgtggtgagctgagattgcgccactgcactccagcctgggtgacagagtgagactccatctcaaaacaaaacaaaacaaaaacaaacaaacaaacaaatctaagtttatagacagagttttttttttttttaaatgatatcttcttaccattttttaatctctgggattttcattatgttctgctcctcccccccatggcaatattgtttatttattgctttactatttattttcttagtgttttcaaaagaccagttttaggatgtattgttcctcttttgcattttattttctgtttcatcatttcttgctcttaccttaattatttcctttttcattttctttggagtttattttgttagtttcattttgactttttaagttggttgtttgtccttggatcatcatttttaagcttttaaaaattctaatatgttcattaataatgccctgtatttccctttaaatgctattgagcagcttccaaattttaatttgtattatttccattcgtttgtcattttgcacatttttctcttttcaaaaaattaaaaaaattttttctagaggcagggtctcactctgtcacccaggctggagtgcagtggtgtgaccacagacagctcactgcagcctcgacctcctagtctcaagtgatcttcctgccttggcctcctgagtagctgggactacaggcatgtgccaccacacctgccccacacgtttttcatcgtcaatacttctttgttgagttatttttaaatgttttaagatttccaaaaattgagtttttttgtgtgttatctttttgatgaagatttttaatttaatgtcctgtggtcagagagggtggtacaaatgatagaaattcctgaaatgtgttgagacttgattcatggccttttctcaaagaaaagcatatcagtcttaactgacctccacttatatgactttgcatattgaccagcatttccaacttttctataaatccttggatgttgacagcatctagtttattctctgatgagcagactttctttggctgctccagcagagtgctgctgaagtgtcaagctgtttgctcctaaatgtatgtacttgtttattataattgcatgatttaattaaaatatgaattaagaggttgtacttaaacatgaataaagagggagtacttatagctacgaaactttgttaaatgctttagaaataatctatatagtttaattgctaaaataaaaaaggagctgtcaatttaggtgtgggtgagatgacttaggatctaggaatcagtggtagattgatttgtaaatatctttaaattctcatttgctttaaaacagttggaggttgtgtacaatgtattatatgttggacttacataagaaagacttagaactccatcaggtgtccctaactgcaaataaaggcctcagctgaaaaccttcctgggggaaggttaaagcaagtaacaggttggaagctgggagaaagtcaggatttagggtgttgggcacttgtgtagagtaatttttttatttcctcatgaactggttgttcaaaaatttttctttttttttttttttttttagttgatagtaacacttgcagacctgttgtaccatgtggttgaactaagcagaacaggggcactagaattaaacaacaacaacaacaacaacaaaaaactacagaggaattacagttgccataggcagcaatgaaactagaactaaccaactgcagttttttgttgtaggcaaatccacaaatcttagaacttaaaaaaaatacttttttttagtgttttacgagatgaactctgaattatagaatatctcaccattaatatgcaccttcagcatagaaacagttaaagaaaataaacttacctgaaactattgtattccctgtgcattgtcttcacatcctttttctgagtacctgagacaaagtgaactacaagtaggataagaactgaaaagttttcaccagatttatgaatacagtttcatcaatgatcttggtgaatagtagtagcagaagagttgaccatagaccttatagctagctgttagaatagctaatttaatgaattttttcccaaatctgaaactcaaagctactgataaccaaagctagttccctgataagtaacttagggaagtgcactcttatttcaataattaatgcttccatgaaattatataaacattcatgcattccgacaatatctgaatatttctgtgtgctaggtgctgtgctgggtgttgggtatgccattatgaacaatacaaagaagagctctgttttcattcaaatgaggataaagtttttcaatagcaattatttttaaaaatgaaaataaagatccacaaatttccagaaaaaaatgacctaaaagtcatagttttaccattgaatgtaatatccttcctgtaatccatgaatcagagtatgtaaagagatgtaaaagatgtaagaaagagttttgagttttaatttgggaaaagaagtataagacagtagtagcagtcatataaaatagaatagcatcaaacatttaaaaaatagtatcgtgatagcatagagcaaaatttacattttaaccatttactaaactttggtgaaaactatcacttaaaaaatccttaattacaaggagatagtataaaacatagtttgttgctgttgtatatttgtttttaagtatctcagacaaatcgaataattttttaaattagaaactaatatatgtcaggcatatggctacagttaaaattttttttgaaaatgaaattatggatgcagaaagcaaacaagctgtggcagaaaaggatggatctaaatatgaagaggaggaggagataagagcaatccagctgcaaaaattactcatgccataggtagttttagatgccctagaaatagttctatgttgtattgaataacagcttgaatcaggattcgatattattacaacatgggaaggaacaatgccaagaaaaattgtatttattcttataacttcaaagtgatacaggagctcgaaagaaatttaggcagttagtgaggctaagagagtccttggcaaggtttccttttaaataaaaagcagcccccaaatcatttcttttctaacaaaagagcagcctgaaagatcgagctgcagacatagataagcaagctggaagcttgcacaggtgaatgctggtagctgtgccaatagtaaagggccacttggaagccaggtatgttcaacatggaggctccaccttcccttttctttgtcaccacgtgcacagtaaagaggcaggcaacatggtgctggccaggtagcaaacccatctgcctagtaaaagattagggtggaggccggcgcggccggcgcggtggctcacgcctgtcatcccagcactttgggaggccgaggcaggcggatcacgaggtcaggagatcgagaccatcctggctaacacggtgaaaccccgtctctactaaaagcacaaaaaaattaggcgggcatggtggcgggcgcccataatcccagctactcgggagcctgaggcaggagaatggcgtgaacctgggaggcggagcatgctatgtaaatggcacacctggtctgatcaatctctcgtgccctatgtaaatcagacaccgcctcctataaaaccaacctcttcttgccctgaacccggaaacccgttcgggaccccttcctctgcacgagggagctttcctctttctttttcctttttctttctttctttttttcttttttttttttttgagacggagtcttggtctgttgcccaggctggagtgcaatggcatgatcttggctcactgcaacctccgtctcccgggttcaagcgattctctcacctctgcctcccgcgtagctgggactaccggtatgcgccaccacgcccagctaattttcgtatttttggtagagactgggtttcaccacgttggcctggctggtctcgaactcctgaccccaagtgatccgcctgcctcagcatcccaaagtgctggaattacaggcataagccacctcgcccagcctcctgtttctttcatctattaaaactccactcttaaactcactccttgtgtgtcctcgtccttcagtttctttggcgtgagacgataacctcaggtatttacctcagacaactctgctacttcagaagtatttactttattaaatgaatatgatttattgttttgaagtaaaatgtttaaggtatgcatgtattttttatgatttcccactttaactgatttttttattaaatgaagaaatggtctcaatcacattggctaacatggcctctatttatttaattcatctgtttttcccactttggggcatcaacagcatggagtatttggaaaactacttgtatttgtaaagagtaaaatgcagtttaacaaagaagttagtttgtcattgtatagttcaggaactctggcctggatgagagcatgagtttgaaattttgtcctcaagattttgtttttatcttaccatcaccttttatgcttaagtttatgattggccataattatcaaattgacacattatgtcatgtgaaaatctgtttaccaaacttttctattaataaacttgatgtttaattgtaatattaagagtcacagagtgctgtagattctgtttgtcatagttgtgtagcttttagagtttagggaaatctagtttttagaattgacacaatgatttttaattttagcagtgtgttgaataacctgtgatataccattcacttattaacttcacattgttgtataataagttataaattttagatcagataagaaagtaaaactggtattaatttgggaagaagaaattgcagaacttgagtgatttttccaaataatgtgtcagctgtaacttgaatgtgttatttttatccccaagggtattttgaaatatacttatgtgaatttcttatagtttattttaaccataaaactattttgatatttttataatgccatcgatgatactgtatgcatagtgagggcatgggttgtctgttcttaccaccatattcccagcactagcatggaacaaatgaataagaacggagtaaaaatgcataatctaaacttgactatgtgtgtcttcaaaataatacctttaagttattttgaaggaaaaaactatgtatccaacaaattcaaacagatacttacaaaattaagacgattgtaaatgtgtgttgtcctccttctcattgtttttcacatccaaaaatgtcctcttggagcctcttatctgagtagcttctgtggatctgatgatgctaggattttattttttcttttattttaaagttcttctgattacatcatctctttgtatagacatcattcttgacagatggcatttattaaatatggacagtagcaggcagttaaaaagacctgcatgagataggcaggaacctttcttttttctttctgactctcagaagcaataccagcattagctttatttaacttctagattaatttaaaaagaaacctctttaaattatgactcaacaggtacagggtgaagtgggggaaatgtatgtgtgttttaaagcttcccaagtgattttgaccatcagttaagtttagaaaccactgattacaattaatttccttagaatttgctcatatatttaattccaaagaggaagaaaattgaaattttaaaaaacatatgagtatttttggagatgacataactttccttttattgtgttaaaaaaagctttaagaactgtttttttctgcatttttattaattatcaagatttagtgatggtttagagagctaaaaacacctttagggtgaattcagaagatctagcagatacaatgatgaaatatgatcagcaagctttaggagaggataacaaatgtgtgattttgaaatctcttctatttgaaaccaatccagagtcttgaatttgatccagtatatagtatgctacaaatggaaagattaaactggagcaatataattagggtaagccattgcatctgcacttgtatcgcagcaactgaatttgaaaccagctgcaaaatggtgactaatctctctggcaagcccacatgagagtgtagtacaataagccagcttcagcctcatgagcacatgtttcttcaacttgcctctgagcaggtgatggtgatgatgcaatctgattatacttttgaatgtattctaaccacagtcaacagtagagtctcacaagggatttcacaaaagacttcaaaccgactgtatatttttcagagagttgagctatagacagccatggaaagtagtagttttttttttcacgttagtgactactgtactttgcagtactttataatcttaagtttaggaggctttagttttcatatgtgaactgaagatgagaagaataatgtggaaagaaagtacttgtacttggagcttttattctgaattgttcacaacaacttacactgatcaattaaaataattaaattgtctagactatttaattctgtacaaacaagagatggtaaatcagtgtactgtgtttaagtggtacactaacctttccatattcagagaagtacctccctgggtcttgaacattaaaggtgtttaataagtactcagtttgacttggacttgagcctttatttttgaagggaataaagtttcttcttccagtgtacctcagagggacttggtaagcatgaataaagccatctgtttgaaaatgtatgtcatttttggaaaagtgctacagaacctaaaatacagtcacaagtattatttcaaatgtatagttcagaagtagaatacttagaaattgcttgttaatcttaattgtaaatagctaaaaaaaatatagcttgcaataaaggacacaagagcattaaaatataaaagtcacaaactatacatctctgagaataaagggggaaatgggatgtaaaaaccctaggctggtggcactcacagttggtatacagcagaatgactttggctgcttgtcagaagcgaataaccctgggcctcttccccatcacttctgattttataggtttggagtgtgtcccaggcatctgtgtttttaatcatttccccccctaacttactctccccatctaaacttgagaaacacccagactactgtagtattatggtactatagactactgagtattagtacagtactatagtgctgactagtaagcttcctaattgccaaacaaaagaaaaattttcactgtcatcaaaagaaataaactttcttcatggtaattataaaaagactttttgagaaaaaaaagcatcttcaatagtgattttgtagaagaagccaatttgtttttttgtgtatttttatttaaacatttttattaaaacaaggggcattttactgaagaattaagagccttcagtgaaggctaagtgcaggtgtgctgccttctagtaatccagactaggtggttagtatgagttatgggttgaattctgtccccccaaaaaggtatatttaagacttcacccccagtacctatgaatgtgaccttattttgaaatataatctgtttgcagatggaatcaagttaagatgaggtcatactcattggagtgggccctcctccttcactgactgatgtccttataagaagagggaaatttggacacagggagacacagaggagaaatggccatgtgagagaggcagagatcgaaatgatgccaccacaagccaagggacaccaaggattgcaagaaaccaccagagctaggaagaggcaaggaaggattctgccctagagacttcagagagagcttagccctactgacaacttgattgacgatttctagtctccagaaatgtgacagaataaatttctgttgtgttaagccaccacgtttgtaccattttgctatggcagctttaggaaactaatacagtatgtgaatctctttttctgtcatttggatttttgacaagtttcttttctcacatattccatatgtgtgcagaggttcatgagctctggacctgtcattgtggtcaaatttgaattctactttaaatgttaaggcacctgcgtgaaaaccacactactgctgcataattgtgagccgtaggggatactgccattaggagccatttttccttaaaaggaagctcatgcatttgaataagtagtaaatggtgatggcagagttatgtttcataaaatatggaggagacttttgtcatcagcaggaactgtcacttttatgatcttctactggaatgaaaactcacttccaccccaggaaagatctctgcagaggcagtgaatcaatctctgtgctgcctcttcctcctccttgatcttttttgtgattgtccatgaggattttgctacctgccctctcagggattttactgaactccccatctgtgatggttaatactgagtgtcaacttgattggattgaaggatgcaaagtattgatcctgggtgtgtctgtgtgggtgttttcaaaggagattaatatttgagtcagtgggttgggaaaggcagacccacccttaatctggatgggcactatctaatcagctgcccgcttggctgggatataaagcaggcaggaaaacgtgaaaaggctagactggcttagcctcctagcctacatcttttcccatgctggatgcttcctgtccttgaacattggactgtaagttcttcggctttgggacttggactggcttccttgctcctcagcctgcagacggcctattgtgggtcttgtgatcatgtgagtttaatactccttaataaactctctctctctctctatatatatatatgtatatatatgtatatctatatatctatatagatatatagatatatactattagttctgtccctccagtgaaccctgactaatatagattttggtacgaggagtggttctagaggaacagaatattaaggatggagttccttcgttggttttggggattctggagttggctgcttaatatgattagacccaataatgcgaaggactctacttctaatggtatagagaacactgatagtccttggcatgaactgtttagacagttatgcaaaataaatgcatttgacactcctgatttaccgcccatgtgagacaaggggtttagtgactctgtacataataccttaggctgtatgtggagaactaaggaatgtaatgaagttggttggttgctcctaagttcactggacaaagtgatgaaggaaaatgatgaattcagggattctgactcctggctacagaagcatatactgagccttaaatctcctaagactgccctcagtgagagtcttacctcctgtagagaaagagctgaaattgtggcaaaacagacacaagctcttatcatgtgggtggctgacctgtaatggaaggtgcatgcacagcctcaccaggtgtctactgttaaagtgaaggcattgattggaaaagaatgggaccctgcaacttggaatggggacgtgtgggaggaccctgatgaagctggggacactgagcttgtaaaccctgatcaatcttttttgccagaagaaacagcttctccatccccagtattggcaacattccctctccaaccgatgctgccatcagcctttccacctttgtctgaggagataaaccctgcactgcctgaggcaacagtgatggcctcccctgagcagttgccaggcaagataatgttgattctcctcaggagccactgccaacatccctgtttgcttctagagctataactagactaaagtcctggtgggcccctagaggcaaggttcagagtgtgacccatgaggaggtgtgctacacttgagaagaactgcttaaatttttcagtttacataagcagaaatctggagaacaggcgtgggaattgatattaagggtgtgggataatggtggaaggaacatagagttagatcaagctgaatttattgatttgggcccactaagtagggattctgcatttaatgttacagctcagggagttaaaaaatgttctaatgtagtttatttgcttgattagctgaaatgtggattaaaatatggcccactatgagcgagctggaaatgcctaatctcccttggtttaatgtagaggaagggatccaaaggcttagggagattgggatggtggagtggattagtcactttagacctactcttcccagctgggagggtccagaagatatacttttgaccagtgctttgcaaaatagatttgtgagggcagcacctgtatctttcaagagcccgataattgctcttctctgtatgtcagaactaacagtggcaaccatagtcactcaactacaaaatttaaatatgatgggaataactggatcctgaggtggcaggggccaagtggtggcactcagccgtcaaaggcaaggtaggcatagctactgtaatggacagcagaggcaaagcaacaatcagaatagtctgactcgtgtagagctctgccattggctaattaatcacggtgttcctagaagtgaaattgataggaagcctactgcatacctacttaatttatatgagaagaaaattttcagatcgaatggacaaaagactaatttgaattataaaaacagaatcatggctcctcaatcaatttccagaattgagccagtttacagacccagaaccccttgaatgaaggggaggccgggtccccttgaggaaggatcccattatactaccgacaatttatgctgttaatctttctcccatcctcccccaaggagacctccagccttttatcagggtaactgataatgtcatttcagatagtccctgaaatgcctcatcatttccctttctccaatgcacggttgatctgaggtgatgttgattccgggggacccaatgtggtcttccagttaaaatagggccttatggaggtcaggtaattaatggagttttagctcaagtctgacttacagtgtgtccagtgggtccccagactcatcctgtggtcatttccccagggccagaatgcataattggcatagacacacttagtagctggcagaacccccacattggctccctgacagtagggtgagggctattatggtgggaaatggaagctattagagatgcctctacctagaaaaatagtaaatcaaaaacagtatcacatccctggaaggattgcagggagtagtgccaccattaaggacttgaaagatgcaggggtggtgattcccaccacatccccactcagctctcctgtttggcctatgcagaaggcagatggatcttggagaatgacagtggattattgtaagcttaaccaagtggtgactgcaattgcagctgctataccagatgtggtttcattgcttgagcaaattaatacatctcctgatacctggtatgcagccattgacttggcaaatgcccttttctccattcctgtccataaggtccaccagaagcaatttgctttcagcttcctgttctacctcaggggtatatcaactctctggctttgtgtcataatgttatttggagagaacttgattgcttttcacttccacgagataccacactggtccattacattgatgacattatgctgattggatccagtgtgcaagaagtagaaaacaaactggacttactggtgagacatttgcatgccagagaatggaaaaaaatctgactaaaattcaggaaccttccacctcagtaaaatttctaggcgtccagtggtgtggggcctgttgagatattccttctaaggtgaaggataaattgctgcatttggctcctcctacaaccaaggaagaggtacaacacatggtgggcctgtttggattttggaggcagcacattcctcatttgggtgttttacaccagcccatttatcgagtgatccgaaaggctgccagtttgagtggggtccagaacaggagaaggctctgcaacaggtccaggctgctgtgtaagctgctttgccacttgggccatatgacccagcagatccaattgtgcttaatgtatcggtggcagatagggatgctatttggagcctttggcaggcccccataagtgaatcacagtggaggcctctaagattttggagcaaggccatgccatcttttgcagataactactctccttttgagagacagctcttggcctgttactgggctttggtggaaactgaacgtttgactatggatcatcaagtcaccatatgacctgaactgcctatcatgaactgggtgctttctgacccatctagccataaagtgggtcatgcacagcagcattccatcatcaaatggaagtggtatatatgtgatcgggcttgagcaggtgaaggcacaagttacatgaggaagtggctcaaatgcccatggtctccactcctgccaccctgccttctcttccccagactgcaccaatggccttttggggagttccctatgatcagttgacgtaggaagagaagactagggtctggttcacagatggttctgcatgatatgcaggcaccacctgaaagtggacagctgcagtactacagcctcttcttaggacatccctgaaggacagtggtgaagggaaatcttcccaatgggcagaactttgagcattgcacctggttgtgcactttgcatggaaggagagatggccaaatgtatgattatgtactgattcatgggctgtagccagtggtttggctggatggtcagggacttggaagaagcatgattggaaaattggtgacaaagaaaattggggaagagatatgtggatggacctgtctggtcaaaaactgtgaagatatttgtatcccatgtgagtgctcactaacgggtgacctcagcaatgcttctgccaagactatcatccatggactcatggaataccttatccaccatcatggtattccacacagcattgcctctgaccaaggcactcactttacagctaaagaagtgcagcagtgagctcatgctcatggaattcactggtcttaccatgttccccatcatcctgaagtagctggattgatagaataatggaatggccttttgaaggcataattacaacgccaattaggtgacaacactttacagggctgacgcaaagttctccagaaggccgtgtatgctctgaatcagtgtccaatatatggtactgtttctcccatagccaggattcacaggtccaggaatcaaggggtggaagtggaaatggcaccattcaccctcacccctagtgacccactagcaaaattttgcttccttttcctgtgacattacgttctgctggcctagagctgttagttccagatagagatgttagttccagagggagaaatgctgccaggagacacaacaacgattccattaaactggaagttaagattgccagctgtaccctttgggcacctcccacctttaagtcaacagtctaaggagggagatacagtgttggctggggtgattgacctggactatcaagatgaaatcagcctaatacttcacaacagagataaggaagagtatgcatggaatagaggagatccatagggtgtctgttagtattaccctgccctgtggttcaggtcagcgggaaactacaacagcccactccaggcaggactacaaatggccaagacccttcaataatgaaagtttgggtcactccatctggaaaaaaacccatgacctgttgaggtgtgtgctgaaggcaaagggaatacagaatgggtaggataaaaaggtagtcatcaataccagctacaaccacatgaccagttgcagaaatgaggactgtaattctcaatgagtatttcttcctctttttgttaaaaacatgcttgttcatgtatacactgtgttaagaaaatgccttcattttcctttttactttatcatgagacataagatttattggcttcatatcaacccttaagtattgttaactttatgtaatagcatttgggttggggattggtgtgttttcggttgtacatagcatagttgaattatgttaggcataattatgaccttattattgtctttatttgaaaattatatatgatctcaggaaatgtgtatgagttcaagttgacaaggagtggatttgggatggttgatactgagtgtcaacttgattggattgaagcatgcagagtaataatcctgggtgtgtctgtgagcatgtttccaaaggagaataacatttgagtcagtgggctgggaaaggcagacccacccttaatctgggtgaacaccctctaatcaactgtttgcttggccaggatataaagcaggcaggaaaacgtgaaaaggctagacaggcttagcctcccagcctacatctttctcccgtgctggatgcttcctgtcctcaaacatcagacttcaagttcttcagctttgggacttgaactggcttccttgctcctcagtttgtagatggcttattgtgggacctttgtgtgagtttaatactccttaataaactctctttatatatgattgtgtgatttaatgctccttaataaactttttttatatacgattgtgtgatttaatactccttaataaactctttatatatatatatctattccattagttttgtccctctagagaaccctgactaatacaccatccaaacctattttcttctgttggccctatttttaactcttgggacctccattctgtggtaaaatgccccattcagagtaccagcttgaagccaaactggtacatgttcagatatgtgtgtacatgtgtgcacatctagagttgcttttttgaggataatttggctttaactgtaggaatctttatagtcaacttgacataaagatctagggtacctctacctgggaaaatcctggttctcgctgttcacagctggcggccagcaggcaagtgatttaatctctttgagtgttcagttttctcatttacaaaattgagatgataaaacctatctcaggccgggcacagtggctcacacctgtaatcccagcactttgggaggccaaggtgggcggatcatgaggtcaggaggttgagaccagcctgaccaacatggtgaaaccccgtctctgctaaaaatacaaaaatcagccaggcgtggtggcgtgcacctgtagtccgagctactcaggaggctaaggcaggagaatcacttgaacccgggaggcggaggttgcagtgagatgagatcacaccagtgcactccagactgggtgacagagtgagactccatcttaagaaaaaaaaaaaaaacacctatctcagaggttgatccatggattaaataagtagccatatctgctacacaggaagcactcaagaagtggtatctcttgctgctatatgaatagtattaagattccagtagtcttttcactatgttccttctcatttgtggtgtatccatgttttcattcatttattcaacaatatttatagtgggcctaccgtatgtcagtgactttgctgggcattaggaatgtatggtgaatatgatggatacagcctgtgccctcatagaactgacagtccagttgtagagacagacattacatatacgacaacctaaataagtgtaaaactacaatgttcataagtggtatgagagcagctgaccaaatgtggaagattgagtaaggcttccataagtacataatgtatttgtgtcggaaatggaaacgtgaatgagttaactggatggagaagggagaggtgagtttgagactgagggaacagcaatgtttaatggctgtttggtgggagggaacatagcacatttggtgagtgggaaaaggcccttccactgatgtgcagagagccaggatggagcatggaacatgatgaggctcgggagttaggcagaccctggtcatgctagaccttgtaggcactggctgtgtcttcatcttaagagccatggaagccaatgttgaacattaagctgaagatgggaatgagctggacaattatgggtttgaaatgatgtttcgttttcatcctttgagaggactttgttctctcagacagatgctctccattctgtcacacacgtggtacttggcttctgtgattagggtgccagtctcttgcagtcattctgccacttcaggctatttctttgctacctcattgataaggctgccatcttctgagcttgcatttgcccattgttatcctctactcactctggattgttccccagacttcatagagccctttgacttgatttctttcccttcctagatcctatagttagcctggacaactctaaaattcaggatgccctggtgaacacgctaacctcagtctccaaagactttgtcagtggagccagccattctcttttctaccccagtcattctctgctgtggtcttgctccagattatataatcacacagagcagtgctaccttgaaaaacgtaaattttaaacccagaaatcctaccctctcgtgtcaagttgtccctctttcctgccactattcccactcgttcactgaattcattgacagctgtttgctcagtctctcatcactgtctgacttctctcacccagtctggagcctatggtcaatagttgcagtgttctaagatcaggtctctattatttaggaccctgccacttttcaactctggataaactcgacttttccctttttctgcccttgctcctacactattaagcattcctggaaaaaatcacaactgtcatatgggcacgataatgtatctttgctttccagttatgtgagctgtcagctctcttctgtggtcttttctcatcacttttgtcttaactgggtgaatttcaaccttggctgtactttggaatcacgtggggtgctctaaaaaataccaatgtctgcgatttactcctagagattttgatgtaattggcctgaagaacacctggcagggacgttttagacactccccaggtgattctaacatgcagctaagatggagaaccacgtgctaatgtgcccacagagactgatggacatgtttgctgcttcttgcactctctgctagtcctcattttaagcaattgatcttgtctcatccagttctcgtcctttttctacctttaaacttacctctgattgcattcatacttgcctagttcattcttaatctagagaaaaacaattgcctacatcctcacgtataagcccttcaaaaggtacactaggtgtctgtctcaccctctctgctcctgatctgagccagatgagcttagtggctaggtttaaataataggcatgtactaataagcatgcatttctcttaaaaacaaaacaaaacaaaaacctgggggaaaaaaaaccctcaaaatctgccaaacctaaatctaagcaatattaagcagaaagatgacaattttcaaagcaaataatatttgatgaaatatactgagatatgtggtatttaatagatggttggggctggataggggcagtagtcggagtggaagcagtggcgggaatggtggtggggctttgtatattacactaaagttgttgaactttgagttttaaatgtgttgaaagttcctcctgggggaaaggagtaaaatgatcaagtatgttttttgtttgtttgtttgtttgacatggtgtcttgctctgtcaccaggctggagtgcagtggcaccaatctcggctcattgcaacctccgcctcccgggttccagcaattctcctgcctcagcctcctgagtagctaggactacaagtgcgtgccaccacgcccagctaatttttgtattttcagtagagaggggggggttccaccatgttggccaggatggttttgatctcttgacctcgtgatccacctgcctaggcctcccaaagtgctgggattacagccgtcagccactgcacccggcctcaaatatgtgttttaaggatggaactattgtagtagtgcagggcatggtctgtaaaggaaacaggttagaggacatttggaagcagtgttcagcggtttaagcaagaaatgatgatgtcctggactaaagtgatagcagtgaggaagaaaaaggaaaaggaaaaggaaaagcaaacaaacaacccccccccaaaaaaaaaacacttctagaggtattgttaaaactagaatcaataagattggctcattttgcattctggagaattatgccaaagactcataggcatttaagttaattcgcttatggtaattaacccaaaagactgctaaattgcctatttgtttataagctgccgcaataaaagagagttttcagaaaaattttttttaaagaatagaaatctcttctatggagtgtaacgctagagcaaatttgaaataagctgtttgatcagtgactcagaatctttataatgatccattaaaatgtgtaaaagaagccttaagtataaaaataccataatcaggagaagtgtagtagctaagggcttggactgtggacacagactggctttgaagtttatttcctgccttaactgacctgatgaccttgagcaaattgtttaacagtgctatgattcattttccttatctgtacaatggagacagtaagagggtccaccttagaggattgtgaaaaatatctgagataaatattaatgaccattattttgttttatatagtcaattttagatagatattcttacatcttctgcttggattacttgctctagccattgagattcactaaattattcttgttatttagtaagcaaatgcaatgagtaattcctgttccttttaagaaaatattcattggctgaatattagccaactgatatgtttttgttaaacgtaaaagagtagatcctcccatgaagttccagttgagtgttttttcttgaaatttactaattgtccttaacttctataatcaataaattctgtgaagtgaaagaagtagggagaacagtaaggtgaaaaggcaaacattttctaatgagttgctattagtcttctaacctgggataaataataaagtttctaatagatgtgtataacatcatagccatttggggtgttttaaaaatttccatgttaactttaaaccttaatctttgttgtatttatgacagaaaaaaattaaaaatgacttaaatcagtgtgcctaagactttaacattgcagtttaaatttatagacttcaacataaccaccagtttttggtgatccaacattcagtctgattttccacctcattgaaaacattctacagctgctgccgagtgatttcataaattgcattcatgatcctggctggaagttctcttaaagaatgtggtctggatgaatacacaacagttttaacacagtcccataaaatatagttcagtgggataggtcaagtttaaagttgcacaaggatttcataaacaccctgagtagatgggcactaaaactttgaatgtgttatatggaaaaaccttataaagggtggcagtgttccaaaggtagattaagttggtcatctatgaaacaattcctactactgatggttcttaatagtaccacctgctagttgtttcatattaaattgtgtgaaacaacacattctggaaactgatgaactacttatttatttaataaacccgtcaatgaaagaaacctctgtcataagtaatggagttatttattaggcccaaaaagtcttaagccagaaatgtcaggcatttttgtggacaaagagtgttgtaatctcgtattgttttttcaaacagcagcaagtagcacacgatacccagttggtatgtttgtcctttatttggatggaaactccagaatctctgggtagtcagctgaatgccaatttaaacctcagaaagacatcagtggtcttggtgtatagtttcaaagataccactaggctttaagtatgccctgaagcctgacattttgggtgcttcactgatgcatttcctttgctgatcttatttattggtttagtgagaatatcttcaatgacatgacagttgctatcttagaaagcaaggccaaacaatctaaacttcatattcctgattgaaggaattcctcctgcaattccgtacattataattgtggtcccttgttagaatagatgttgctcatgttttgaattaatatgatgacatgaaatgagtgatacacagaaaacattagcaatatatggtagttatgactttgccatctagtatgtcaccagacattgtacagaattatcccaggccagtttttaatactagccagtcatgtcaattgaagttagatattctcccaaaatattattttcagctctgtcactaaacttttctttatttataataatatatgactttttatagttgtgcgttgtatgggtctaaaatagtccatttgtattagtagctttgagctatcttgaatctagatagcatacaccaagacagatttcccacatatttttaaaattgattatagacttctgtcacacataatatgaacatctctctttagagaagaaaatatgagtgtaatttcaggttctttcagataatcatgagattttaatttccttggattttcaaaggaatgtaatctcttttcatttttttgttataaatagttaaggattaacagtgtgtgctttaattacaaggtatgtataaggttattctcccccccgcaaccaaccctttttttaaacttttgatgtttttgatcaatgtcattattatcaaagttctttcagagttactgcagggctataggcttaagttctttttgagatattgttcctagttttgtaatcgtaggagactttgttagctcatgacatctcagagctttgagccccctgtggtatgattttgggtgtgccaggtcaaattagactgttatatttaccctagtgtggacgtgaatcttctcttagttcccagaaattctttggttcctgtgccttggtgttgtagctaacctttatttattattaagatttttaaattttaattaaggtctttaggtttgaaaccttaagaatttcatgataataagaagcttaatacttttgaaattatcttttctatttaattaagctgtattttggtgcttttactttcagagctaaacctctctccctattcagtgttcacccaagtaaatttgaaagatgttattcttcattatattcaaaagtatataaattttactgtacatttgaagtttcatcataaatactcaagatcacaaggaattttgttaaaataaagcccttcgccatatcatgctgaaactaaatgcctatcctcaaaggcttttttgatctctcttgttttccattcttcccttaaaatagttacctatcatttccattaatttgcattaaccaccttatcatatcttgtggtctttaaaggaaaatgatatgctagctaactttatttttttcatacataaaacaatgtgtttaaccccaagtgtattaacaatgctttgcaatttcctgcaatgctcaggaaatatctaagactactataccaaaaagcagattgaatttgaattctatttttacatagtaaatataaaattgtattttatagtcctaaaattatatttaataaatatagtgtgaacagggtattattttagtagtttctgtcatgaaatacttatgcctcacaaaaccaatagtgtaaaaaaaatttcaagaacacatcaaataagttacagtttaataaacaatgatttgtccatgaagagtgattatgccttaaattaatattgttgcaaggtcaaaaagttgacattggtaacacaccactcttgaggatacagacattttggcaaaaaaataacccattacgggatcaaattagaaggaaagttagtaataatttaaaggtaattctaaaggtacaatatgtgcagatacacacatactctaaagacttctgcagacttttaatccaagcttaattttaatgtgttgtagacatttcttggaaaaccactggggtaaatcccacatcctcacctttttttttttttgagacagagtttcacacttgttgcccaggctggagtgcaatgacgtgatctccgctcactgcaacctccgcctcccgggttcaagtgattctcctgcctcagcctcccgagtagctggaattacaggggcccaccaccatacccagctaatgtttgtatttttagtggagatggggtttcgccatgttggccaggctggtctcgaactcctgacctcaggtgatccacccaccttggcctcccaaagtggtgggattacaggcgtcagccaccacgcccggccacattgttatgttaaatatgaatttcttcagagttaatttctatcaaggcagttttgattattttgacccaatagttttagtttccccgaagtcagcctcactgaatttaggaggacttggaaacacccagaaagtatcttccacaggttttttgctataggaattgtgtttctaaaagtttgtgccatcattaggcacatccataggaatggatctacattgtttgtccatgattagagaattgctttccctgatgaaatatttagatcccctggtaaaggagaagctgtggtatttcttagaaagagctttaccatttggtgagaaagagagatgtcttttgaatgttgcagtgaaatgcatgaaatgcagtttcatgttgtcctccccaatgtcttcaacacattctcttgggacaaaggccttcctggttgtagtaagaattttcagtgttcttagtagtcatttctctcttcagttcccaatataaatgttgcatattatgacttgaaaaacttagtttttgaaagtgtctgctggtcaggccttcttcctgagatggatccctttggatttttgcagctctattttgaaattgcacgtttcttccttataagtaccagctgtcattctaaaacatggatcttcagatcacagttcaattttccacctcccaatttgatgaaggtgggtttaaatgactcttcacctgccgagtttctacttctgtgcataggaggaggaattcttcttatttagattacatttattcacgcactactttcagagattcagtcgtctttatttatttgattccagtgtgctcttcaaatgatctccatcaatgcaggcctcctgatgtgcatgatagcccttatttactggttttcatttcacagaacatgtttttcttcatcttatttactaaaaatgtttcttccaaagtctgattcttttctttaagaaagaattctctctctgaatcctaaagccctttcttgatgtcttcatatccagtgactgagaaaataagaagcaacagactcattggtccatgttgagatgggagtcactgtatctctcctctgagcttttccacaattcagaagacagatgtcacatcctttaccaatgcatctctgacagctgtagcctggcttccagcggcctcctgctgagctggctgcttttcattctccagtggtgggaaacaatctgaaaacaacctgggtcaccagaggtcaccaggcctctggttttcctgaagaccccactgcttctccagaagctgccatggccaccttgctctgagaggggttttccttctttggcgtgggccatgcccctgtccagtaggttctctaaagctacattttgcgaatctgtcgtcttttggagagaaaggagttaagcttacaaattatatataatttctgtatattaattgaggggaaaaccccattgtctactaagtcagtcccttggagctgaatctcagctctgccacttgccagctgaaactttggtgagttaattaacctctctgggcttcagttttctcagccgtgaaacaaggatgatgacatggactcagtagggctgttgtgacgtttagatctaataacttatgtaaactaaaataccagcccagtgggtgctcagtcaatagaagtttccccttctctccagcagaaacctcaggtttctacctaccaccagttcttacctttggattttgtttttatcttgtgcattattcaatcacaagaacacataacatttagtcatgttgtaggattaaaagcctggagaaaacaaactactgccacagcatgaatgaagaacttaaccactgggaaaaactcagtattatttgattcatttcacctatgacagtttatgtattttgggggacagcagtggttgtactattattttaaagtgtacattgagatttataaagtgttaattgtgcttatattttcacccatcaaaaaatgattgtttttgcttgatttacctacctaagtttttgctaaatttggtctccttgaagctgggtatattgtctttttgtgtatagtaacttaagaatgtggaatgtgggcagacagcataatctatggtagttaaacttttattagattgttgtgaagattaaatgagatagtacatgccagaggcctagcccagcacttgcatacactaagtcaataaatattagtcattattctgcagtggaaaatttagtgtcactaaaactttgtcctgctagtcaccttaaaacagacagcataacctagtttttcatgttatcaattgagaaaatggattctaaagtcaagctaactgaagaatgtcactttaatacataaacgggtatattttttttgaattgataaaagggtctgtagaatattaaacagtagttattaaaagaattaattccatttcttaaagaagtttagtgtgaccaaccactagtgtaggcattggaagaatttagtatattttgtaaaattttttccagcatgggatctgactctctgaacctgaaaatgaagcaaacaaaacagaggcttgttctgcctatgcccttagtgccaaaacataaatcattgctgtattcatcaagtcataaaatttaaatcatctctatttgagttggataacttgctgcggtatttgatactaaccactggttcaagcaggacctggtgatgtttaatggactattgttcaaagttgttggactaagttgttgcattaatataaaagttttgcaaaataacatggttgtaaaagaaatcttccactaagcaatgaatataaatgaactttatttgtccttgtaaccaaatactgttcaggaaaattttttgctttagctttacagctaatttgccctctttctgggatacttttagggctgtggctaccgagtgacatcatatgtaggcatttctgtatatgtttctcttgctttcctattttctgtaggacagagttgccagctgtcatcctctctgggagggaaccgatgctcaaaaaatggcactacctttcctctcagcagtaaagtgccagtgtttcttttacagctgccatgtgcaggtgccttgacatggctgcatttggaatttagacgacagctgcagaaggtggaaccattggctgtagggtgagtggtcttaagttttcagctgagacataggtaggaagaggaaactgaaaggaggctcagcacagggaatgaaatcctgttgtttggattcttgaaagaacagggagaaatttcaggaaaaaggatgagaaattatttttacttttcagcaccattattcaggcacaaaatctggacaacaaattataaacttaaagcatttcaagtgtcacttaattgttacctaagtatactttaagtagcttagattaatgtattttaatgtaggaaattagcatagtttgttaaaagattttaattcgacagaccacagatgagtacacgtaaatacttagtaatgaactgctgcatcagcaggcatttgaggtttaatcatgcagtcaataatatagctcactgtcattaccttgcctggtccctgtgaaatttatcatatttttagtaagttactgtagccttaggtgagatttggtatttttcttcgttactaacacctgctcttttcatggtactctcaacaaaataaaatagttttgttttgttttggtagcaagcttaacaagtggttttttgaagtaactgattatttgctcttgtgcagtgtggtttgacctcagcacctttgctgtctaaaaatggtcagaagtattttccaaacttaaaatagatttttcaagatctatttttctcaaggaaactgtttgatgttcctagtgacgtaacaaatcaatcaagcaaaagctttagaaaatctggatatttatattagggtcaaaaagcacttaatatttcctgatattatgttaaaaatggaaactgtaagtttatactaatcgagttattttttgcagagaaattatgagatctttgatttttcactttgtaatgatgacagattcatgaagagtagaagaaatggctcagctggctatttagtagttagagaaacttgtgaagaagacattcagattctgcttatttgtctatacaaaggagagcacaggaagattaaccaggcaggcctgaagagaaatctgagtcagcatccttgctacctgtgtcaatggggaaaataggaaggcagcttaaataagtcaagactgttaagcatctaattactatacagtgaaccctttttccccttcagatagaagcatgattgttaaaagttcttgaaaccctggattgctactgctttcaaggcatgagacagatttgaaattctgggcagcaagctatcactttcatttgaaaactggcttctctttctttgtttcttcctttccccctttctcttttaaccaaaatctaacttatcaatcacaaagtttaataagagtaaagaatttcagtatttgggtccaaacctataaaatgtttacaagcacctccaaggatgtattgtgagcaatcacgtctatcctttgcgataaccttaaaaaaagttatctgttttctctccccacccaaatggaattgcaagattactttgtctataaatccttaaaaaacaactaaatccttcttcaaactgttataattttagctttatgctactttttatggtaagattgacaagttttctatcaactcttaaaacattcttttatttgccctaaattatttcaagtataagttggtattgcttttcttctagaattttgaaatttagtgaacaaattcaagtaggacacacccttcatactgttcgtaacactatatactcttttaatctgccttttgcattgccctttccctactgagaagtcataaccctcggttgtaatttacctcatacagcaatcaatgattttgtgatcactttagtttctttggaccttatccagcatctgtttatgtcttgacatgtagataccagaattgaagacaatttgaaaactggcttttctttgtttcttcctttctccttttctcttttaacccaaatctgttttatcaattgcaaattttaatgagtaaagaattccagtatttgggtccaaacctatataatgtttgcagtcacctccaaggatgtattgtgagaattcatgtctgccctttgtgggaataagtttaaagttttcttctgttaatgttgaaattaggaattcattttttctttaaattcttgcaaagcctgacttttagactttttttaaaattttacattccatttatttgacaaaaccattaacgtagctaatagcatggcagtgagcagttgtgcagttacataaacttcttcaggttataaagcttctattttgtatgatgtggcagtaattcagggagtaagtctttataaagtttctctaggtgctcaacttactaggagaactttggattcctttaaagagcaaggaaaaaatagtctcaaaaaaaaaaagactgtggcctggcgcggtggctcacgcctgtaatcccagcactttgggaggctgaggcgggaggatcacgaggtcaggagatccagaccatcctggctaacacagtgaaaccccatctctactgaaaatacaaaaaattagctgggcgtggtggcgtgcgcctgtagtcgtagtcccagccacccgggaggctgaggcaggagaatggcgtgaacccaggaggcggagtttgcagtgagccgagatcacatcactgcactccagcctgggctacagagcgagacaacgtctcaaaataataataataataataataataataataataataaaaataataaaaaaacactgtaatgtaattagttgaaacatgattagaatgacagttgaggtcctccctgcttattgaaccaacaataacttaaacaaacttaaaccactgatttgctaaaaacaactgtagacttttcagttaactacaattagtatgataagagcagagaaaaacctgcatttcttcatccttgtaaaacttaagtaaaaggctttaagtcaacttattaaaaatagaacacctttgtaaaatgaaaaaataaagtcattttttactactaaacaaaaaatatttttatttttagcgtaataaaatcaatcgttttatagttatagtgttgaaaaaatatttcttaccaactgcctctgaaaaattttcataaatactatttttaaatgaatactgatgtgagacagttccattgtacagcacagggcttggtacatcatagatgtttagtaaacgcttgttgatatgatgaaagtttggcaacatccaaagcatcgtaatcaggaggcagttgaatatatgccttctctccatcaggccgaatcaggtgttgaccttggccacatcgatgtcacagagcttcttcacagcctgtttgatctggtgcttgttggctttaacatccacagtgaacacaagcgtgctgttgtcttctgtcttcttcatggccgactcagtggtcagcggaaatttgatagtgtagtggttaagcttgtttctcctgggggcgctcttccgaggatatctgggctgcctccggagtcgcagtgtcttgggctgctggaaggtgggtgacgggcagatctttctttttttctttttctttttttgtggttgtggacacctttcaacactgccttcttggccttcgaagccttcactttggcttcagctgtaggaggggcaggagcttccttcttcgctttcggcgccatcttgtgaaaagggtcaggacaatttctagaaggattaaaggatgaatgctgtttagtaataagccgaaaagaaccataattttcaagtgattcttcatgattgccaactaagaataaaataaatatgaataatcaaacatttgaaattctgtatttatttctctaaaatcagcttgattgatgagaaagttactattgcttgacattttaatttttccagtttctgatattgatgctttattttgtataaaatggcactgtgatagaatatttactattctttctgtcataatagacttgctttaaactaaccccatcaaagtgctgtatgttcaaaatatcatcatgttaaggtaataattttcagtgtattagaaaagatttgtatagaaatatttattgtaaagcacgtgcgttttacactccatgcactaggttgtttttgtttggtctctgtgtatatatgtgtttacattcctgttgaaatctgaagaaggtggtgtgtatttaaatgttacttttagtttattcacatgaatgtgaatttctgtgtaagtatgtatctaaaattggtttagaaacaacacaatcagttttggtctggtggtgcaggatgaaatttatatacatttacatacttacaagtaagttgctttaaaattaaagtaggggataaaatgtagtgtgaattgttatgcaaaatctaagcacagcataattagcaagggatagtagaaatgcaatttgttaaaacctgaattgtaacagtcaattaatttcctcacaacgtgaaatagcaaaacaattaacaaacatcatttgtcaaaaacagtattaaggcaggttaaagaactacagatacaaaatttataaattataacattgaaaacagaatgttcagtagtgtttaaagatgttttgatatcttttacagatttttttaactgattgatttatttcaataaattttccaaaatcatgttaatactttccccttatgtatgtttggacttataacacgttttagatgtgagattttcctactctggacaaagtgagtctattggagaaagaatctattcattattaaagcaggggaaagtaagctaatatacatatatgtgtatatgtatatgtataatatatattatacatatacatatatattttccattctgcacttttaaaaaaatattgttttaaaatatatataacaaaattttccattgtaaccatttacaagtgtacaatttagtagcgttaattatatttatgatgttgtgaaaccatcaccactgtctatttctaaagcttttccatcaccccagagaaactatttttaaaataaaatctttattgagatataattaatataccataacattaacgtaaagtgtacgattcaatggcttttaacatatccacacaattgtataaccattaccatagttaattttagaacattttcatcaccccaaaagaaacctctgtatccattagcagttactcactatttcccccaaatcctctttcccctaaccctagtcactcaggaatctactttctatctctatagatttgcctgttctgggtgtttcatataaatgaaattttaaaataggtaggtttttgtgactggcttcttttttgttttcaagacctctctatgttggagcagatatcattacttcattcatttttattgttgaataatatcccattgtacggctatcccacattttatttatctattcactgattgatggacatttatgttgtttttgctttttggatataatgaataatgctgctgtgaacatttgtgtacaggcttttgtgtagacatgtattttcatttcattgagtgtatacctaggagtagaattgctaggttatatggcagtcctatgtttaaccattcgaggaattgccagacaatttttcaaagggatttgctccatttcatagtcccaaccagctgtgtacaagggttctcatttctccacgtcctggtaacactaattgttactgttttttttttttttttattatagtcatcctagtgagtgtgatatagtagttcattgtggttttgatttacattgacctgatggctaatgatgttttcgtgtgcttattggccatttatatcttcactggataaatgtctattcagatattttgtttatttttaagtcatattatttgtctttttattattgaattctaagagttctttatatagtctagatacaagcctattaccagatatatatgatttgcaaatattttttcccattctgtaggttgtcttttcataatacagttgacccttacaacatgggagttaggggcactgacccctgtgcacagtcggaaatctgtgtataagttttgactcccccaaagcttaaactactaatagcctactgttgactggaagtcttactgataacgtaaacagtctattagcacatactttatatatgttttatatactatattcttaccataaagcaagctagagaaaaaaagatgttattaagaaaaacatagagaagaggaactattcttactattcattaagtggaagtggatcatcataaaggtcttcattcttgttgtcttcgctgtgagtagggtgaagaggaggaggaagaggggaggttggccttgctgtctcaggagtggcagagggggaagaaaatacacgtatagtgtacacctgcagttcaaacctgtgttgttcaagggtcagctgtactttctttttgagattctactgttgcttctctctgatttctaattatatcacgactttattttgggaaactctgaactccttacggggtgtgcctatcattgataagctgagaaaggcctctgtgctggccaaatccatttcttaccccttggctctgtgctgtagaattcaggaagcatttattttggtatctgctaatgtactagacactgtgaccaacttttgggaataaatataagatggaagccattctcagtaagcttatagtctagcgaacaggtcagggaaagctgagttgtcaggaaaatcactgtctttataaaccaaggagagtttattttattagatttatgatattaacttgcagatcatagaaggagacttgaatatcactgagtatattttacttcgtggtctgtaaaaagtagtctagtacgatgacaaatggcctgtttccccacattttctttccattccccctcattggagctctttgctcagtctctctgggccctgaaagtttacattgattccttattcttgtcttttcctgggctgtttcttttctctttccttatccaagtctgtctgggaccgagacttaccttctcatggctcactgcaccctcaaacttctgggctcaagagatcctcccacctcagccccctgagtagctaggactacaggcatgtggcaccacactcagccaattggtgcctttctgaaggtcttcttttcctctcccattagcatagtactgttaaaccttgcgtcttgattaatattctcgtgtttgaatgcttagttgctctcgtggtttgcatgcaccgtagagtttgtactgtttccttctttggtgcactgtgtgtggagctgagtagaagaaacatggtaaaagcacagtgtactgttctcactttgcaacatcagttgggaaaatgatagagggaagcacttggggcaaatgggcaaaatagagcaatgggttagcaaatgcagaaaatgatatagttaattaaacaacctgatatgttgagttgaaggcaaagaaaatatacaattttataattgcattttagactatttaaaaatgctcctttctcttatccccagccttttcattagataagcagttttcgtgtgctaacttggaactcacatacgtttaaagtctttcatttcacacacgttgcttaaatatgtgcatgtagtttttgccttagctactggcctaataaaagcctcttgtgaatgcttatcaccttgtaaagtagttaccagagctacagtaaaattggcctgcaagtgaaaaggctttgacttccctagaggaagaataaaaaacatatgagacaaatagcagcaactgaaattatctggtgcagaatgtggcagaatgccagccaaatgccctgtccctcagatgtttcacacctttatcttaattcgctaaaaaggccaccttatttaaagaatttcaaacacaacttgagaatgccttattattggctttgacacagtttacacatacaatcctgtttcttattgctatcttctggtattaaggccctatagatttaagagattttaaaaaaatgtttatatttcttttaagtggagtgcatgtttgtgtgtgtgtgtgtgtgtgtgtgtgtgtgtgtctgtgtgtatgtgtgtgaactgttattggaagttattgccatgtttattttaggcacttcatatatctaattagaaatgatgtttattgttaagtaggcaaagttgccttcgagtgcatggtgagaaatagtaatgagatactttagccattaggccatgaagacttttacctaaataatagggaaggaataaatcctagtattgttttggagttgctacaggagaacagaaattgtttaaacgagagagtttcaaaaggccccactacagttaagtatatttaatttaattaggtaatcagtattattcttgcaactattaatggcacctcatttgtttaacacttgctatatcatagagcatttcatacgtgctactttatttggtcctttcagaaatccctagaacaaggcagggcaaatgtttccatcttggttcatggatgaggaaaaccaagactcaaagatatgcagtgacttggtcaaggtcacagagtagtagaggatggctctctttccattacagtgacagtcagaaagcgtcaaatcttaggttatcatgacacttagtaattatgaagtatattttttccaagaaataataagccttttaggcaattgaaactgccgagaaggctgccagaggagtaactcaaaacagaacaaacatggaggtttttggtcctttcatctctagcattgagtccactaggtcagggtttcaggaaatgggaaatcttcattgttacctgctaggttgccttatttctccatttaatggaaaacttagtcttcattattttcagtttaacaaataattttccttagaggaaaagaaagttttgcctgtattttggggaaaatgtatagaaattaaatctaaatcattgaattattagatgatgtgccatttctgagccaaaaaagtaggaaaacaatgcataatcatctaataaagtatatgttttatgattatatatgtttcttgttttgttttgtttacagtggcgtgatctcggctcactgcaacctccgcctcctgggttcaaacgattctcctgcctcagcctcctgagtagctgggactacaggggcctgccaccacgcccagctaattttttttttttttgtattttcagtagagacggggtttcaccatgttggccaggatggtcttgatctcttgacatcatgatccgcccgcctcggcctcccaaagtcctgggattacaggcgtgagccaccgtgcccggcctatatgttttattttataaagttatatgttttattatttactttttgttatgtaattgtttatgtcataaaattataatataataattccttaaaccaaattatattccataaattataacatatgaattcaatatgcatttataaaataaagatttctagacatatggtagactaacagtgatattttgaaatctacttctgccacagaactagataaccatttccagattggaatataaattaatcaatgtctcattgttagagctgctgtaattttttgaggggatcaagtgaggaaggacttatttttggcttagatttacatttacagcaaggttatcaacattttcctgtggtggcacattaatattaataatataatcataatgccgatttacacatttaccaaattcccatctattaccttcattcctgttaaaatacaacctatcatgttgttctttggggatgagtagtacatttatagacatataagtatatgtgtatatttatatatttgtatatataaaaatttaaaaaattcttttatttttaggagcaaaaatttggggaaaataatgtaatatttatcagaaggatactttaggatttagctctatcagccaggcagggtcatcagtaaatctaagaactgccaaacttctcacactcctaattccctcttttatccctccttttctggctgtgctagagatatcctattacacatgattttcttttactctgggctcttcttcgcccagatcagtgtgattgctttgcattgatttctgtatttgcttaaaaaaaatttcccttgataatgtttttaaactttctagcatgagcctttccatacttggtattggtgttttataatagatttgaggacaggtttgtgggggattccataacaaattcaatttatcagttacttctttttaatgttaaaataactgcaacaattccacaataaatagagtgaaatttgatgtgctaaattaatttaaatggttttgacacattttccttgaaggactcttttctaggtttttataatctcacctcagtgagagtacagtatggtttaattactttccagcagtgcacactttaatagcccgtattccacgtgaaagctatgtgtcttctgtgggtttgaactgtttctgcctaatccaaggaaaaatatttgaggaacattagttaatgccttttccaggaatgggagtgggtaagcgtttttttcatggcttatagaatatttagcaattttagcttccagtacttaattttatagtgttctcagtactggtggcaaaggcttccttcagaaaagtgagaaattatgtgaattcccctcttggcatgcttaggagggcaagtcatgaatctttactctcatatttttctaaaataaaactgggcgttgatatttgctgtgatctaatatgtagatatgatgaaaagatttataaaatagcatatattgagatttttgtatgttctcataaaaggtgctataaattgaaacatttattacacagaaaacgtctaagataagagtattattttccaggatagtttatctaagttctgtaaaacttttaataatgtaagtaactactaatgaaaggacgttatgtgtcacatttgcattcataaatatccatgaaggatctctttcaccaatgttattcagtctcagtccaagacaaggtcagacattgattatgtttgacatcttaacaaaagtgaatagggaagataaatattcttaattatactgctagaatggtgagaagcagtggtctataatgtaaggaggaatattagcaaaatagaattatggtcaattgcaattataataacttctatgcattaagtatcttctactacatattagctctttatatatgtcttatataatgtaattttaactaatatcttaagaagtctaggtagtatttatacccatttgcccaaatctggaaacggagtttccaaaaaattaaataaattccttaaaactgcccagctagagtccatttcacatctgtcaggctctactaagctgcttgtcagtctttgacttcctcattatcagagatagatatggtattgataatgtacaaattgtttatttggcccagaaatgtgtttgtgcttttaaatttgaactaattgtctttggcagtttgaaatgtacaatacttgatggaaaataataaaactccactccaattagaataactacctgatttcttgattatagcttctttaatgacggcccattttatattatacacggtttcatatttttcttatatttaacaaacacatatacaacactactgtgtgtaaggcactgttctaagtagttacaaacatgaattcatgtaatcctcaccagtatacttatgaggtaggcattattttatccccattttacaaataagataaatgaggcacagagaggttaagtaacttgctcaaaatcacacagctagaacatggcggagctgagatataaacccagtcagtttggctgcagagtgctcttaactgtatgtatttttcagatgtttcagaatttggtgaaagcaataattgttctaatcctattgctggatttaaaagtaggaaagggtaaatagagatagcaaacagtgtcaataaagtatttaataagaagtaatgacccccataatactttgaaattccctatattaaaaatacaagatgaattgtaaagagaaactgaaaaccagctttaactgtgttaaaagccagttgagacttctactttatttatccatttgatattatgcaggcttctctttgtgtatatagctgagcaatgtgaatataatgctgtcattattgttttctgtgttataccactagttacattacttcagattatgaagtacagtattgagctctgtcgttgactatatctctccccaattatatgtatcatgattttagcccatattttataaatgagagataattttaatgaatgtgtggggcaaataaaacttttagagttggtatgttaaaatagggctaaagttaaagtttcaagaattgtagagagagagagactagatgtgccaatgcaaacaatggattggtgaaactgaaactgaagaaatttctgataagttagagatttttggttaactaagatttcaacctgtgtgaatctcaattttggcagaaatgaggaatgtaagcaattctagctttgcaatgtggaaaagtcagggaaactaaattagactttgcactaacacttcctataagcatatgtcaccctgatattgaatgttgtatatgagggtggagggacaggtggggacaaacacccagctcctcctgggcttgagccaaggacctttggcttcagttggatcttgtaactgccctgtttacctgtaatcagaggcaaatttaccaggagtaaatttactgggatttaggtttcaggacctctgacttgcacagacctcctccaaggctctgcgaggacctctagcaatgtgttcacgtgatcatatggttttgcaaaatttgaggaatttaaaggtatttaagcataattagttaagactgctatctcttttctactctgacggtccttctatcacatttcctcacacaggattgctttggaatgatcacaggcatttatcagatctggctaaagggaaattgagttgagaatatacaactttaaactatagtttgaaagatattttgaaacatttcaataagacaagggagaaattatagactcctaatttaggtacatagggttcattattttctcatttttgcacttattttttaaagaactgagataatttagataatggaacataaaactaaagcaacaaagatgaatgatgaaataagtagaaattatttgatatcaaaaagcatgttgtaaaaaaatagattataacaaaagcagtaatgcattgaaaagaaaagtttctaatagagataataaataggcttgatagactacttgaaaacttagttaataaaaaagagtgaatcatatgaatacactggggaaacacttaagtttctcttgatttaaccacaaaatacgtatcgagaaagacaacataaaatgtcataatatgtaactataatgagctttataattaatgagtatcttcaggtcaaagagtatatatattagttgccacatatgaaactttgaaataccctgaaattttgcaactcataaaagaaaaaaattttatgaaagttttcccaaattttacagtgatcctaaaaacccgacatgagttgtgaactgaaaagaatctttccttaacacatatttctaaaaattctttttatagcataattagaagagatgccaaattattttttaatttcgtatgtggaaaattgtgttataaaattgtcatttgtcaaaatatgtataatcaaaaattttagaaaaaagcattatagaggtttgttggataaataaaaataagatggtatttttctgaatttcatgatgtttattttcagctatttaaaatttgtaatttttctgttctaaatatacttccactttctcttctaattttgtattcataattttgtattctttttctttaaaaggtctagaaaagttgcataagattcagttaccctacaacctggatccaccctggtctgtagttaatggttttaaacatgaaaaaatatatttattatgtagcatacatattccagaaggcataaagtgagaagtaaaagacccctcctccactctcatttgtaagcccaaaaagaaaatacttgaccttctttatgtattttttaaaattgttgtcacatcatctttttatttattttaatttttgtggttacatagtaggtgtatatatttatggagtacatgagatgttttgatacaggcatacattgtgtaataatcacatcacagaaaatgaggtatccatcctctcaagcatttatcctttgtgttacgaacaattcaataactctttagttattttaaaatttacaattaaattattgttcactatagtcactcttgtgttgtcaaatatttggtcatattgattctattatttttggcacccattaaccatccccatcaatccccccaactccccactactcttccttgcctctggtaaccattcttctactctctatttccataagttcaattgttttgattttgagatcccacgaataagtgagagcatgtgatgtttgtctttctatgcctggcttatttcacttaacataatgacttccagttctatccatgtagtcacaaataactgggtgtcattctttcttgtggctgaatcatactccattgtgtataaataccacgttttctctatccgttcatctgttgttggggtgcttaggttgcttccacatcttggctcttgtgaacagcgctgtaacaaacatgggagtgcagatatctcttcaatatactgattttctttcctttgggtatatacccagcggtcagattgctggatcatatggtagctctatttttagttttttgaggtacctccaaacggttctccatagtggttgtactaattcacattcccaccaacagtgtacgggcccggtgtggtggctcattcctgtaatcccagcattttgggaggccgagacgggtggatcacctgaggtcgggagttcgagaccagcctgaccaacatggtgaaaccctgtctctactaaaaatacaaaaaattagctgagcgtggtggcgggcgcctgtaatcacagctactcaggaggctggggcaggagaatcgcttgaacctgggaggcggaggttgcagtgagccaagattgcgccattgcactccagcctgggtgacaagagcaagactccgtctcaaaaaagaaagaaaaaaaacaaagcaaaacaaaaaaaacagtgtacaggggttcccttttctccacatcctctctagcatttgtaattgcctgtcttgtgaatataagccattttaactcaggtgacatgatatcttattgtaatttttgttgcatttctctggtgatcagtgatgttgagtacctttttatgtgcctgcttgccatttgcatgtcttcttttgagaaatgtctaatcaaattgtttgcccattttttaatcggattattagttttatttcctacagagttgtttgaactccttatatatactggttattaatcccgcatcaaatgggtagctttccttatgtatgttttacagttgttcagatctgctttgttcagtagggtggtgtgcactaaccagccacatgtagctatggagaacttgaagtgtaacaaatatactgatttttaaattttcatttcaccaaggtttaattttaattcagtttacattttaaatgaataatttcattattggaaaacttctaagtatatttaaaacaacttgggtttgtggatttatttttttcagctgtaaattttctaaaatccaaaggacatcactgcagtatgtgtacatgtggtgtgtctgtgtatatacatatttttttccacaaacgagatcatactctgcatcttagcttttcaacttaaccgtatgattgcacatcttttcgcagcaacttacagatttatttcatttagttattagcagtataatattctcttctgtttttatagtcttttttcatacagctgctggggtgattctttttaatttaagtgtaagtgagatcatgtcactcctttgttcacaacccttcggtggcttcaaatctatctcaaaaccaaattccaagtcttcactccacatcgaatgcctgccttgatctgttttctcactgctattttaatatggggattagacacaaatattttattctttaaaaaatccatcagaaatgttatttagtaaagcagagactttccacgtacaaaatttaaggtcttgtttagtgtctcatttattttaccaccaccagttccttttaaagacaccccatttttccttcccaatagcactcactgaagtaatataaaccttgttaactgtagtaaaaaatgatgcagactttctctaatcaagagctcatttacaagaggaaatggtgttatggcagatagctgaagtatactgtgtcttaagaatttgttgcctctttcttgctagattgaatttcagaattcagagtctaaattttctctttcacatctggtggcactttttaaaaaatcagtgtgcaaaaaggagaaaaatctctctgcttcctctttatgccactcactacagtccagcctatgccaggcttaaagaaaaggcttttgtattggcaaagacactccaaaatggtttccaagtgcattaaaagtcaaggagagttttgcagaaaaatttaagattaaaaaaaatccgagtggttacaagttaagaaaccatttttaaaattaagcaatgactaccaaaaacatgctggctaagtacgtatgtaatgttagcatcccagtgccactagtgcaaggcagactcccatgagccatttaaacataaaagttaagaaggtagaattttagaagttttaatgattatttgaaatctcaagggattcttatacaagatatggtgatggttataaatatatggactgacacacacttatcactaaataaatgttttacatgaacaaatgagtaaacaagtaaaccacattgcttggaataagtagtgtttgttagagctttgagccctgggagcgggggactcaagaaatagggagacttaatcagaaagaaaggactatgaagtgatatcagagtaaatgctaaaactaggcatagtgtgaagttggaccccaaagggtaaagacggttgttggaaaatgaagatagccttttctgtggaagatcaggcaagtaaccaccccagtttggagttatcatgaaatcagacttgaggacatgtggatttacacctggtgaattgaccaaaaaagagcttgttaatgtgctcagagagttgagaattaaagtgtgagtggttctgaactgagtattgtttgcaattatttatgaagaaagtgacagaaaatctagcttatcctggcttaaatgaaaaagggcatctgttgacacatataaccaaacagtccatgggttggactcactttgggcatatcttgatttaaggttccaaagatggcccaggatcttattctttgtgtgaaagcctcatcttagaccagccgcccctttctggtggcaagatggctacagcagctccaagccccttactctgttctttcatgaatgtgctggtcactattgtctcccacatcatgggttgctttttactagatgtctcttgttaaaaagtttttaattttagcgttaagtttctcaatctgtttcccgtttggttagcactttctgctgtgcaagtaatctttgcctcccccatgatcaagaaaatattcccttacgtaatctgctagacacttatactgttttaccaatcatatgtagagttacagtctgctcagaattccttaaagtctgggtgattctactgggcagccagggttgaagacctcaggctttgatgttgctgagttttcctgggagtctttggcactgctacagtgtgtggtacctgcttgcctgagagggaagtaccagtttgacagaatagctacacattgatctgttttgtggtaaactaatatgctccttctttgttttaaatgaatgggattttgcctttctttgagacatgagttactacttttattaacagatgaatgatgtaaatgtgttagttgttagtaaaaggagaaaaatccagagagagtatccattcataagcaactatcaattatattatgtattcaaggtgtcatcttggattctgagatgttgagactcttcaacttcaagactccctgatcctttattttcacattttttcacactatgaggtatccaagatgtgagaaaataaaattattccagatggctttccttttctcattttttagaatgtttccgtctaatcctctctctcaaaagaaacattccccttggaattgcttctgttattatttgtattcatttttaaaccttgacaaccatgtgaacgtagtacaggtgttttttttaagagagtgatctataaagtaaagttctttgtgctgtgttgcagaaggagaaatacttaagctaccaaagtaaagctactttaatctaattaaacatgctttggagccagatgtaaatgaggtaacttttttgaagagttagtttacagatatttggtcattctcattttagataaacagaaagccatgttgattattatctggatctggctagactcctgttcaaccacttgctagctgtggggacttgacaatttctttagcttctctgaaatgaacatggtagcaattcccacgtttagggatgttgtgtggattaagtagagaatgcagagaatgcagaaaaagctcaaagctttcaatgcctggtacgtaatatatgcccactaagtcttagttatgctgttggttccactcccgccaccattccagaggccgcagcagggttctgtgttgtgttgtgtttgatcctatcttcttatggtttgtctagagtggaagttttggggtaggggtcactcataaaacagaaatgcaaaagtagagggaggaatctgggatgtggtttatttaagatttttaaaatgtgcttgcttgtttgggtttttttaaaattatttttacattattattattatttttaattagagacagggttctccctatgttgaccaggctggtcttgaactcctgggctcaagcagtcgttctgccaagcctcccagtgtgctatggttacgggcatgagccaccgcgtttggccttggctggatttttggtttgtttttcttaccttattttgagaactagagtcgtctttgctttccctttttctcacgtagcctatcccagtggtcttgaatcattccctatgtagactgcctaatctttatttccctctgtttatgctgaatttttatagcgaagatcttaagaaagtgtaaaagctgtttttacccatctttttatctttaaatttttttatataataattaagctttataaaagttataaagtataatacaaccaacatccacatacctaccatccagctttagaaagaaaacatagtgggtggatactgtggaagctgcctctgcaccttcagcctccattgaagaagccattcattcccatgccattttcttatacttttaccatatatggtgtgtagttccaacctatttaaagtaccgttttacttatttaaacattttatataagtcttgtcattttctttgtattctgcaatttaccttcttattcaatgttgcatttttcagatttatacatgttgatgtttgtagctctagttcattaattttgactcctgcgtaatgtttctttgtatgaaggtaccacagtttatcctttctccgagtggtgggcatttgtggacactctctctctccccaccctgttagagacaatactgccacacaagtttttgtacatatcttgcttcacggatctttgtagctttggttttgttgtgtttgtttttatacagaaaatgagttctttggggactagtcaaattctgtgggcctcagatttttcatcataagattgaactagatcttttctagctcaaaattgcacttcttacatggttatttaaactggatagcttgaattactggcttttgttgtttgtgttacctcacaggcccattagtatatctcttcagtagattatgccggatatggattttactctgacatgagaaacttccatttgcaacatttttgaggacaaaagtgtatgtagtgttagaaactatcattaagcaggacacaggacactaaaccttccttctccccaagtttgtttatctttcctggactctacaggaattacaactgctattaatttagaataaacatataaataatatattttaaagtatgttgtctacatgtgctgggtcaccttcatccggcatcagcctggacagaggactcaggccctctacttgattccataagagtccggttacatcgagcattttgcgccctctttaaacttgactgagaatttacaaggccacggggcttacagcattctatttttctttttgcctttctctcttttttgcttcgtacataaatgaaaatctaatgtaaaattgtaaatgggaaaagtactatcatgaagaaaaaagtaccagggaacctgaaacgagattaaaactgactgaaaggatctaggaaggagtcttggaggaagggaaatttaagctggtcctttagggatgaagaccttaaaggtgtatgacaattagacatgcttgtagggaagaaggaggaatggagatgctttccaggcagaggaaagatatacgaggggaaaaagtataagaccatgacatattcagggaacagtaagagaagtggctcagactttctgggagacagtctgccatattatcccccttcttccctaacttaggcagtgttaaaacatggctgcatattctttgacactctcccattgaaaagttgtgtcgacgccccctcctcttgaatctagacgagctgatgactgcctcagtcaatagaatatggccaaagagaccctggcttacaagggtcagttgcaaaaggccatgtgacttctgctttgttttctggaacacttgctcttggagcccggagccaccatttaagaagtccaaccagcttgaggccatcatgctgtagaggcatgtgtatagatgatctggttgacgttcccagctgaacccaactttctagccattctaccaaatgtgagtgaagttgtccttcaactgttttctgactaccagtaccctagagcaacctctaacatcactacacagaacagaagaaatgctcaagctctgcccgaatttttgactcacagagctgtgagatataatacaaataaccatcctggctaacacggtgaaaccctgtctctactaaaaatacaaaaaaatacaaaataataataataataataataataataataataataataattgtcttgagttataagtagtttattatacaccaatagataactggaataccaaccaaagccaaagtgaggggatttttctttagatgcttgctgaagacaatattaagtcatccaaaaacctctccccagaatatactactgaatgtaatttagcacttatggcaggaagactgagtttggatagcattcaaggcagaggaaatgacatgaacaaagatagcaaggcagggaaggacaggacatatgtaaggtagagagtaattaggttcagctaggagtagggcacctcctgggcacagtgaaagaatagactaaaagagaaggttaaggacatgctatgaagggccttgaatgtgagattgaagaaaataacagtaccactgaagattttttgaaaagttttactagcaaaacagcacttttgggaattttttcaaatgcttgtgggatggactgaagtatggagaaattaggggatcattttggaagctattgcaagatactatgtgaatcagatctgtggtagctgcagccagaatgaaggctggaaaatagataggaaatactgtgggcaggaccaccactgacctgcttagtgcattttgtgaattatgaaaaggtcaccccagctgggcacggtggctgacgcctgtaatcctagtactttgggaggccaaggtgggcagattgcttgagcccaggaattcaagttcagctcagacaacacggtaaaaccctgtctctacaaaatatacaaaaaattagccaatatggtggtatgtgcctgtggtcccagctactcgggaggctgatttaggagactcaccagagtccaggaggtcaaggatacagtgagctgtgatcgtgtcactgtactccatcctgggtgataaaagtgagacctaactaaaaaaaaaaaagtaccacttctttaagacattttacttccatctgttagaaaattgttgtaatatgtttattagaataagacacttgactgccatctgctggaaaattattaaagatatgtctttggtttcaatgctcctctccttttcacatccttgtgcagtacacaaattttgtgggtgcgagtaataggacttggtaacggatcacatttcttattaaaaggaaaaggaagaaatctcaagtttggatggtagggaggttagtagtgacattaatagaactagaacttattattggggaatagatttataaggcagaatcattctttacatggaaagacactcatcttattatttattgatcccaattgtttgcatttacttagtaagaattttgataccttttcttctagaatctcagctctccccccttgtgacatctgagaatgttgaccagttcctcttttgtattccatacacccctctcttctgtatcttttctttctattctgaacgttgcttcttatccgtctcctttgcaggcccttttccctcagtttccattcttgtgcttttttatacagtgggcgctcaataaatgtttgtttaattgaattgcattgcttttgaaagatcagttgcaggtttttcaggagactgattcataggcagttagggactaagggcgtgccagaattcagaaagtagaaacctatcctaaatacagttccttgtttcgggatgtattttttacacagtaggtcactcttccttggggaatatctgtactgttgatccgttcatcattgttcagcagtggcaacaccaggagaacaaattatttacattggctgtgtcatatgggtgtgtctaattcggagaactttcaaacaaaataatgaagcttccccagcttctaacttgggaagtatgaaaagttacttaaaaaaaaatcttgactcttgtttaagtacatcagtgactgattaagtcacaacacattttaatattttcattcgaggtttcttgctaacattcttaccaccactaccactaaccccaccccatgtgtgtaagttacttttcctttcatttttcgtgggtcttgtgtgttaaggcaaagtcaagaactttgctcttctgataacttaacattgattgtgtgactgctttgtgcaaattgctatgggatgcctcatggaaattacaaaggtttcgtttgcttctgcccttcaagagagacttgcttagtgggagaagtagatgcatatgcaactgctccagggcaggcgatgacaaggatcataatatagtgcagacagagacaggattccctgtcttagagtgatataaacatcactcgaagactgagtcacatatatggacttgccatatttctttcctaaattgcacacttaactcttcactttcctgggctggattagaatttgttttcgtcgaaggcttcatgagttgaaagcacattacatatatgtaagatttaatggatttaatttaaaatgcattgaataacattaattttagcaggtttgattgttttaaatgcttttaagccggcactcttaaacgaaaatagagaatatcagagtgatattaaataaacaatgatataaaacaggagttttatgtttatggaaacctagtatttaggaaataaatatcctgaaattctctagccaaattatatttttaaatgttttgagcataggatacaagttataaacagcctagtagggaaaaatgtatattactgtcataaacataggtagtatttaaaatattaaatatggataattgatatttaattgaagtgctttttatttaattaaagccaatgacattttaaaattatttctttattaatttttcttcaattaaattttagcctgtattttagatacaaggggtgcatgcgcaagtttgttatatgggactattgcataatgctaaggtttggggtatggatcccatcacctgggtagtgaccctagtactcaataagtggttcttcagcccacattctcctccctcctccacccccagtagaccacagtgtctgtcattcctgtgtttatgtccatgtgtgctcaatgtttagctctcatttataaatgagaacatgcaaagccaatgacatttttccagtcattggagtaacaaagacgtttgaattttaaaaatttaaatatatttaagattgaaatttaggccgggcgtggtggcttacgcctgtaatcccagcactttgggaggctgaggctggcagatcacctgaggtcaggagtttgagaccagcctgaccaacatggagaaaccccatctctactaaaactgcaaaattagttacaaaaatagtagagtgatttatgtaataagtaaacagttcaggtttacttgacttaatagcataatgatttacagcttttacttaaattcattctgagatgaaataatacagcctctaggaagatacattatctggttttcctttgcattttcattaaaaatctaaaattggaaatgaagtatgtcaactagttttagaaatgatagtaaattgggaagcatctcaaatagcagtagaaaagaagataccaaaaaggtttagaaatatcacaggaaatagtgagattcagcctaagaaaatgcaagctaatacatgtaagagcaaataatctgaaatagatatttaatgagagacaatgcttagtagtagtgaaagggagtcaggtgctatcagacagcaaagcagatatgaggttgcggtgtgatacggcagtcacagagctgttgccatctggggggtcatcttgcaagctcattacaataaagcagggaagcagaaatctcttacaaatgtcagtgttaagaccacatttgtcttatatcaacttaagaatgtccagacccatagctatcaatatattgagtgctgaaagaatagaagctgcagttcttagaataggggagaatttaatgtaataaaaataattttaaaaaataaaatatctttgcttcggttaagtagtaaggcaatatgaagttatacagtggatataagcaacttgttggaagacaaatttgtttagatgaagctgagactgtggaaggtgagagtagtgtgaacttgttcataggcagttctcaatacctaggccaattatgcagatagtgaaataacatcttaaggcagtgatgggagctggatcacttgaggtaagtttggactgtatgaggaactccattaggtaacagtgccggaattgattggaagcagtgtgttttaacaatgaggtcatatttttaatgttgtctatactggtccaattactctgccccttgtttacaatatgtgattcagtgcatatactcaagaaccattcttatgtcttggcaaggtaccctgccctttctctaagcaccctttttgatcttggcttctagaatttctttgactgctttacttctgatctccaaaactggcctgctgtttcttttgaagcacttccttccctgtatgtacctgctgtatcttagctctgatcatgtttgtacttcagctgtcactgcctactactggtgacacctctgctctgctctattcttaatatcattctttttttttttttaaaggacatagaaaatcaggtattgtcttgttgtctttaagtgttgacacacttaaattcttgaagtcctgtttttagtcttcccttcccaaatctgacaaatatatagctttctacttatgtcagtgaggacaacatctcactgatcaaaaatctcaagttccttcactcatatcttgcctctcatcagtttactctatgtatctgtctcttctgtgtctgtcctttttcttccagtagccaaatttttaacctcgccttgagatctttctttcaaaatactcctttggcttcgagtgcagtactccagtgcttaaaaacaataatatttaatcaatcataccatagcttcagaaaccattgatgacttgtaaaaagttctaattctgattaaattttgatttttggctactcttatttaaaattttatgaaaagtaaatttatcatattaaacaaatttaataattttggtagcttaatattacaattctaaaatttgctttttaaaattgaaactgtttaggtcattgactttgtatacttttactgacccattagtcatttcttgagttttgtctctgtgtcagggattgaggtaggcctgccctgagggttatgaatgaggtgtggtctttggccttaagaagctcacattcttgttatgagcaatacttttgttgactgagaaatcattaatatgttcagtcaatatttattgagcttcaaactctctgttaggcactggggatacagtatgctaagcaagaggggaaactgggattcctacaggcttgtttagtaagcatatatctatctggttttataaatagaatgttctactcaaaattttggaaataattttttccctctatttagtatctgagttttttttgaatacttattaatttcttagtcaacaaagtagtccttgtatatataacaaatggtagaacagttctcctcagttacatatcgttgtaatagtggaataagaattgtaatcagaattagccttctggtcatttgtttgggatggatcttctgttagaatccagatatggcagatagaaccgaaatgtagcagtttccttcttttaatgttaacagtgattgtgctaacacataagattataatagagcagccttgtcaatagcagcaaaatttacttgtctgtttttctcccagagtacatgtgtagttaatcaatttttaaaaatatattttactacaagttattgcttattccaggcatgcccaatgacatgctatttattacttctttttgcagatccacagtttatattaggaaataaaacttctactgtttaaaattgaagttcatctgattaataaactgatattgcctcaggtttcaaactccgtagtgaataaaataggtcctcgtgtagtttagaaatagtataccagctgcaagtccagaaaatacttgctgttactcacataataaaagaactcccaaagccttataatttatatattcataactgcttcttgttgaatttcttcttctcaatcatacaggtgctgctttggtttaaaacttacagccctctttaggcaatctacagtttctccaaagtgtttaatttttttccttcttatattgtgagctggttaatgttgaagatagcacttcatttaaagttcaaacctgtgattgttttaaaaacttacctagtattcattttttcatttaaatatatatgtaatttcctacaaatgtgtacttgtttatctaagatttggacaattcattttaaaccatattattcatttattttgaaatattaagatcctgccatgttccaggcacagatccagatactgactgcacattggtgaactcagcaaaaatccttgcctttatggaaacttactgtctggtggaatttatattttggtggattctataggcattcttgcctattctgctttcataaatcctctagacaggtataatataagcaacagtttcaagttctgtcttttaaggtcctttcacccaaaaaaaagatggcatgagtgtattgcttcagagatgatcattactgtttattgtgaatagtgagcatttcaagaaattaagctcttttttttttttttgagacggactctcactctgtcacccaggctggagtgcagtggcacaatctcgcctcactgcaagctccgcctcccgggttcacgccattctcctgcctcagcctcctgagtagctgggactaacaggcacctgccaccacacccggctaattttttgtatttttagtagagacggggtttcaccatgttagccaggatggtctcgatctcctgacctcatgatccgcctgcctcggtctcccaaagtgctgagattacaggcgtgagccaccgcgcccagccagaaattaagctcttaaacaaaagtaggattaaacaatgtgcgttgctaagcatgtttattttaggtttcaattccagagtaatagtagctggaaagcagcatttttacacaatttaataaaaggataaatattttttcacgagatcatcagtagtttaatatggattttgtagtaaagtgccagctctggatcataatagcaacaataaccgttaccactcacaacagtaacagttaggggccaggtactggtttgaagagccttgtttatatttatgagtttaagcctcaaaataattctttgaggtagataccattattataactctgtattacatataaagaagctgagcctaagcaacttgcccgaggttacaaagctagtgagaggcaaggctgagatgagatcccaagcaagctggctcttcacctctgtgttctactgccttatatccttaaatactgtatatgctttcttgcttcttcattctaggaattagctgtctttcagatatgtaaatattaatttgtgtagcacatgtcatactctgaatgtgaacatgaacatactggtttttctattatgacttttttttcttattcatgactttcctatcttagaaaggcttctttttaaaatttctagcccataggaacctggaaatttatttgtttgggttcttgtgtttgcttactttttaattaattaatattatgatttgtttttatatgcccaataccctggcagatttatcaaatttaaaatgaaaatttagtcaaactcattgcctaaaaattttatttttctgtacctctggaaaaaaatggaaacagaaaagcagccttcattcttcccataaaaagagaacaagcataattttgccaaatgtgtgttttgagagggatttcctcatttcttaactgcagtctaacagaaggttatttgggcttacttgtcccacttcagacttcttactggagcaagtatttctgccgttctgaactccacacactgttctcttacatgtctaggctgtttgcttcctcggaccatgttcctggatcactttcttcttctgcctatgcatttctgctcatcctccgagattaaactgccatcagcttctctgaggaggcctgaaaactcctcctgctctggaggaattgctgccttcaatgtcgtgcttcattttattcgctcatgtgtttatcaattaaactccttgaagacaagtgttattttttttcctcctacttgtttcactgctgaatcctcagcactgaaagtagtgcctggtatatattagatatttcgtatttgttgaataaataaataaatgaatgcatagtatattatcgcactttactatattatatgtaataattttgtactttctcttcttccccagacagtaagcgtcttatgttattcatctttgtatgttttccagtgtctataacatattaattaagtcagtagctgtttgctgaattaatgagtgagcaactaattaatacctatagctctctgtggtattagatggagatgattaaaaggagggggctagaatgagtggtgactaaaaggaccagtgcattgtgaatttctgaagtctgaatcaagaaaggaggagcagaaacaccaagaccagatgtcccttttcattcatctgtccagaaatttagcttttgtttggctgcaatttgcacatttgggcataccagtcaagctgagctccagatactcatttgtcttttagggtaacatggttagggaaatagttgtagagataggagctctcagtgaaaactcaataaatctgcttctgtcaattagggagactaagtagctttaacttccataaaaatctcaaaaataattgccctttaatgttcttttttttaagttttggagaactttagaggattatgttttgaatttagattagggaaacaaggacctgaggaatgatatacaagtttattaaacatgatggggtggaggggatgcttgatgatacccattatccccttttcttcatgcgccttagagagcctcccccactgacaggatgggcgtttgctgcatatcatatgattccttccccagtgaaatgctcgtcgagtgcttgctgtgtacccagcttattggtttggtgggctgcctacccaggccaatcaaatttattgtggaatgtttctttttggagtgaaggaagacagagggaaggagaggggagtagggggaagtgcatttatgtagaggaagcagcatgtcctacgacggagtcctgatagtgtggcatgttctggaaatggtacagtatgttcattatggttggaacacacattctaggagaggaagagggactaaattgcactggccctggggaaattgagctaaatggataaaagtaggcattgagagctgttggtgatttatagcccatcagcaccatgatcacactcttcccgcttctcctgctcaccacctttgcaaccaactttcctctcactgtgctgattgtctctggtacagatttatgatttccagcctcagctcagtgctcaggatgacttttctttcccttttttattctttcagacttatttctaatcagctgctttcttcattattagtagtgactgttccaaactggaaccgctgttctcaggcagtcagccctacttatcccctcattttaaagtaataatttacctcccttctcatatttctaaggaaatagataatatctggcacatactccctcggcttgcctcccctccgtattcaaacttaccttcatcacattcatccttaccgtctttctttctcccccagaggcaagtgcatctatgaagccatcccctcctccagggctctggagcctgcctagcctgcctaatgctctgggaccttgctctgtttatcattgactctcattcctttcttaccacagtccctttccttccatcttataaacatttcccaatccccgttggcataaaaacaccactgttctcaagatactgcttgcttccccttgtttaagcaagagaggtagatggtctgagtatgtaggaacattggctgtgatgttgaggggtgagtcagggaaggcagaaattagagagaaaagaccagttaggagggtgtcgaattaaggtgatggtgatggagaggagacaagtttgaaaggcatctaggaggtaggattaattacaatttgacattcagtgattatgagagttgaaagaatgatgattcttgtgaattgagaaagtacagaatgaggaggtgcacatgtaccctaaaacttaaagtataataaaaaaaatgaggagcaggttttatggagacgatcatgagttcacgatcgtctggaagtgttgaggtgaactgctcttggacatctagttggagaaatcaggtaagcagttgaaagtatggggcatatgatgtataacttaagaaaaatattcgttatttagaaatggctttggtaattaaagatgtcttggtgtatcttgagttagtcttggataagatcccctagagatggagtgagaagagagcaaccctagagagtaacacaggaggtggaggaagaggaccctgtaaaggagcctgagaacaaatggcagaaagaaagagggcaaatatgaggtaaatttttgttagatggaggtttttgttagtttttttttttttcttggaacgctttgaggacaaggataattgtattgacagcttctagcaaaaccagcctaagttgtatatacccaataactatgtattacattgcattattgacagggcttaattaaaataaagtctcatcacttgttgagaacttcctttgcctgaaatcacatatagctagggtttttggaaggaatgaggttgtaaatgagacagtttggaaaggtaaaatatcaatatattggagctatatggcaaagctgatggttagggggtgccatcgctgcggcagccacaggatgttattttcagtataaacctctttgctgattgaggtgattttgattgctgtcaggtgtgagagaataatcattggctgctagcagttttgccactgaagttgggggttcacagatctgaacattttcttgtactttaaatctccataatgttttatcacatttgaattccattgcaaccctccagtgatgagtcagaattaaaagctgttctaaactagattatattcttatgtttctacaaacaatcttcttaagggcagggatagaaattagagcaatcaaataattcatccaaagccactgagggcatggtttggcctcacattagctatggcccacttagggtctccatgggtgggggtgagagtggaggggctggtgcctcaggagctgtgcaaggttacccataggaggtgtgcaaagtcttaaaacttctatttataagcaattttatcctattcttaacaactatttttgtatatgtttaaaaatgtgcattagatattagtatagtgctccatgcttgtaggtatatatatctatatatatatgatttacataaatatggcagaagcatgctctaacattttgaaattgacaagtgtgtgtttgattaaaaaaaaatactttggagacctcaagattaaattgtgattactgtttgagcattgtaaattaactgggaatatttagaagtttcttaacaaacttgtgtcaatcattttagctattattagatttccagtaatagctaaacctttgtgttttagttgcaaaatgcagatgtgtttcttgaccttaattccttactatggattttaatggagagccttaaaacacaagttgaaaaccgtttgttgtactttttgtgaatatgctgaagttttctcatgaactaactaatgcctctccacatacggtatgttctttgcagtcattctttagtcacaggcagtttaagctgttaaatagtatcttgctttgaaaggtaggcggatggcatttctatcttctggtacatctggtaagttaatatatacagtctctgagtatcctgcagggacctgtttttacatgcatacagggatgtttatgtagaaatcaaaggccatgaatcagaagaacacaactcttgtttccagtgtactggaggcttgaaaaaattggctttgaaaaattgaaagtagtgtggtttgtttttattgtggaaccgatcaggaagaacaatttacagtcattgccattcttcacagatgaatggagtagaggtgcctgcctcgtgaaatggagcagctgcgcccgttttctctgggctcacaaaaacatttgctttttaatcgagaactttagatggtagggtacagtttgttttcatgatggaagtggtcagttgtgccttaccagacagctgtagtgtaattaagaaaaactgtgtgaaagtggattagatataacacaagaagccttttttatttttttttaaagaggggtttccccttaaatttattcatttttttctttaatggttcaaaggagaaatactgctatcattctggtccacaagatttttgctacttcaggatatcatttagctctaggaaacatgagatgctctgctatagaataattgcttgtttttgtaacaagtgcaaactaaaaactacaggttttaaagatgatttagtttgtgagagatttgccttcaaaacaaagcttaaaataaagaattgcacagttatatttacattaactttaatgcattttaaaaagtgacctacttttataataaagttgtgaggctgctttttagacctgctttgtacacaagttgcaacattaggggatctttaaaaactgttagggtattagctttttaagaccagaaaccatgagaggagaaaattatacttttcttgataaattttaaaatgagttagtcaaataataatgaaataagctgttgaagtgttgatgtagctaaatgtgcaacattaggctgtcaatttactttgaagagcatacacttactttatgcagcagactttgaaataagaatagaaatgccttaatttgcatcacagtctacagtagcaaaatgactttcaaggtcagagggagcttaatttctaaaaaaaaacacaataacaaaaccaaacaggaacctattgtgttcacaaataaccaagatttatttgtactagacacttaacctttataactttttatacagattgcccaacacactagaaaccaaacttttcatcctaagcaaagtaaaggtgccagtttcaggtttgctttaaaacatttttatatgttgattttctggaggagactcttaggctttatttcagttaggggaatttggaaggctggttgaagggaggaggtgagtgaggagttacagcccaaatgctcttaccatttccagccttgcagccctgccctgggaggtattataaggaggacgagtctatattagattggttggtttagagaagaaccctggctgctgtttctctctggctcactgatggcggctctctactgatttcttttgtctctcctcaccacagaccctaagaaaacactgagaatcaggccatccattctaaatggcaaaccatggctgcagcttgatagctggtgctttttctgtttgcaaactgagtcctcaggtgcaccaaaatcttcttcccctttctctgagcagcttctcaggcttagatgctactctgacttctcgacagacttctgcttctgtagaacatgagcaatgttgtttaggaaagaatggagcagagtgtggggtggattagaaaggtagagtaacaattaagaaactgaggcagtttttaaggtcagaacaataatgaagagcattgaaggtagatagcagcaggatgcagcaatagaattatgggacatgctaattactagaatcagaatcaaaaaatctggattaaagttccagctagcctagcgttgtgggaaagccattccctcactttctgtttcttcatgtatagagtggaacctgttctacataccaaacaagttgtaagtctcaaaaaagaaagagagagagcttgagaatgtgaaagtgttgtgaggtagtatagttatggaactgtttgacccatttatgtcctttttttgggaactcttgacaaccaaggaaagagaatacaagaaatattaaattttactaacatagattctttgtgagtgctcttaaagctgtttgataatcccactacttatctctgtttgattcccaacccactgctttctcataacaccaatttcaactcttgtcatccttctcaagccccaggcccagttccttctattttagtctcagtagataagttcttccccaattttgccaggaaggttgagcaaagcccttgagtttccctggccaccatctcaaaatgtatttcttcacttaatttccatctcactttctgtctcttcctcgcaaaggtaacctgtatccttatcacattctcatcccatttcttctctaacctttcttcatcaattatttcatgtctttctcttgttcttttaatctcctctaccggtccttcctcatagccaagaaaccctctttaagttcactgtcatatgtgtttcttccattttcactgccaaaattttccaaagactgatttgagctcattctttcttcaccattcatgctttcttttggtccatttcagtatggcttctgtctgttcaaataagcacatgaaaagatgctcagcatcggtagttattagggaaatgtaaattaatactgcaatgagatactacttgatatggtttggctgtgtctctacccaaatctcatcttgaactgtaatccccataatcatatgtgtcctgggagggacccagtgggaggtaattgaatcatgggggcagtttccaccatgctgttctcatgatagtgagtgagttctcatgagatttgatggttttataagtgtctggcattttccctgctgtctctcattctctttcctgccaccctttgaagaggtgccttccgccatgattgtaagtttcaagccctccccagccatgcagaactgtgagtcaattaaacctctataaattacccagtctcaggtatttcttcatagcagcatgagaatggactaatacactactacacccactagaaaggctaaaattacaaagactgaccataccaaatgttgatgaggatatggagaaattggaattgcacatattgctggtgggaatataaaatgttacagtcattttggaagtttggctgtttgtaaaggaggtaaacatatacctactatatgatgcagctattctacttctaggtatttactcaggagaaatgaaaaaatatactatgtgattccatttaaataaaaatctagaaaatgtgaacctatagtaatggatagcaaagtggttgcctgggaatgagtgtataatgttggaaaaatggattacaaagtaatacaaggaaacttttcaggggtgatggatcgttatgtaggttgtgatgatgccttcacaaatatatataaactcatcaaatttgatacttgaaaatgtgtaatttgttatacactataccaaaacaaaactattttaaaaaatcatagaactgcacactgaaaagggtgagttttatagtatgtaaattatccctcaataaacctgacttaaaaaacaaaacaaaacaagacatatggaaccaggcacagtggtatgcacttgtagttccagctacttgagaggctaaggcagaatgatcagttgagcccaggaattcgaaagcagcttgggcaacatggcaagaccccatctctagaaaagaaataaaaatatgaaaatgcaatcaatatggggaatgagagtgcaaaaagtaattgttaaacgctaatctcaaaatattgcatactttgtaaatccatttatatagtattctcaagtgacagggttatacagatagagagcagattagtggtagccaggtttagggatagtaaaccatggggaaaactaggtgacgggcacacaggaattttcagtgttgtttttgcaattatatgactaaagaatctgtatcacaaaaagtttcttttgaaaaggccttttagatattgtattctctaatgtgaaacaaagacagcatgccaaaaaataatcaatctttataattaaatctataataacggttactctgcaaacacttgaaactaaatttcatagagatgattacaatttaacattgtattgttgtagacagaaggcacaggaagaatcattttccaatttctgatcaccctatctaaatgttcaaaatcttaaattcgttttgactagataatacatataaatggctaaaaaatatatgaaaagtaatacactgaaaagccttcctccaacatctgtcatcgatccacacagttcttcctcctccaaaagtaaactactactgttcatcttttatgtattctttcagagtttatgtctacacgagcaaatgcaggtgtatctttttaccctcctccatgcttgtatgcaaaaggtagcttactataccaactcgttttgcgccatacttttttcacataacaatgtatcttaagacattttcaaggtggtatgcagctttttaattttttcttttgacagttagtattgtattatatgactgtaccatactttatttactgatctcctgtctagccatttagatcatttccagacttccgcttgtaaaaacaatactacaggctgggcgtggcggctcatccctgtaatcccagtactttgggtggctgaggcgggcaaatcacaaggccaggagttcaagaccagcctggccaacatggtgaaaccctatctctactaaaaatacaaaaaattagctgggcgtggtggtgggtgcctgtaatcccagctactcgggaggatgaggcaggagaatcgcctgaacccgggaggtggtggttgcagtgagctgagattgaaccaccgcactccagcctgggagacagtgtgagactccatctcaaaaaaaaaaaaaaaaaagaaaaactacagttaatattcttatatttatgtcatttcatacatgagcaaatatatatatatatatatatatatatatgtaattgccagtatttggctttttaacctagaaaaaaatttatgttgttcagtctaatatctgtagagtaaatgttcacatatgtaattctttgagacaaaatatttagcatccttttgattttctgatctacttccagatactcgtgatagtctggatgtttaaaatttgtaaaagggagtggggaacctttatttaaaagctccttttcaatatagttaagggggaaatacccatgtacacagggctatttctggaaatcctttaccagtaacttcattcagtaacatatctaactctaaccctgatctagctgtgttaggcttccttgcctgctagtgaaagcctttgctctccccttattaaaaggcctgaacataaaactctgagactgtttatccttcccaagtggggcattgcagaaaaatatcttcttattcgctatcagtgttactctctattgatcatcacaattattgcaactttaatattatgacattgtatgtcttatgcaatattaggttctctgaaaaaggctttttgtacatatgacaaataggtggagtatgctcttctacacagtgagccaaccagccgtcatcttggcttctccaaaactggttttgtgtgtgtgtgtgtgtgtgtgtgtgtgtgtgtgtgtgtgtgtgtgtgtgagagagagagagagagagagacagagagagagcgtaaatatggcaaagtttaacaactgatgaatataggtaaaggtgaacagtctagagtgttcatggtactgttctttcaaattttctgtagatttaaagtttttcttttttttctttctttcttttcttttttttttaaaggcaggtcttgtcacccatgctggagtgcaggggtgcgatcacagctcaatgcagtttcaaccttctgtgatcatccaatcttagcctcctgagcagctagggctacaggcgtgtgccaccacaattggctgattttttatatttttgtagagatgaggtctcgctctgttgcccaaagtagtttcaaattcatggcctcaagtgatcctcctaccttggcctcccaaagtgctgggattttaggtgtgagccaccacactcagcctaatgtttttcaaaagaaaaagttgagagcatattctttgttgagattatttattgtgaattaggggctgctgcttcgttacctattgtgttcttttttgttttgttttggtgtttctaggtttgaagacatcttagaaattccacttctaaataaaaataagaataaatgctaatagcaatttatacttattaagggtttcctctgtgccacacgttaggctaagcattttatatggatgatctcatgtaaacctcttatcagtctattattatcttcatcatttttcagatagggaaactcaggcacagtgaggttaaataatttgcctaaggtcacacagctatcatatggtagaaatgctacttgccaccatttctatctctatatttctgtacttcacctaggtttcatttgccctggtctttattttcctctgaagtattttgaagtgagagataggttatcctctggctcaaatttttaaagaattaacctaatccagataataggatgatgtgaaggcctcatgaaaacataaaaattgatataaacaggaagaaaaatcttttttttaaaaagagatagtctagctctgtcacccaggctagagtgcagtactacaatcatagctgacttcctgggctcaagcagtcctcccttttcagcctccccaagtagctgggactacaggtgttcatcaccacatccagctaattaacaacaaaaaaagtttctacagatggagtctcactatgttccccagtctggtctcgaaatcttggccttaagtgatcctcccactttgttttcccaaagtactaagaccatccttccactttaaagtactgaaattacaggcatgagccaccatgcccagccccgtttttttcctcttcattttcttttcctttatttcctttattttactttatttatttatttttgagacagggtctcactctgccatccaggctgaagtgcagtggcacaatctcagctcactgcaacctccacctcctgtgctcaagggatcttcccacctcagcctctagaatagctgggactacaggtgcacaccaccacacctggctaatttttgtatttttgtagagacgggattttaccatgttgcccaggctggtctcaaactcttgaactcaagcgatccgccagcctctgcctcccagagtgtcaggataacagacataagccactgtgcccggcccaagtttcttaatatattaatttgccaagctctacaaacaagaactgctttgtgtacatacagtagtcaaaacttgctggtcccttttctgagtttgcttatttgtttatacactgactggcctgccaaggggcattattgttctttttctgtatatttcctgtacatttccctctctgttgactctttgctttcagaacttaaacaggttccagtgttcctgtcttaacaaccattgccatttactacacacatcctctaaccacccccatctctcttcttcaaactaagctctcctcataaacaattcctatgagagaccataggggtatttccccatttcctgctggctcctctgtccctcccaactacccccacagactgtgctcccagtgacctcctttccttctagcaattttcctatgctattcttttatttacaaaactggaactgtattttatgcacagatattttatagcttgatttttttcctactttaatattagggactttctttttccaagtcattaatttttaaaaactttctattgatgaatagcatacatgcagaaacatgcacaaacgataagtttgataacctttcacaaaatgtcgttagcgtccaaatcaaggaaaagaaattgcagaatcctagaatctcctcccaacccactcctttcagtcacttcatccaacttccaaagcaatcctgacttctaacagcacagattgttttacatatatgaaatgtatgtaaatagaatcatatagtgtgtaccttttctgtgtctcacttctttcactaaagattatgatgtttgtgagattcatccatattgttccatgcacttgtagtttgttattctcactgttatatgatattatattgtgtgtttatgcattaatatgttttaaaacataatgttaattcctatgtaatattccattgtagggataattaattaacttattaattacccatcatttttgccaggttttcactattagaaataacactataataaacatctttctgtaaatacttgaagaaatttctgatcattccttagaataaatcctggaagtggatttaccagctaaaagcttatacattcttcaaaagttcttgatacatattgccaaattgccttctagaaagcttatacctgtttactttcctgctggcacagtacctgacacataaacattcaataacattttgtttacatgaactggatgaactaaattcttttatatcttagaatcctagaagctgagttttctgtgtctttgatctgccttctttccagttcatttttgttttaatgaatttatactaaaaacaatttaatagtacatagggcgcagcttcccctcccgaccttattctttttcaaaaataatctggttattcttgctcctctttcttttttttttagtggaaatttaaaatatactgctgcattctggaaaaatcactggagatcttatgaaattgcattgctggcattttctttacattaatgtggaaaaaaatgtcatatttatatgtttataatcctatccagaaatgattctccatttatttaattattttttatgaaatgcatttcagtaaagttttataggtttattgttgcagtaaagtttgatagctttattcttaaaatttaaaaattttatttgtgaatattttatattttgtgactactgggaatgagatattttgtttccattataatttcgttatgtgaaagctattgtatcttctatattaattttgtattcatcctttttagcaagctcttattaatgttaacagtttttcccttataatacttttgggtctgtgaacatttaatttataatttcagagagggagaaattaatatgtagaataaagaaatagaaaaatggtaaccttgaaaaaattaaaaaatagaaatgtagaattctgatctgttcttttaatgcattgaggtactcatttttatcagttctcaactattttctctagctttgtattttgaatgaagcagcaagtcacaaagttaaacataaaactaatgaagttgtagaatgtaaaaataatctatcattacgttaggaaaagtagttacgaaaaccacattatttacccattatactactctatactttttccattctcttatttttaaaaacttctctttttattatctgttctctattttgcttctctgttttgtttttttaagaatacaatagcttgggaataatttttttaaatactaatggaaaataaactttaggataaataagggaaaaaataaaaatctttcagttttcctctcggatttttttctcacgtattctcatatacttttctgttcttttggatcactttagtgattctcttccttcttacagcatgtattcatctgaatgccttcatacatgcgtgcatgtaagataccagtatttgtgtcaggggttgtcttatctcatctttttcctcagagataagaaaatgtgtctaagtcgtgtgtctacatgctattgcatagataataaaataattttttatcagtttactttcaatttttaaaattttttttattttcttttttattcattttaaattgtagggttatttttttgtttaatcctaaagatagttttaagtacctgtaaacttgaaccacaaatgtaatcagaaaataatactttaatcctagttaatccacgttattgaccgtctgtgcctacaagccgaaacaatagcagaatgtcttgtgtataacctctctcttttttttttttttttttttgagacggagtctctttctgtcacccaggttggagtgcagtggcgtgatcttgactcactgcaacctctgagttcgagcgattctcctgcctcagcctcccaaatagctgggactacagatgcacgccaccacacccagctaatattttttgtattttttatacagacagggttttgccatgttggccaggctggtcttgaacgcctgacttcaggtaatctgcctccctcagcctcccaaagcactgggattacaggcatgaggcatcgtgcccaacctagtgtataatctgttatgtggacctacatactcactggcaaagtctgatctagagattaactgtcttcttttgagatggtggttttgctgatttttaggaagagactatctagggtctcatttaatccttgtaagagacaggctggttgcacccatcttgtctaagtttgtaaaatgaaactaggtcagatcaattacagatagttgtaacttcctcagaatagtctgtaagccagggctgttggttattaaaatacattttttctcttatcaaaatcaaaggaattaattatttctcatgactgtagaattggaatatgacaacttgagaatcctatcttttgtagaatagaatagaagttgtttttttttttttttctaaaagagaaattcagatgctgcacggtttgtgtctttgggtgtttgctgagctacgaggctgggaagtgagaatcagaatggacaatcaggacactgtattcagatttcacttataaaatgggtttggaaatgaggatgaagggcactagccaaaataatctcaaaggctgcttccaggtcttaactaccaagatttgtagcttaaaaacgaactattgggaattatagaggtaaactgatgtgctttcattagagaggcgtaaaactggttctaagtccttaaaagaaagtagaaacaaagcaccaaagccagaaacaattacaccagcagaatacttaaaaactaacaacaaaaaactgttttcataggcaccctgttatacgcggtaatgcagtttgttttgtacaatgttataaaatgatcagtatactgtacttctggttaagcaaaataagaccaaagactgacacggtatgctgtctactctaattcagtacattcaccaaaaggagatgaaattaaagatgaagaagaaattaaagaattaaggaagaaattaaagatgataaatggatccagtttgcctatggcaaactgatagtatgccattctgaaggtggatattgcttatgaagaaaattttgagtgaattgtttccttttataattgtattagaagaagtgtggatcttgactgtagacagactttagtttaaatatggctctgctatttaggagttttgtgacactgggaactttttaaactctcttttgttatttgcttcacttattaaatcagcaaaatcattcctacttaataaagttattggaaagagcttattataaggagtttgtcccctttcatgaaattttcaaggaaattgtgatttccatgacttaaaattttctacttaaaatctctgttttttttttttttttgagacagagtcttgctctgtcacccaggctggagtgcagtggtgctaccttggctcactgcaagctccgcctcccgggttcacgcccttctcctgcctcagcctcccgagtagctggggctacaggcacctgccaccatgcccggctaattttttgtattttttttttttttaagtagagatgaggtttcactgtgttagccaggatggtctcgatcttctgacctcgtgatccgccctcctcggcgtcccagagtgctgggattacaggcgtgagccaccgtgcccggcctacttaaaatcttttgaggaaaagtgctatatcagaaaataaacaagaccaacccagttacatattaccatatcatctgaatatgttttacattagcttctgcccttccttctttttttttttttttttttttttgagacggagtcttgctgtgtcgcccaggctggagtgcagtggcgcgatctcggctcgctgcaggctccgccccctggggttcacgccattctcctgcctcagcctcccgagtagctgggactacaggcgcccgccacctcgcccggctaattttttgtatttttagtagagacggggtttcaccgtgtccttccttcttagaaaggttccctaattgtctgaactgtgttggagatttcgtggcatgtgtagtatttgtggagaacttttcctgtatggtcatttccaagtgtctaaagaatctggtatcagtccttcagattttagcgggttaagagaaaaagacaccaataaatcaagtaggcatagaattttgtataagaagtgaatctgggtatggtaaaaagttgtgatagaatgaaaactttctgaacagtggtttgggagaaatgcagtaagacttttaagaagtcaatcattcatttactcattgaatatttcttcaatattgattgtgtgttcagtggaaagaggtgacatggaatggggaagaatgttcaagacacacagagtagcacacctgaacggaagcagatttgaggatctgaaagttgttttatgattggagtgtagagttggaaccgaagggatgaaaagggatgagagagttagtcaggggaccgatcatcctggacttacaagccatgaaaaggaatttgacctttatcctaagcacaataggggccataaaataattgtgggatggggcaaaggccaggtctgtgttaagaaagagtaggagaatggattgaaggaaggagaacaagtagaggaagggagattgattgcgtggccgcttgtggaaatcacagaaatcatggtagcctaaacttgagtagagtcagtggctttagaaagctgaacgtggaggccagcatacaaaagagccagctagctgactgacatgatgtggggagtgagggaggaagaggaagcagggcaattggtgatgctttttcttccttgacacaaagagtacctaggaggagaaggtgaaaggggtaaaggattagttccattttagttggtgggttaaaggaacttgtgagatgtatctatcaatatatttatctgtgtacctatctgtatatcatattcatgtattctaatcatcctaactactcctctcatttattttttattttgaaataatttcaaacttaaaaggtcacaaaaacagtacaaagtgctttttgtttttttggaatcttttgagagtaaattgacaatatgatgtctcattactttccaatacctgagtgtgcatttcataaaagcaagggcatctcctacatttacgttttgtcccagtgatgtcctttacagcaaaaggatccagtctagaatcacatgttgcatttactcgggatgtctctttaatttccctccatcttgaatggttcctcagtgtttccatgaccttcaatatctagacatttttgaaaatcacaagctaattattttgtaaaatatccctcaatttgagtttgtctgacatgttttgcaattagatgcaggttatgattcaggaatttttgctaggaatatcacaataattatgtgttcttttcattgcagtctatcaggtggtgcacagctcctgttcgttacattactgaaaatgtcaaccatcatcatttactaattttgctatgagatggggaggtagatgcgtagtgtacagatcagctgatggtttacagaagagtaaacattcagaattccctcccaccccccgtaagccttgttcagagaaatattttttacataataactgtagtctttactgttattataatttggattattgcccactgaatttattatcagtttagtgcagaagagaaatactttgctcttgccttagattgaaaggctctccctgttgccactgtgctctggtttccagatgccttgctctcactgggattgatgtgctttctcacagagtgaagagagaacctgacagccataggaggaggaaggtttgcctcactttaagtccggatgtggttaaagcatgggagtgggagaagagaagggatttgactgagacaagttgatttgagtgaagccgctactcttagacaactttgcgtaaaacagctggttagttaatatgtttctcttttattccatgctagtcctccaagccttaaaacaacttattagagattagaatttttaaaatctgttttgcaataaggcacgtgtccagttgaattctaatttcactaaacctgccccctagaaaactgctgaacttatttgaaaacactgagtcatgatgatataaatatatgatggggatttaatgaagtaggtctaatttcaagaatatctaatttatgaaaccaagcagtactgtggaatttgttggtaattagaaatacaggtttaaagtatataaaccatatatgattttcataactttaaaggagtaaatgtttttactctttaaccagtcttgatattagtgattccttctttacaaactgaaatgactccagattttttgaaacagtactgttgtttttagaggaattaaaaaatatattgcaagtttgctgccatgtgtttctagtatagtactgctttgaaaatataggtgtttaaaattaatcaaatacatattagcaacctttaaaatacagcattgaatacaatatgataaataaaattactttatcaaaactcctttggagtctcagccaacttttatatttcatgttatttacctcaaactccattgtaactatgcagaacccagtaaaatctcttttctttctcctttctcccatattgtcttgtctacagaataccagagacctatcagttttcctaatgcagcttcaaaggcactattgactccttgccctgtttcttctacccttgcaaacttctgggaagtatttccaagtatcttatagctgagctaccctgtccttattgtagaaatcccatccaaatttcacattagggttatgattgtagatctctccttaagccttttgttcagcttctgcctttcacccaggtcaaagtgctattaataagcttatttcctattaccaaagtgtatcatcttaaatttccttcacctaacctatagcttcatcagaaacttaaatttttctgagactattgccaccctctcttgatcataccatgtttgccgcaatgcaccagtcgggaaacagccgtttagtcagagcctacttggtgccagtcactttaccagatgctgagaatactgtggcaaataaacacattattgtcctcatggaactgatagtctggtgggaacaacaactattaaacaaggtagtgcgtgtaattaagtgattgcatatgtgtgaagtggtttggagaagaaggagaacgtatgacttgtaaagcagacatgcgttttattggggtagtcttgaggtagttgtgttgaagctgaagcatgaagattgagtacatattgttagctggttgaaatctgggttggggaatattttaggctaagagtggtcccttctctatcatcacattttactctgtaatcaagcaggttctcatactatttattctcatactatttagccgtgccacttgctcactgtcacccagtgcttcttctttcttaatgagctcttgcttttatacctttctatatttctgattttatagtatcatcctattttggaattcctgaggtcagagttttcaagctgttagattaggatctaccagtagcaggctctcagtgtctgatttgtccactgcttcctacctggtgactctccttttccttctctcaactcctcagattttctgtgatttctgcaggaagcaaagccagcagtcaggtaaaggggttggggagttggtgggggtggggacttagaatatttgttgatatcaaacctctccccaccaaacacttgaatttcattttcagcaacctcttcttcccattctagtgacatcaagacttaagaagattgaaaaatgtcccatcttcagaggaaatctaggtattttgctctagatcattaaaggttacacatattcgccctgaaattctccataatctgtaactgtgcttcatctgttgcctaatactttatattttaaatttcttcatttacttaaaaatttctatttttgtaactagcagtttacatttttttagagtcaagcatattgatatgcagtatcactaacattgtcagtactggtgatatacatacaagcaaacttgcagatatatatcaacaaaaacaacattattgtactagtacaaagtggtcaaagtgtgttcctctgacactggttattatttttttgctgcaaggcatagtagctgggcaggtggtcaaactatttcttgtagccaggtagtaaggctttttattgagccgtaaccaattctatggctgagagaaaaaaaacacatttccctcgcatgactttccttttccctttaaatacctatttattaaaataacaatgtgaatatggagtagagacttattataacatctgtatgaaaacaattgttagaacaaaactaaaattgaaaaagtaccaatttattgttttaaatagagaaaaacatcttatttctttaattttttaattactagtaataaaaccaatgtaatatttgccatcttaaactatttttgagtatatagtttatttgtggtaagtacattctcattgttgtacaacagatctctagaactaaaactgaaactctgtactcgttaaacaaaataccccttctcccctccccacagaccctggaaaccaccattctgttttctgtctgtatgaatgtgactactttaggtatgtcatataagtagcatcatacagtatttgtcttgtgactggcttattttacttagcaatgtcttcaagtttcatccatgttgtagcatgtatcaatttccccttaaagctaaataatattctactgtatgtttatactacatttttttaattcattcatctgtcagtgaagactagggttgcttccaccattggccatcgtgcatggtgctactgtgaacatgggtgtatgttcagatatttctttgagactctgctttcggttcctttgggaacatttacttagtgagccccaatcttcttacagagttatttattttttacgtattagaatgtgggcggaattgatgaagggaaggaggcgatagtgactgtaaaaagtaggcagataatagtctgtccattgtttaaggctctctgtctgcttcagtgtttctcaaagtgttgtccatgtaccacttgcattagaatatctgggatattttgattcttaggcctttcaccagacttttcaagtcagactctcttgtgagactcaggaatttgcaccccaggggattcttgtgtacaccggaatgtgagatgcattgccctactggtaactagacatcccaggatttatctgtgtttatgcggatgaaaactctgttccctgctactaatagcaccttgcttttggggggcacatccatcccatgccagcctatgattttcactttattctgtctgcgtattgtagcccaactaaaagtctcataaatgtagtaaaggagggcagccctgagttcataaccctaaacttggattcaggcccattcaggcccttcttctcaggctcctaatggtgattcactattgctgtgtctgcttctgatcagtgggccagtgaacaggttagaacttcctccctctggccttgtagtgtttaggcttacctgagttcttaaagggaccaaatctctttcctgatacgaacactttaagtatggcatagcaaattgtgatcctaattaaggcagtaatttctcacgttcatcttgtatagctgaatgacatgtgtgacatctttaataaaaccaaccagcttctgcattctgaaactgaactctgtcttcatctagttatcacattgtgctatctctaacatgtgttcttggcttctgattattacatgatctgtgatttgcaagtgactgtttttcattttttgtttttttgatacagaatcttgcttgctctgctgtccaggctggggtgcaatggtgcgatcttggctcactgcaacctccgcctcccgggctcaagcactcctcctgtctcagcccccaagtagctgggaccagaggcccacaccaccacacctctaatttttgtatttttagtagacatggggtttcaccatgttggccaggctggtctcgaactccccacctcaggtgatgcacccgcctcagcctcccaaagtgctgggattacaggcaagagtcactgtgcccagctggagcatattttattttctatttacatatttaggctttaagctgtacacaccaaaaatatttttttatggcagtcctgtttgttctcagcagagcctgtagagcctgttgtcagtggaatgctgagaacagccctttgtagagctttctattggcagtattttgggattcaggctgaggaatggttgacccaacttatacttccagcagtatgtaaatttactctgacatgggaaagatattaacagcagcaacaacacaaaatctttcaagatgcagatttgtacagcataatacagtattgtacaaatgtacatatacaaaattaatttggccttttcagtttctagtcttccagcctggaagtaagaattgtttttaacaaagtgttaaacggctaaattgatgttttggggttccgtcaagatcttccagaaaaattattaccccatagctacaaagtaacaagactgagaactaaggacatcagtgaagcccaagacaagttaattaagagcagaccggtaggactgaccggtggatatgacctcatttagatttgttggtgttcttactttccagattaagcatgcttaactattcagtgtggcccaatgcttttaaagtagtaagcatgtttttgagctgtatgattcgaacagcaatcacatttaaaatctaacatggtgcctaaaagttgtatagaaatatgtatgaaaattcacactaatatattttaacgtagactacctgttctggtgaactcttagtttgaaactttctttatattttagcaatcgtttgtaattctttttattagctcttagtgagtgtgtatgcagcattttctttcttactgtccttctcccacctacagtcaaatcaacagatgtttattgagcattcactttgcatgtgccaattctttcctttgccaatttcgggtgttaataattttggtatgctaatttattacatgctctgtgccattttaatttgcttttctttaattcacagtcagcttgtaccctttcctatatttgtttgctaactgcattccttcctctatggcttagctgttcctgttcttggctcattttcctttgaggttataacagttgtcaacagaatcctgaccaggctcctgggcaagccatgtcttaaccaattagtacttttgttttctctctattcctcttttcttcattatggtggaaaacagacagggattaaatggacagaattagaaaaagtaggaggggaaactaaactgaattggaagagatttaaatgtaatgtgtttaaaactgaattggttaacttaactcaagctttgataagtaatgggaagcaccatgatattatggaataatttgtcattttcaacagacttgggttttagtaccaggtctgcctctgttacatgaatgcaataaagcctacctcacaatgctgccagagcatttaataagattacatgtacgggccttcccctcccatcctctctgtcttagtttgtttggactgctataacaaaataccataaaccgcgtggcttacaaacaacagaaatttatttctcgcagttctggaagttgagaagtccaagatcaagatgctggcaggtttggagtctggtgagggcgcactttttggttcgtagaaggcatcttcttgcttcattttcacatggcagaaggggacagcccagctctcttcaaccccttctaagggcactaatcactcgtgagggctccatcctcatgacctcatgacctcccaaaggctccacctcttactaccaacacactggggattaggtttcaatatacgaattttgcagggatcggggaggacacacactttcagtccatagattctctgatgctgaacgagcgtgtcgctaattgctacacgcaaagacagaatagcagtcgaaaccaagaccttaccccggcttcccatccttctctgcaattagtgtctaatatgttttcccatttaatctttataacagccttagtatgtatcattattcccatttttcagatgaggaaattgaggcactgagaagtaacttgtacaaggtcatagatttggtagaggatttgggtagagttctgtcagatttcaaatccattctctttccacagtgccaggctgcctagaataatgagtgtgactgaagaatgaaaaggagttaatggtgtggccattcccctgttctttccactacttcacttggtgaatgactaataggcaaacactcccagagggtatttgcattttaaaagcgagctcattaaccctaatgaatctctaattggtggaatttgtgggggagatatttttaagtactggggctttctcctgtgtcttcaaggtgcctggctatctttttcttctttataggttatcaactattctggaatcagaatcgtgtagcagaatgcagtcacatactgctagtctgccccaaatgcattaacagggagtcatgaattaaaaggcagccatgaaaaaacattgaaaggaaaaaagtgtgggttagcattgtctaaaatgaatgtccaaaagcaaataaatttggccatatagagagtcttccgaagagtcagatgaaaagaatatattttataaccaaatttaactttagaaatgttatatcagcatttcccatggtgtgttaatgaagctctgcaagatgtttaataggtgtcagatgaataaaatggctccacagtcaaatacacttcgaaaaaaaatttttttttaagtttcatcactgcagaatttcttagatgctaaagtgcattaggaaatcaactggaagagaacttgcattctgaaggtttttctcatatttttgaccatagaaatatttttttccatgtgaaccccttggaaccagtgtttcatagattgcattctcagatacagagttctagataaatcatctttaattaaagaaaagaaaaagaaaaacagttttctgtattcacagccctttgcatgcagacaggctccaacccagtccacaacagcccatttccagtcttgttgggctcaagggcatgccaataataacagccctcttccccagatgagatctggccaattgaggggaggaaaaaggaacagatggagaccaaactctcatctttattgcctataaagctggtgttgaagaatgtggcttataacagggagcaaaagggcgtcctaatcggaatcccagaattaggttgagtgtgtaaaccaaaagtaagatcctaaacccccacaacagactgaacggaccccctctgggcctcaaaaactgaattccccattatgacaggagagatcttggtataccccctcccttttggagtttaggagcaactgactagcattaatgttaaaagagagattataagactgacaaaacagactctttgtagcagtaagataccaaattgcaacctgacactggtataggacctcatgacagatagcagaccctgaaggaaataaaaatattttaccctagaatatatttccttgacatacgttgaaatggccctgcaaagctgtcttttgtgggggagattacatccgtagagaatctccttccctttctagatctttcccagatctaggagagatgaaatgaaaggctgacacctttaaggtctgaagagagacgcttaggatattctctatagggctgttacctgaaggcgtcatctacttaacaagaaccttggcttccacaatgccctttttcttaactcaagcatttacttctagtctttagacaaagctgaactccttcaaccaactgccaatcagaaaatctttgaatccaactatgacttgtaagaacccctactttgagatatcccaactttttaggctgaaccaatatataccttacatgtattgacttatgtctttgcctgtaatttctttctctctaaaatatataaaaccaaactgtaacctgaccgtctcaggcacactttctcaggacctcctgagactgtttcctgggtcatggacacacacattggatccgaataaacctctccaaatattttacagagcttggcttttttgtcagctagttccactcagttacagaatatgctgagctggtcaggcttttccccaagtgggaggatgtttctgtggaggatcagagcagacagcaacatgctgcctgtgttccttgattcttaagagagagggaaggagaagttactggaaaggaatcctgatcttggggagggttcttagatctcctgcaagaaagaatttggggtgagtccacagagtgaagaaagaaactttattaagcaagtaaaggagtaaaagaatggctgccccacaggcagagcagctgcgagggctgctggttggctatttttatggttatttattgattatatgctaaacaaggatgggttattcatgagtttttaaggaaaggggcagggatttcccagagctgagggtttctcttccttttagaccttatagggtaacttctggatgttgtgtaaacagtcatgacgttggtgggagtattgtttagcaggccaatacattataattggcatataatgaacattgaggatgaccagaggccactttcatcaccattttggttttggcttccttctttactgcatcttcatttatcagcagggtgtttgtgatgtttatcttgtgacctcatatcccatcctgtgactaagaatgtctaacctcctggggatgtggcccagcaggtctaagcctcattttatccagatcctattcaagatagagtcactggttcaaaggcctctgacaaggggacagaaccacttgtggccaagtcctcccaaatgcaacaaccagtggacaggagagtggagagaggcctggagtgaatgttaatggaatttcctccatgttgaaggaagcataaggcaagtgacctcacagggttaacaggaattctgaacagaaatatatagatatacttaagcattcttctggctgtactttgacccatttctattttctttcttttttttttttttttttttttttgagatggagtttcgctcttcttgcccaggctggagtgcaatggcataatctcggctcaccacaacctccgcctcccaggttcaagtgattctcctgcttcagcctcccgagtagctgggattacaggcgtgccctaccgcacccggctaattttgcatttttattagagacggagtttctccatgttggacaggctggtttcgaactcccaacctcaggtgatccgcctgcctcggcctcccaaagtgttgggattacaggcgtgagccaccgtgcccggccgacccatttctttgtaaccaaaatttatgtaacaccagatactgaccatttgtatccccattgttcctatagataggattctggttttcgttcaagatagtgtccctgacactagaatcataagctcttggtgaagaattacttaagcagatcctggattctagtggaacaactaacaccaaccagtttaaagacccccacagaggaaccaaatcagcaagagaataccgtttcttcatctccctgccccatgacttcaccccacaattttcaaccaatcagtggtctccacactttggcccactccaaaacccttaaaaaccctacccccaaactcctctggggaaaagatttgagctttcttcatgtctcctcatttggtggccctaagattaaagttctttttctgctgcagcccagtgtctcagtgtattagtctgtttatgttgctataaaggaatacctgagaagggtaatttataaagaaaagaggtttattttgcctcagggttctgcaggctctacaggaagcatgatgctggcaactgcttctggtcagggccccaggaagcttacaatcatggcagaaggtgaagggaaaccagcatgtcacatggcaagagtggaagcaagagaaatgccagactcttaaacaaccacctctcacatggactaatagagtgagaactcattaccacagggagggtacttcatgagggatctgtccccatgacccaaacacctcccagcaggcccacctgcaacattcgaggttacatttcaacatgagttttggaggggacacacatccaaatcataccactcagtgtattgacttaccacatgcatgaacaatgaacctattatggttacattaaggagtgggaaccaagtgtctgccccatcacccacctaccaccaaccccttcagacaagcctcctctgggtgacctaagtaggtatttggttcttctcccatcactggaaatttctgtcctgtccaatttcctttatacatagtgctcactcttcagcattatttctcccctcaaccatcctcacccagtagaatgggatcatgatgatactctaatgaccattcctttctcacatccttatatagctaaaacatcatccaacatttttttttttttttgagacgaggtctcactctgttgcccaggctggagtgcagtggtgtgatcttggctgactgcaacctctgcctcccaggttcaagcaaatctcctgcctcagcctccccagtagctagggttacaggcacatgccaccacccccagctaatttttgtatttttgttagagatggtttcaccatgttggccaggctggtcttgaattccagacctcaagtgatccacctgcctgagcctcccaaagtgctgggattataggcgtgagccaccgtgcctggccatcattcaactttttatcccggaaatgatggaagacatatatttctctaatacagactggaaaactacaggctgccacttgtttttgtaaacaaaattttattggaacacagccacacacattaggttacatattttctatgactgcttgtgactacaatggtagagttgtgaagttgtgacagagaccttatgacctgcaaagactaaaatgtttactatctgaccctttacaaaaaaaatttgccaacccctcgtctaaaatatagatgagtttcacatcagtcctttaagttctgaaagagcttcattagtatgtatatgtagcctttatcatttactcactctaaataaaaactacatttgaaacaaagaaaatcgcatggctgtactataaggataatttttacatcttgtaaaattgtttccagccttaaaaacttcctgaaaaatatgaagggaactgtgtatttgctttgaaggagcagaaggaagaataaagtcttgcatcagtcagaagtatttgatgtcaccattgaaaagggaagaaaacagataatctatggggcctatagaagcaaaaaggagtaatgaaaactgtctgcaggaccagaaggcacaagatcctgccttcagagctccctatcagagcccttggctcctctcttcacaccctgttccctaactcagagtctagtttcctcccaccttggccctcatgcattggaaccgttcaccagaccacagagtccccagagatgtcaagagactgggttctgctcccattgtgactgctttctatgtgggagaccttgggcaggtcactgagtgcctctgccccttaggtttcactctcctgtaaattgggggtgggcagagttatcttactgtgcttgcccaacagtaatcaaatctgatgttttttaaaagcctatatgaaaggtaaggtattatgaaattgtcagtgtttttgtttttgttgaaatgtctgagttgcaaatgaaatttttttatctatccaagatataaattagagttaactgatatttgaaaacttaagtaccttatttcatatttctcatacccatttttgcttatttatttttatagtatttaacttttatatggattagagaaaatatagaaaataactgaatttttaccataataaaataattcttcaaggggtggaaaaaaaacttcaaaaattgtatttcattgtgacccattcttttctgtttgttgtttattcagctttcatttttatgcctttgtttacagagaaacaatcttgcagatggcaattttccttgtaatcatttattgtcctatctgagtcatcgccagacatggcatttcagtaaacagtgattctgcaattgcttccaggcagatgtgttgtgtgaagttaagaacgctggctgataacctttctggtttttcaagcagcagggagaaagttttgtgtagatacacacctcgaaatcagaaaatggcgaaggaaggactttgtgctgcatgattttaaccaaatatagtgtttgtgtgatggatggaatagtaatctttttaaaagataaataatatttcttcgagtaaaggactttttatagtgcgttatacgtattttcttagaaacatcgtgcatgtgcattgttaaacacaacgttgaccttgttgtacagacatttgtatcaccttgtccactcaggttcctgtggtctcatgcctgtagctaagcaaaccaaactcctcatgcattggtttttccagtgtaaattggaggttctcttatccctcactttcagacataggggatttcttttgcctcacaaatatgtttttacaaacacgtatgctcaaatataatttttattatgtatcataaagtcttatcttgtcactgtttttatctgagatggagtttcgctgttgttccccaggctggagtgcaatggcgcgttctcggctcactgcaacctccgcctcctgggttcaagtgattctcctgcctcagcctcctgagtagctgggattacaggcatgtgccaccatgtccagctaattttgtgtttttagtagagacggagtttcaccatgttggtctggctggtctcgatctcctgacctcaagtgatccacccaccttggcctcccaaagtggtgggattacaggtgtgagccaccatgcctggccttgtcacagttttaccatcaactacaaagagaagttcactaatttattcatctaatgtttattgaacacctattgtgtgctgggccctgcccaacaataataatgttgcacaaaacagagaacaaagtaatagggtggaatatgcattgtaaacattttgtgggttaatttatcttaaatatataagctaccaatttagttcttgtttcatgattttataatttaacaggcttataaatattttttattactttaatcactttttttttattgcaataggttttgggggaacagatggtgtttggtacatgagtaagttctttagtggtgatttctgagattttggtgcacccatcacctgagcggtgtacactatacccaaagtatagtcttttatccctcaccctctcccaccctttcccctgagtccccaaagtctaatgtatcattcttatcaacaggcttatattaaatccttcacaattttcatgagacttttccttgattatagccatgagtaaactaaacttttgtgttgcatatggagaaattaagcttagacaagattttcatactttatctccagtcaagactcatgacttttccttacattaacaaatttctaaccattagtgtcagctaagccatcatccatttctttggtaatcttccctgctgtggacattcctaagattgcccaattttatagaaaaagcaatttacaaatggctaaattagcgtctgattatgcttcaaagaagtaggctaataggtagtctctatcatgtgttaatcacaaaccattagtgataattaataaattaaaatgggccaattatgaaattctgcttatacttacccaagtgtgtttgtgtctatcctgtgtccttcaagccagcctactcaccaacttcatttagtaatgtaacccagtcaggcactagccttaggaatcaaagtattaagtgaaggctagtttatgcatttgttcattattctttcctgctgtaaggattatctgtcatctggttaattattacatataaacatacacatctactccaaggcaaatccacaaacgcttacaaagagtaagccttatgaaaaactaacttggaggacagttatccatatcataaaagagtttttatttcaacataatttgccttaagtcataagctttccaagtttgtttgaaatatgacttgatttataaaatatgaatttatttgatttttccagagtaaatctagataaaacaggatacatttaggttgtgtgtgtatgtatttatgaatgatatatgagacctgtttataattactgttcttaaaaagttagcttgtttactttgaaacaagggaaatagtggtttcttccatgatgtgaaacatataataacaaaagatacttcaaacaaatagcaagtagtttggcctcagtaatatggtcaagttttaaaaatagacatatattttacttcataggagatacaacagatgagcaaagaatgacagcaagaggcaaaacttcggacatagaggccaaccaacctttggaggtaagtgaaacagagtaagtccttttcggtgaaactgaacaagtcactatgattacttatgcctccgaggataaatagtaacttctgctcttgctatgccataggtgcctgaatacagggaaacaagtggtctgctgaaagtcagtggagagcagtacagggagtgccttcccaagtgctaaactcctttagtgctagaaatgaaaactttctgttaaaaacaaaacaaaacagaaatcaagtccttaagttaaaacatttaaactatttttaattgagtgattatgtactaatatatttcaataaataggcagtatattaacttgtagagaaaggcttaaaaataatccattcagccgggcacagtggctcacgcctgtaatcccagcactttgggaggcctaggcgggtagatcacgaggtcaagagatcaagaccatcctggccaacatggtgaaaccccatctctactaaaaatataaaaattagctgggcatggtggcatgtgcctgtcatcccagctacttgggaggctgaggcaggagactcgcttgaaccccggaggtggaggttgcagtgagcctagatcgcgcctctgcgctcctgcctggcgacagagcgagactccgtctcaaaaaaaaaaaaaaaaatccattcaaaatcccgttgccttactagttccagcatcaaagtacactccttgaaagtattctgtagaaaaactagggtatttattctttttcacatgagaaaactatttgctctctaagagtttacatgaaaatgtagttaggatacttttgaaaactatatagaaatatactaacattatttaatcaccaaaataatcatctttaagacttaaggggaatgttaagtactagggtggaaggattatcttgaaatgtgaaactttctacgtagtgacacacctctacctgtattctagttgtagcatatgagggtattgctgcatacaactagagggaggtcagagacctggccagtgtgattcaccatggttccctaatgcctagcccacagtaggtagttgaaaagatttgttaaatgaataagtcagtacaatcatgagtaataagtagagactaatatacttttaagagatatttttattttttatatttatatttttcaccgtgaacaaatattttgcaatcaaggaaaaatcatcctatttaaaacatcttatttaaagatgtgatataggaagtaaattcatgaggaggaagaaaatcatctttctcatgaaactgtgcattcattctttcacttatgcatgcaacaagtatttattacactgaccgtactcaagatactgtgcatggagctgaatatataatggtgaaaataggacacaaggacatagaaaaatgtccatcttatatgttgaagcaacttgatctctttcatttattcaaacatttggtgaggctgggcgtagtggcccatacctgtggtccctgtgctttgggaggccaaggaaagaggattgcttgaggctaggagtttgagaccggcctgggcaacattgagagactcatctctacaaaaaatttaaaaattagctgagtgtggtggcacatgcctgtagtcccagctactcagaaggctgaggtgggagaattgcttgagcccgggaattcaaggctcccagcctgggcagcagaaacatttagtgagtgctggccataagtagcatctctgataggaaataaaagttgatatgtttgggatttgggagataaccaccaggatggttcaaaaatcatccacaattacttgagtttcgttgcttagtgtcttcttttatatgggctgctacagcaaaataccataaattggataccttatgaacaacagaaatttatttctttagttctggaggctggaaaggccaaggtcaaggtgctggcagatttgtgtctggtgagggccctttttttttttggtttgcactctggctgtgtcctcacatgataaagggagaactctagtctcttcagccccttataagggcactaatcccattaatgcaggctctcccctcccaccccctaatacagtcgccttggggattaggtttcaacatacgaattttggagggacacaaagcattcagaccatagcacttagttatgtgattcattggaaatgtctgcagaacttgactatttttcaaagttgattcattgatagaaagaattccaagactaattcttaaggaaagatgcttttaagattacaatccacagagctttcaaacaagctcattattgtgctactttctagtctctctattaatatagtcagttgttaatcattaaggctggatgtacatactcatgcagtaacagatgtttcaaaagtgccttctatgcaagtaccggctgggcaatgagaggacagtgtttgctatcagacagctcactaatgtagaaaaaaagaaaagtggagtgggagactataaatgagaccacagggttaaatcgcaatgcaagaggaaaacaataaaatacttctagaggctatatatgttttgccacagaaaagccaaatagtaatttaccttgacagtaagcatctaacatgggatttgttattcctcccctttaaaatacaaaaatgagactgggcgtggtggctcacacctgtaatcccagcactttgggaagtcaaggtgggtggattgcctgagctccggagttcaagaccagcctgggcaacatgatgaaaccccatctctactaaaatacaaaaaattagccgggcttggcgccgtgcgcctgtaatcccagctactcaggaggctgaggcaggagaactgcttgaaactgggaggcggaggttgcagtgagccaagattgtgccactgcaccctagcctgagcaagagagcgagactccatctccaaaaataaaataaaatacaaaaatgaggccgggtgcggtggctcacgcctgtaatcccaacactttgggaggctgaggcagccggatcatgaggtcaggagatcaagaccattctggctaacatggtgaaaccctgtctctactaaaaatacaaaaaattagctgggcacggtggcctgcgcctgtagtcccagctgcttgggaggctgaggcaggagaattgcttgaacctgggaggcgggggttgcagtgagccgagatcacaccactgcactccagcctgggcgacagagcggaactccttctcaagaaaacaaaacaaaacaaaacaaaacaaaacaaaagtgaaaacactgctgaacgctcgctacccttcatatactacctagatatagtcaaaaatgagtcttatccagcctcctcgatttaaattctgtgtagaagttgatgactcctaaaatatgtctctacctagacctctcccctgagttctagactctgtacccaactgcctatgtaacatttcacttacaaatttctacacagttcagcctttccttaacccatagaagaactattgatacctggccccaccaccctggagcctctctgtgcccaagttttaatcattcctgtttaatatcaccaccctatatctatatagtgatttagaaccaattccccctgaggtacccttggctcctgtctttccctcacactgcacatccagtctatcagcaagtcctgccatcttgccctctatatccggaatgtgactgctgctcaacgtcatcactgttagaacagtctaagccaccccttttactagggccccattctttctcctccagcccattctccacatagcagacagaaatatgtcagatcacatcactccttggcttaaaagctctatctactgtaactagaataaatgctaagctccttgcagtgggctacaaggaactccatactctctctaatctcatttttctccccatccccatccaccagccacctgccgttctgtctcttgatgatgttaagccctttcctatctcaggctttgtatttgctagtcattttttaaaccagagcttcacttggcttcctccttatcattcaagtgtcacttttcatgactacctcagctaatgtgtccttcccccagtcactgtcacataactctgtcttattttctccattacacttaatcactatgtcggattattcatttgctatctgcttctcctgactagaatgaaaacaaactttgtatgtctagaatagtgtctggtacacagaagttacccaataagtacttgctaactgatcatctagattttatttaatgtctttgtccatctgccaggttaaaggcctaaatgtcattttgactccttcttctcactccctcattaaatctataaccaaggcctaatgtttctgcctatcaaatatcttccaaatgtggtttctcctacaccaactaggtcctcatctgttcactagactattattagatgagcagtttcttccccaaatctctttctaaaaaagaacagcagggtttttttttttttacttcccccctctaaaatcccttgaaacctgcacaatgcagctgaaaccttgaaccctgttctaatgtcacttcctttgtgaacccttttctctgctcccccagccagagacaaccccaatgtcctcttaatgcttagattgtcttttatgagttcactatagtgcaggtttttgaaaggcaggggctatagcttaattagctttatgacctcagcaactatcacactgttagacatatgtgatgtaacataaatgccctgtcaatgatttctgggtagataaatgaaaaataaataatccacttatctttattaaattctgttttctactttacataataaacagacagttgtatcttttctcaccataaaaaaattttcttgcatttctttggagttatccatttaaaaatctgttaatttacattatttttggcactcttactacattagcagggaaaagtttaataaattcagttagctttaaatatatatatacatctgattaagaaatcataactatttgctaactggaaagcctctaattattttaatttttaatgactaagcaatgttgaaatattctctataacgagaacataattagtaaattagcatgggttccataaagcttaaaaataacatttgtagttgccaaaatatagctcagttttctaagaacctttggagaaggtggcttttagtataccgaaagaggtttcttttggcaagttcagataaacatatagattgcctcttagtttcaagggattgtgttagacatggtggtagggaggatacaaagatacctaagacccagtgactctgacttactgatgcaggaattctccatctatttgtggaaaatttagcaaatcactgtactgtaaagtgaaataaaataagttccttacgcgtcataactacaaaggtagctgtgagatttcgatggaagaaggatattgtctgggggagtcaaaaaaggcatcatgcattagatgagctttaaactatgaataattttgtctacttgtatgattaattttttatgattaagaagttcctgggaaatgaaattcttcattaagaacattttagaaatacagaagcaaatcctaatgtgaaattgctttacacacgtgaatctcaatggctggtaataaggggttaaaaaatgaaatgaatgtagcgtggcctatgctacattgtaattttaatgacagttaaaatatttgttaagtgtctgtgatatttttcattacacgtcatagcccaagtatatttcaaaactgtgttctccattcaagtacatctctcgaccttatggaaattctaacatctagatggaatagaatttaaaaaagatctggtttgggcatcaaataggttagtttttacagagctagattatgggatattttagcgcatttacacgaatgattgtctatggaaaacagcgtatttgtattaagtaatttgagagactttgcagttcatgaaagtgatgataatttagcattcactccagaaaaatcgaaagttttcagtacttcctgaagtagtgtttgtctcttcttcacctccctgtttaggtagtttcaggtttctctcaataataaattaattaatactgcatctacatcatagtttcctatgtatcatcctaagatattatcacctaaaatagggtaactttaggagacacgtcactgaactatctaatcatcaaaatgtgatttttactaagttgtgcattactctgtgttttaagagtcatttgtaacttttaacaaagttcaccatgtttttggtatggagagagtgaatgtgtataaatccatgtttgggcttattaaaattaatgtcattagactctgatatttgagggaagagttacaattcaacctaattatccaattaaaggattagacacatccttttcattcttcttttttccttcttgcccttctgggtaaattttgatagtgagttgtaatgatgttgcatctacttctactgtgttctactagtcttggagcctgtaacttacagctcagggagataaacctgtaggggcccagttttgagtttttgccattatgactcatctcttaagagaataaacattacatgtaagcaagtcgtcattctttttcaatttgtagtcttggaaagtgttttatattgtgaaaactggaaccgtattagctaataatttaccagcggacctgttctttttggctttaaggtgtattttgggaatcgagaatgttagttttagtttttaatataactatgtctaattttggtgactgaattttaatctagttttagcagatatttttaggttgtttattttaagtgttggttgaacttaaatttcttgtatttgtaactgcagttttttaaaaatttgaacttatttttgatctcaaagactgagggatatttttatttacttatttttatttacttagtggcttaaagataataaaatacaaaaacaagccaataaaatgctccccacaaaaccataattccatttgtgtatttgtcttgagtgataacgaattcacatatgcatatggagacacatataaaataataactaacagatggtagagctgcaaagtaggatttataaagattattatcagctggtggtattgagatactcctgtggttatactgacagaagacacaaaaattatttatattaagaaactggcactaacaccttcccccaacttctgttaccaaagtaacttattgcatatttaatataaatttcttaatgaagaggtaaaacaatcttatggccaatttgtactagcaaatttaatagagtagcagaaatagtaattaaggtagtagcaataacaataaaaactgttttgctaaaattgttaggggcatgatatttctagtaggtaaaggaaggatttaagggactttgtttattcaggtaatttcaaacacacttctcaatttagtacacagcggtcactttggaatattgtacaattgtaaacaaaagcttgagttcttttgagctaggtatggaagctgcattgtatatgaagctgcattatagaattcatagttcagtaatttagggaaaagttgattcttttgttcatttctttttaaaaacttttatttttaatggacaagtaataattgcatgtatttatggggtacggtgtgatgttttgacacatgcttacaatgtgaaatgattaaatcaggctaattaacaaatctatccccttacgtgcttatcttttttcatggtaaaaacatttaaaatctcttttagcaattttgagtatacagtgtattgttatttattaaagtcaccattctgtgcattagattactaaagcttattcttcctgtcttactgagactttgtcccttttgatcagcatcttccctttccctacccactcccttccctcagcctaaaatttgattttctgaaaaaagtatgagatgcacattttaataaaacatgttcactcttcttctgatgtgttttcatacatccattatgtctttcatagagctataggagccttcagattctgtagggacgcgtttccttgttgcttttatttcagatagttattgaaatgaatgaaaatatccttgagatttgtgaatcccatgtgatacagactttggttactactcctcaaagaatggaataagattactgcattaaaaactgggttttgtgtagaaaggaattggggactcaaagtatagaaaaaaggagactggagggggagattttcaagaacaatttcaaaaatagcaacagttcttctagtggatgccaggatttcagttttaagaattttttagtacaaaatggtatataataagtatattaatttaaagcatcggggggttacaaagatgattatgaaactctttactcacacaagatattcatagtcaaaatacaaatataatggatattgctattgaaggcagtttaaattggtacaactattcttggagagcattttggcaataggtattaagagccataaagatgttaatatactttgacagtaattccacttttaggattctgttctaagaaaatagtcttttaaatccacaagttgtatgctaaaaaagatggcatattcagtcagtgcaatatttttcagtttttataaatgacactgatgatgagttttcaataaaatatacagatatagtacttaattttataattttagttaaaaatgcaatatacaaaattgtatatacagtatgattgctgctatataaaaactatgcagaaaaagatgatgtaatacataaaaacattaagagtacttgcatttgggatgatagctacataggttaaatcattctttccagtgttctgatcttccaatttgtctataatgaatgtatcttatattttaaatgatagtaatgttggtgatgaggaaacaacgtattcactcaaggatagtttttgcaagaactattttgtgtgatagtaaaatagtgaaacagtcggtctgttgagaatgatcatgaaggagatatgttggcactttgctcccttgactcatttaggtttaaggtctcttaattagttgatcacagagtaccacatctgaccacaatttgtcaaaacatctgtcccctgacacccagggacctttccagcagggagaagagtgaggtgatttgggaggttattcttcctatctctttggaaatcacatggcccaaacttttctcattaatcaacctgtcaatgtcattgaatcacttataaaggcatattttcccccgcaaaagtgtatgggttactggcttggacacatatttgtctaaacatctcgcttctttctttttatctatgatgctgagactcctaatttaaagatatgaatttctagctttatgataattagctgatgagaacataattttatcaaagacttgccaggatttttgttcattctttgtttttcctaatataaaaccctttctaatttctgatttctttggatatgaagcatagttagattattgcactgtgtcatttgaacagataaatttaattctttgatgtgtttatcctcttatgcagcataccttttggtaagaagattttgtagaatgcatttctccaacctttattttcatctgaattgctgggtcatataacaaaatagaaagtgcacttttgttggactccttagctcactaagtatgatctaggatatgttgctgagatttcttcaacttcaattcttagtccatgaagtcgatgaattaggtgcaatgtttgagcgccctccctgcccagaagtcatgactgtttacctctttggaaagcgaactggggttttgccacaaaatgccaacctttaaaataatgctttgataggggagaaagggagatgcgaatctgctgcttaatgaagagattttaggcattgattaatcaagctttatggcctgttgggtggggaaaattcaatggtccttgcaggtaaattgtcagacttcaaaaattacttcaaagattcttgctcttcctaagagtgtttgtcttgggaaatgataaatttggtcactggtagagaacaattaaaaatacgttgttatttcttttagtctataggtaatcttgacttattttacagtaagattagcacaggttgtttacccagaacactgccaagataaacttacagcctgcttctcaaagtttgtgaaggtctttttcgtaacttcaaatttgtacatttttgttaccacaacatctgtatcctaacttcacctttgctggaaaaattataattgaaaggtcataattctggtgctttcttctggcttgcattggggttaactagcacactgaaacataatgttcattcaccctagccagtgagtccaaaccatgtgaggtgtatgagagcaaccctgtttccatccaaactgcacatatggtgtgggtaagccagtaatgtgagttttatgcaatgtttctgctcatgtacacagtctgttgctcagcaccaattattccctgccagaaacccgctaacctgctgcttttgtacctctgctggatgaagttaggtagcttaaaatgaccacaatgatatttatttaactttagcaatctttgtttgttaaagttatgtaactttaagtgcccaacacatctgttgattgatcacaattgattgcaattagaatctaagaactggaacattgttactgcagtttgtggagatacacatgtgttaattatatatatttagaaggaggaatcaaaatgtggaaatactagctttttgtttatcaaatctagttttatgtcttcaattgagatattattatttaaaaaacgatatataatattctgtttatactttggtagtcaccttgttgtcattgtttccagtttctacttttatagctttaaaaaccacaaaatcagcagggtgagaggtccatgttgggagaacaactgttccctatttcacacagccatcttttttttttttttcaaattctgttttttaattagtggcaaatggtccttattttgtcctcctttggtttatattaccattacaacttcttgagactatatagagagcttaagtgcagccatttttatgatgtcttccgaccactagagattccttcttgaaggataaatttcatctgaatcttcaggcagtggaaaagtaacatgtaggtatgcacctggtctaactgacattatctgaatattccactttgtacctactgaggagtcttcttatgaacatgcctacatgagtgcaccagcatgaatacatagaaaaaaaattatactttagcttagtacaatttacgtagattttccatttttctccaggcgtagccagccccattccttactatgtgccaggtttctttgttgttgttgttgttgtttttagatggagtctcgctctgtcgcccaggctggacaaccttggctcactgcaacctccacctcctgagttcaggcgattctcctgcctcaacctcccaagtagctgggactacaggcatgcgacaccacgcctggctaatttttgtattttttagtagagacagggtttcaccgtatcggccaggctggtctcgaactcctgacctcatgatccgcctgccttggcctcccaaagtgctgggattacaggcatgagtgactgcgcccagcccctttttctgcctttttatgccacttgcagagggagaaaagattggtgtatgctacacgtaagagcacagtgatagtgtactgaagtaccatttacattaaaaaaaagcatatgaaaactttctcacaactttttagctgagaagttggtaaatggttgtataaccctactttttaagatggtttctcttggaaaatagtttgaagaacatgctgtttatttgttcatcgagatattctggcatttatgactagctcaaaccaacccatcggagagctgtatatttctacctcattgccttagtcctgcacagattgccttccttgtactgttgttcagtttgattgaataacttggtgagaaactgctgtgtggaatttactgatatttattatggaggtgttactaaggcattgtcaactacattagatagtttcccatgtgaagtcctacttaggtattctaatttcatattgctttttatttattttttttttttgagacggagtctcgctctgttgccaggctggagcacagtggcgtgatctcggctcactgcaacttccgcctcccaggttcaagcgattctcctgcttcagcctcccaagtagctgggactacaggcacccaacaccacgcccagctaatttttttgtatttttagtagagatgtattttcaccatgttggccaggatggtcttgatctcttgactttgtgatccgcctgcctcagcctcctgaagtgctgggattacaggcgtgagccactgtcatattgcttttatactaacaaaatattttgtttttcttgaggtggtaatagtctctttttctcatggccattgtaaattttgtgcctaactttgttttttcccattttccattggctagggggaagctcagacctaaatttacagttcagttttagtaactatttaagaccttatgagatatgcatctgcttgctttattttcctctcacctgatgctcctgttctatatttttcctggacgtaatttttaaatttattgtgagtctttttagttgcctcattcattttgtagaggaaagggttaaaatatattcctatatgtaagtatatttatgtaatacttctacaaaatatatttatatttagagtgtactttttattttaataggttgtaagtggtatacataacctctaattttaatcatcttttgctcctctttcaaatctctgataaaatcatacataggggtttgactgcgagaacgtgtgtgacattgagtaccttccttaacctgtctctcccatgcctcaggtggagtatggcagtcagctacacacttacctccagtgcgatgtgatttcttcagggtccttattgatttgaagatgcaggtgaaaggagcctcctttccaggtcatcaaccttgccaagctgctttcgggcagggtgtaccgcaggcatcttgcaagtctcactacttgtcacatcagccacttcatggtctcccttctgtatacactttcaatcctagatatgctttttagatggcttaccagttggatttttgatatcagtatagaggatgtaggacaagtgcctttctaacttagagagaaagattgtctcgggagtgatggttcctcacagtggcagattttcataacccttgctgtagtatggatagctgtaagaatgtgaactgtatcagacagacttgtagctcagatcttggctttaccacttattgtacagggttactataagaatttggtgagtcaatatgtaatatttatttgtatgtctatatacacagtatctgatgtatactagatactcagtaagtattagtttctttttagattggaaggaaattatggttaatgccttaaaaatcatgccagagtagagtagaattgattaaatcatttaggaattatgctcaattgagagttacagtaaaaggcaggggtttaatttggggcttaatttttctcatgtgacaagaagtctcatagaaggtagttaaagtattgattcaggagctcaggaatgttaagaccaaagtcctatagttcctcatagttgcaagttagctattgcagctccagccatcatatctattttccaggaagcaggaaggaggaagacagcaaagggagaataaaactgtgtccagaaacttttcaaaaaatctctaacagttttactggccatattataacatatggccacccctagtggcacgggagcctggtaaggagcctactttagcttggtactttgctactacccccagaaaaatcaggattctattaaagatgaaaggaaggatgaatattgggtaggctacaagaggtctctgacatagatatcaacctattttgcttttagaaggttcatttgtccaacaatagatatcagtggaggtgggggaggacaaatagagagaagcattcattagtgatgcctggattctatttagggccacgaagtctttgagtagtcatagtgggacaagaaataaagaaggacattaatttaaaaaaaaatcttggataagctaagcacaatgctggtaggacctttacatgtattaactcattaatttttacagacgaggtaggcaatattatctatatatcttatagaggaggaaaccaaggctcaacaatacccatttcccaaggtcacaaaaaaaacagtaacattaatggaaccggaattgagacttgcgcctgactaaccacaaaacctatgctttgcatcgtgttgttttcctgtctccactatataaataacgctgcagaaacctgctgtttcactttgcttctcttttccgtagtgccttctcctgtgaggtccacaataactatatattgacttcaatgatttgtgtgcagaactaaactgagtgttctataaaagattgctgctgttagttgctgaaggctgtagagatgaggccgggagaggaagaagtggtgcttctctcttatcaccgccactcagaggtgggaatgactgccttgggatatatgccaccagtgtcggtagcattcaaggacattctttgggacaaagagaatgtggcaaagcagcagtgaccaatctgagtgagccaaagtccaaaaggaaagctgatagaatgagttggcatggaggtgtatcttctcaagtcagaagcctgggaattatctttgacttcttcctctttcattctcaacccaattgatcaccaatcactttatttctacctcctctggctaccttgcttatctgtcctttcctctacctccccactgcaactacagtggttctggccttatctttcacatggattattacaaagagtttttgtaatagcccttaatgcccagtcctactttcattcaatccattcacccacaaatctgaccatgtagttgccttacttgatggcatcagaggctcttcagctgcctgtaggataaaatccagtaatttgtgtctactgtgcatatatggtccttcgtggtctggtcctgctcctctgtgtaaacgttcaggtctgttctgtgtcaccatacagagtttcttaccatttcttgagtatattcctttctcttgaagtttgtgcaatttctgtcacttctctgaagaactttatcccatacgtcttgtgttcactgagcaaattcctgttcatccttcaaacccctgctcaaatatctttcatcttcaatgccatttagtctcccctctggtcccttaacaccttgtacatctgaccaggagtgccatgaagtggggattcgggttgactcatcattgttccctgtgcgtggcatgcatcagccactcaataaatatttaatgtttgatgtgtgcaggaacagtcagactagacaaaagacagaagaacttgttatctaagtattactcttaaccatgaaaagctctaactttggataacctccttacctttcggtgctagagtaatgggaatatatttgaaacattacttcatctctccgaagtgaattattctcaccaggttcttaacagtttctgttagtttttcaggttatgtttaataattcccatgataccagctgaatgatgattctaattctcaaatcctaaagtgactcttgcctctcttgtccaatttaacctgccacattgattttttatttgttatgtattatgactttcctcaaaacttggttgtattttggattttcttttctgtatctcatccgtttttgcatccgttcctgactaaagacacattttcaatggtactttttaccttttagatgtttcagtatgttccccccacccccttttctttgagacaaggtctcactctgtcacctgggctggagtgcagtggcatgatgtcagcttactgcaacctgcaccttctgggctcatgtgatcttctcacctcagcctctcgagtcactgggactataggcatgtgacaccaggctcagctaattttctttttaaactttcaggttcagaggtacatgcacaggatgtgcaggtttgttacataggtaaacatgtgtcatgggggtttgccatacagattatttcacccatgtattaagcctagtagtacttagttattttttctgcttctctccctcctcccaccttccaccctctgataagacccagttgttcccctctatgtgtctgtgttctcatcattttaacaccctcttataagtgagtacatgctgtacttggttttctgttcctgcattagtttgctaaggataaaggcctccagctccatccatgtccctgcaaaggatatggtcttgttcttttttatggctacatagtattccatggtttatgtgtaccacgtgaacagacactttgcaaaagacatacacctgtccaacaatcatatgaaaaaaagctcaacatcactgatcatcagtgaaatgcaaatcaaaaccacaatgagataccgtctcacatcagtcagaatggctattaataaaaagtcaaaaaataacagatgctggcaaggttaaggagaaaagagaatgcttatatactgttggtgggagtgtaaattagttcaaccattgtgaaagacagtggtgattcctcaaagacctaaagacagaaataccatttgacccagcaatacctttactgtatatacccaaaggaatataaatcattctattataaagacacgtgcacacttatgttcattgtagcactattcacaatagcaaagacatggaatcaacctccatgcccatcagtgaaaggctggataaagaaaacatgctaatttttgtattttttgtagagacagggttttgctatgttgcccatagtttttcctctgtttttttgagacggagtcttgctctgttgcccaggctagaatgccatagcacagtctctgctcactgcagtctccacctcccaggtccaagcgattctcctgcctcagcctcccaagtagctgggattgcagatgcatgccacaacacccagctaatttttgtatttttagtagagacgggttttcaccatgttggctaggctggtctcgaactcctgaccccaggtgatccacccacctcagcctcccaaagtgctgggattacaggcatgaaccaccttgcccggccctctcctcttatttttaagcagtgattcctaagggtaaatttgtgtatgatttttagccccatagtacaggaccttcttgcacaaaaattaggaatttgacaaaataagtaaatgacaagcatctgaagattttcttcaaaccatgaatatattacttctcaaaattttaagcccccatttttgatgtatcaaataacattcagcagttgtttatattacgctgtatctggtaagttgtaggtaattactagaagaatataagattcttgagagctgcataaatgtgatttctgcagggtctctttaggtatgctatgctatacacacgctgggagcctgcagaaatcacacatacacaaaagggccactgaatcagatctgaaagaggagggccattttgagttggataaagctacgtgtatattacttgttttttccacgcctgttgacatggagaaccaaaaccggtgtttcgtgctttcaacaaaaatagttttagttttgctctgaaagaaaaatgggttcacattctgaaaaaggtgattttgtcaccagaatatctgatgagtaaatctgcatttgcatttttatcattgcctaactaaaacctgttcagtttggttaataaattattaatacagttctctaacttctcatccgggtacactgttgaaatagcagaccatcccatttatttcaccaaatatttcttatacacctattttggatgaggctctgttaaactctgttctccatatctgaaaatgtatgggttattactctgccaaagatttgtggttaaaaaaattgtgttaagttctaagactcatcatatcaagatcaagcaaaacaattgaccatgactaactttggggttgaaggctacaactatgtcttttagaggtagttgtcactcaggcaaattttagggcatcacagggctaaacattaattaaccaaatgaatcagttttaaccactgcttttcctcaattcagttaagggttaaggagttactaatacagaaagatggtgatacaggagagtatgagaattattgattaaattatagataaattatagactaaagcatagtaatatgagaatgtttcattttctgacgtatttaacttaattacctaatctcattagaagtgattaagatgaatactcagcttgtatctcaagatctttttaggtattgattatagcatctataagtccactgactttttggtttctacatgcattgcctggcagtatcagtcagttcacaattcaagttgaaattaaaattttctaacaataaatgagaaacaaaaagtaacatttattttaaaatattatgtcttttaaattttgaatattcagatttgaggattgaatactggcacctctctgtcacttatgttttgctaatgatcatctatgcttcagctcctcaaaatggcctgtcaggtgtcagtttagcatgcgagactttaagctgtcttttgtagtttcataagggccaaagagcttgttagcctggaatttagtgtattttggtactcatttgcttttagttattcttttcttgattttttttcaaactcttctcatgaggaaaatgtacaattcctaccaattagtcataagccagtttggatttaggaattgcatagtttattactttgaaatattattttattcaaatatttagcaaatagtaaagatgtgaatatttcactgaatgttgggtgatttggctgataattagatcctcagagaaaaactgaaactcctgaagtttgttgcagaatctgaaaagtaaccaggaaaacagtagtttaatatgttaagtactagttattaatgaaaattaagcgtgacttttttaggattcaattcctgtttttagtggtatagctttctggtattttgtagcttactgtgttcatgaacacaaaagaacaagtaacctcactagtggcttgagatctgactcgcaggaaaacattaggtagtaattaaaacaaagctttccccccacccccaagtttgtgaaattttaagcacactgcctaatgcagtcaccacttgccgcttgtggctattgagcacttgaaatgtgactagtctgtattcagatgtaaaatacatgctgggattcaaagacttagtatgaaaaaaaggattgtaaaatatctgaatattttatattagttacatgttgccatgataatgtttttgatatattggatttaaaaaagaatattaaaattaatttcacctgtttaactttcttaatgtggctatcaaaaaatttaaaattatatgtgtttcacctcactgatttattggacaatgccagtctaatagatttaaaaattcttaatatgtacagtaaatatcagatattaaaagcttatatgatttggtttttaacctctgaacagtcaattctttggaaatctgagaagcccaattattctttggtctcttcaagggctccaggttgaagcagctgttctttgaaattgccagtcctgattcagttgactaatagcaatcgatagatacggaaggctaagtactgctttgcggttgtgcagccaaatgagtgaactgtacctactgtttctctcctttctgcctcttcccctgatggcttttatgtggttgttagtattcagttgatgtttatggtaacataaatctaaattggttttcagagacccaattcatgttttactatatcccataaattatgtcataaattaccatggctgaccatcttatttacaacccttgagtaataatctatcacttattatattattacatattactgtaatattacattaatattacttattagtaaacaaaaatgagttgttgatgtgcttttgtatgatatcagccaaagcaaaacctacatatggtaggaactggaaagcaagcatttattaataatcagcctctcttttccaggggggtttagctatttacctgtgaaaagcttgtgtactttatttaaaatttttgatgtatgtattgtttgacaaaaacttaaagggtttgggcgcactgagaatagtacagtgaagtcacactgtatgaaaaagagagaggcagttgggtaaatgctgataataatgaaatctgtaaggtcagtctgtgaagataaatgtaatatttgaattagtcatctagtttctctgaaaaggtagtaagttaatcttgttccaaaaaaaaacaacccgagcctggtcgttttgtttttcatgcctttcatcttgggcaatcttttgtatatcatgcaaaggaccatacaattagcatgaaatgagagagcgctttttaaatttgatgaataagggctctttttcttcagctgatatgcatgcaaggtggaggtctatatcccaccagcacacagaccacttggtatctgccctgtaagtagctctcagtttatatctgtgccttaatgaggaaagggttctggaagtaataaaagtaagcttaaaatgcatcagaaatagccataacgctttagtgtaaatacagaaaaattcctagatttgaacagttcggcttcctaccttgcttggattccagagatgcccctgtcattctctttttctagcaatcaattgaagacatattagtaagacttctatgaagacgaaaaactttttttttttggttgtcttctctgtcatttataatgaaaatatgctttgttaacaagttttttttaggtgacatgtgtttagaaaaattttcatgcctctatatttttatgggctgtttgcttttcagaatacttgtctgtgaggttatagtgctaatatgtgtcaatgaacattatttattctttctttaaggttttaatattctgttttattgattaggagtgctcctcccttgatgttttatacagagcacagtacttaagagatgagatcccaatgttgttgggaaagtttttataattagtcatttaagctcacacttttatattgttgtgcttcataatcccctaatatgtagttaataacactccttattacataaaggaagccaaaatgtcacccccaaaaagataaataggtcattaattcagccaacttttttcccttaactatgattgccagatttagcaaataaaattactggatgcccagttaaatttgtgtttcagataaacaataaataattttttagtatgtttgtcttgtgcaatatttgggttatacttagaccaaaaaaagttatctatatttgatctggcaacccccgccataactcagccctcttattaactcaaagaattcccaagtctggcaaatgtgatgtttggccctcctgcactccgtttgcccaatttttttgaagcccaaagtgcctcaggtatgctttctcatttgtccacatgtcttttgggagataggaattgggaattgggcaggctctattcacatcttacctacttttcattttttaaaaaagagaaaatgctttcttttttatttttgaaaaacatattagcgtatatatttctggataattttcacaataatatgtttaaagatggtaataaggatgatttaaagacagatttcaatatgagaaatctaatgcatcccctctccattccctttaggtgaaaaatgcttccttgtaaagtgataatattgattcgtaaagctaagaagacacctacagcaaaaagcttcagcttctccttctcacatctctttatttttggttcatttagtattaaatgcctagcagtataatcccagacaaaaacctttgaaagagtgaattcatagagaacgtgcatttcctgggtgccttataaacaatgttgagggcaagtggataaaaagtgactattccaaacaacaaacattaccatcagctgaatgatttttaaccttcctttcctttccctcccgcacctcccaccttgccctccgctccacagaatcagagaggaaccacttgtaacttgcatgtcctcatcctttgtcatctggattattactaaggcttcccaggtgatattccttcctccagcctcactccattccaagtaccccggctcaccttcagtaactacttatcagataaaatccaagttgattagcatggcatccagcaccctccctgatctgtgttctaattaattcccccttcttttacttcttcctcagtgctcaatgctacagcaataacaaatatttgtcatacataaaacattcatatcatcaggttttgttcatttttccctctgactgcaatgcatatcctctttcatctccatagcaaaatcctatcatcctggaaaatcctgtttaggtatcattccctgtgtgaggctttctctgaccactcttcatcatccttagaatgaattctgctatcctacttgagcttttgtatccacttgtggtaccacatgcttcacagtgttttgtcatggtttatttacatgacaatcaccagtagaagtttggaagatttttgaagataggacactatcatcatcattttgaatctctactatctagtactaacccacaaataacaagcacttgagaaatgtttgagtgcctgagtggatcagctttccacttggtaaaactttaggtaaatttcatcctgttaaactggtcctgtgtattagccgctcacttaccaccatttgtctctctttcacatcaattggtgaatagaaaaatggctcttgatttttcaccaggatagctagtccacctatgctgtttattagttaactgggttttgtttttttgtttttgtagaataaataaagtaggcccatatagaggggtggtcatgggtagcattatgtaacagaggtgtaagtttgcctttggcacactttccattcaggtttgtagctctcctttcagtttttatatccttgacctctaaggctgcctgtcaatatcttagagatgggaatagagtggataggaggtgggcgcaggggggagtgtaatcttcctacaggaaaacttttctattaatatcttgtgttccatcccctcagggcctacccatcactgaagttaattaataagtccattcacaacgagatagtcaattatattgatacgttaaagtgtaactcttctcagatagcatttttatttttacagaaactttaaatccatctgtattagtccattttcatgctgctgataaaaacatacctgagactgggcattttacaaaagaaagaggttttaggacttacagttctgcatggttgggaaggcctcacaatcatggtggaaggcaaggaggagcaagtcacatcttacatggatggcagcaggcaaagagaaagagcttgtgcagggaaattcccatttttaaaaccatcagatctcatgagacttattcactatcatgagaacagcatgggaaagacctgcctcttcccacaacatgtgggaattcaagatgagatttgagtgggaacacagccaaaccatatcaccctatttccaaagaatgaataatattggcatgatatattttataacaaatatgcactttacagtaccaaggaaaaaggtgtttgtgaaaaagctgaggaccttttaatcaccactcaaataggattccctagattgtgcctataacgtgtataattgtccctcagtatataggggattggttccatgacctctgcagatactaaaatctgagggtgctcaagtctcaggtataaaatgggcacagtatatgcatataacttacacacatcctttcctatactataagtcatctttagattacttgtaaaagttaatataatgtaaacgctatataaatagttgttatgatgtagtgtttttaaagttatactttattgttgtattggtttttttctaataattttgatcagtagttggttgaatccatggatattgaacctaaggatacagagggctgactgtatgtacatggatgaatcagaaattgcatttggctgaaagtaattgatattcctgaactggtggccttaacaaaacaggggtttgtttttctttatctagaaatgtctcacgttaggcaattgagggctgataatagtggctccatgatactaacagtttcctcaactttttctctttctgcatcaccacctttaatttttgaagataggacacaatcatcattatttcgattctctagtatctagtactaagtctcacaaatgacaagcacttgagaaatgtttgagtgcctgagtggatcaactgtccacttgataaaactttaggtaaattccatcctgttaaactggtcctgtgcgttagccactcacttcccaccatttgttatttctttcgcctcaattggtgaatagaaaaatggttcttgatttttcacctggatagctggtctacccatgctgtttattagatgtgtgatttttatatatcagattgcctctagattacaagatggtcactgcatcttcaaccatagcaggaggggactagggtaaaacccacccccctttaagtaattttctgaaagccccatataacagctttcatttacatctcattgactatatctatcagcaaggaaggctcagaaatgttagctaggcacattgccaccccatcaccatacttacctgtaattaaagaagaagaagaaacgtccaccaatacacaactactaatcttataacaattcaaattttgcctttatggatcattcaattcaaaataattagaactaaaatttagtttattttcattaatatttagagaacattccataagatgcagttactttaatgaattataaggaattataagactattcagaaaatatttatagtatgccccatttgcatagtgctgtgctcagtgccaaagaagatggattaattctttttcccctgaagtgttttatcagtctcacagtccaggatatatatatatatatatatatatatgtgtgtgtgtgtgtgtgtgtgtgtgtgtgtatcacatgaaaatttaaataatggaatattatagcatatgattttgtgttaatcatgtagtaaaaataaaatcacgtagtgtagactaaattctataggaaaaattccagatacaaagagtaattgctgtggctgcagtggccaacgaaggtctgcaaaaggtagattagtagatttggcaggcaaacgagaatagcagagggcagtcctcctgtattcaacttgtgccacctattattttaggatatttatcgtactatatctctgatatattctttaaaatatttttagtattttaaaatattatttatccacagttttaaaattgactcatgttttaatacatatatttgaagaggaaattttatgccaatatcatatacgtaaagctgattttacttaccaactaaagataacttttgagaaaatacagtgatactaaaaattttaaatgcataatgaactagaagtaatagtaagatataacttctagttcattatttaatagtaaacaaattaagttcttcagtgggcaaaatggaacattttgtgatcagtcagtagtaaagggatatatggcttaatggcatgtggtttaagacaaagatgaagttctacctccaataagacaattctgccttttaatgaaaattactaccagcagcaaaaactccaattcacatgtacatgaagttggaaatatataaatatgtttaacccctcttcttataggttgttcatagaatcagtttttaaccaaaatgttatagatgacttttgtttggcaaacaattattcaagaagccactataagaccattttcaaagtctttttcttcttttgaatatgtcaggttattgggtaatgtttaaaaagttgtggaatgaaagagactctttgtcattcaccactaccatcttgtttgtgaaaatacttatgaaaacctttcatcaatttcaaaatatcttcacagaattcatttgaatttacaacctggccagggtttttggatgtttgatagtcgctggttggttaaaatggatgaatgagatccggcattcagtaataataataaaagctattatttgttgttctactgtggttagagactgtgtggagtacagtgcatgcacatatatcatatagctctccctatttgaggagttgagaaaactgatgctcagaaaggtgaaagtttgacatactcaggtcacatacctaatctgtggcacaaactcaaattctgatttgttgggttcagtccaaacacttaagccaagtcactgaatcaaaattggggaatacagctctgactcatgcttcttctcagagcccctggtcccgagcttcttgcggctatatcaacccatagggaccccatccctgctgacttctgtgtgtacacacgcatgctagtttgtgcaggggctaaggggctgcctgtaaaggctttgatccagaaaaagaaaggggatagctcttgacctgtcttgcacacaaccttgcgtttcatttttccttctcctttttgcctttgaagctctcctgaactccagcttcccagtgctcctcctcctcctcctcaatgcttgtacaaccagtggtactctccccactacttaggaattactgaacagatcagagggaattacgacaagaaaatcgactggcccaggtcttctaggtctttgaatgtcaaattcaaaagtttgaactctattttgtatgtggttaggaggtcattgacaataatattatcttaaattaaggtagataaaaatcagtggttttcctcaaaatgcaaacatggaacactattataagggataacatgtctatataatattgatcatatagtcatgtcactgtctaaggaaatgtaagtgtgttgtaatagctcccaaacattttcttgtcaatgttctttttctagcagttcttaccactggcattaataaggacttggccttgtatagggcgtctagcaatttttcataacaacaaatttggtgataaggataaattatttaggaaatagatctttcctgatgaacattttaaattgttactgaatgagcagcagcaatcacttgcatacctgcactgaacagctagtccagtgctaagagcaataactctctacaagtttggggaacaggtgatttctgtttgactttaattcttgaatttattcattcagcatgtaatttttaagcatctactttgatcatagttttgtgttatccctggcaatgtgggaggtagataataagacacttagtgcaaatcatataaatccctggataaaaagttaaagcccattttccttttcgtaaatataaatggacaaaaaaaggaatgtgctgaaacctgagctagaactatagccacagtgctttaggtctcatataatgaatctggctgaaatagcactttatatttttattttaaagaaacatacgtttcatattctgacatgattttaaatgtaatgaacgagcattttacaaaacaattttgtatactttccttgatggaaaatattatgacacaaaggtatatgttaattttgttgtcaccaaacctagtaaaacattagaaaaagcatgtagtatcagcttctggatctccttggtcacataggattaagaggcaaggcaccctcaagtcatgtgtgactgactcatctctttcctcacatttaattatattcactaggagctgtcagagagtctcctacctgtcctctcctttacctttcctgtgccaggaccagagatcaggcccttatcttccctcattggatttactacagagtcttccgacaaaccttcttccttctgacttttgcctttctggtctattctttacacagcactagagttttctactttaaaaaagaaaagttatattattttcccacctctccctcaaaaatctactatgttatttgttccttaagaggcatttgccagtggacctgcaggtctggccaagcccctgctaggactgtgtctaccttgtacgttgtgctggaatcaacttgccatttcctaaacatgcgttgtaatcacacggctctctgtctgcttgctaaagattgagtgtggaataccttttttgtagcagctgctctggaggttagccctgcccttcatttccagcctagaatgtgactgtttgccctggagcctttccaggttctcccatcagaagttcattctctgcttgaagcacgttcatactatattgattttttacctctattaggtaaaaaattatatgttttggtttctctcttttgtatctttctctttcttttccctttttcgtttcttttctttcttttaacatgcgtgtttttcttctttgctctgggtgcccaaaaactgtgagccaacttcaaagtgtggaaaccacagtcatactgattcttaccttcagcatgttttggttcattttccttgtcccagactttctatttcaatggttttctttattctaatgtcagatattgcctcagaacctttgtaagaagagatacagtagggttttgagtcaatataaataaacacatagactaagttctatgaatctttacttgccgatcttgtatctttcagtactggataagtgaagtgaatgtaaattgaagcctgtttatatcttcccatctttttaagtatctgcatagaaaaatttgttattagtttttatgaataagccaatcacccaaacatttcctcatgtggctacaagaatattttttaattataaaaaatataccagtccttaaaatatgtattttattgataaaaatcaatgcttgtatttctctgattcttaaagaagataatattacaacaaatactaatgatatacttatgcatttataaggaaaattatttgtatgaagttagatattcttggctagtattaattggattctcctgactattaatttgatgtaaatcctcaagagttacagttaaggtgacattagttttactctgttttagcctctaacccatatttttgtgttcagcatgtccttatcttaaaagttgctgtcgccaggatattctaagtatctatatcttacagaaatttattcttgttatatatttttggaagtaccattcattggtgatgcatcatatcaattctctgtactcttaaaaaattatctgaaatacttgatcataaaatcaaactaaggaacaaagaagttctatttgttagctccattctggagcctgtctttctgggtacctttcaatgaaagaagtcaatgaaagaagtcaaagtggcctctaaatcacaggccactttttactcttctgaaattggattacttagttttgtgttgtttttaggctcttttttgttgattacgtgaaccaagctccccattgaacctccctggtgacttgagtcagcgttgagagcccggaactgggagccctgattccctttgtggctttttgacaattacctaactttgctgtatttcttcattgacaccgttgggataattgcctttcatacctcgtgggagtattgtgagattaattaatgtttgtaaagtgttttcaggatcacgatgaaaggtattaatttataagcatgtggtattattataattattattagtaatagggatggttgtttaatgcaaattttcttctaaatgtagtgtcatattttcaaaggacaacttctttctttgtggccagatgtggatacaattaaccctttaccctttattttgaagatacaattagccaattgtgtgtgcaattagatgtgtatgcagtttttgcctgaacaactaattacagccctggtaaaacttcttttgaaaaacgctggccctttgaatgttgactctgtctatctgtgtaataagcaatttgtgctaagcatattttggggccatggaggctcctgaatattgaagaattgcttttgcagttacttgagaaagattttatgttcttcataccatagcattgtattttgccattgagcctacaagtcctctcacatggttctagtttcaaaggttttattggtttttcttaatcttgacattcagtggaaatattttccacagactgcattttgtgaaacaggtttttcttttggaatttttttttcccttgaaaattccatttcctttctgtcttcaattcaaacatgtcatcttatatcctccttactcactaaagaggactgatcctctcttcccagatatggcctggtgaaaccatttttacagggtgcttttaatcactacaatgtaacttctacttatacggaaaagtaggaagaaaaatgaggagacccagaagatagtgttatagccatttgtctccactaatctcctaagtgaaaggggaacgtttttggcttttaatggtgagtttagtaacggcctcttttaagacagctactctttaacagtgctcttcagtgatgatcattgaactctgctttgcataatgtaccatgctaccacgaagggggatccagagatggccaaagtacagttgttaacttctaggattttagaacaaactgttgacataagaaaggtgcttctgtctgcaagctgtagtaagtattctacagagtgcaggtgggattcagtggaggtggtgatcacattgattggaaacatcaggagaagcttcttcgtagttgcatttgagataggacctaatgggtcggtcagcttttcatagacaggggggaacgtttgatggaaatgagggaaagtgtttgtctgagcagaggattggatctactagaacataggttcagaaaagagtgatttgtcttgctagagttgtagttatcttgcaaaggaagggataggagatgagactggaaaggcagcttgggaccacagtgtggagggccctgaaagtttggcaggaaactttttacttaattcagctgacactgtggaggcactgcgtggttttgatggagagtgatagactagagctgggctgtgaaatcgggcaggcctcaccatgccagatgaactgcagtggaacagactacaggagaacagatacactcagcaacgttgtggaaattaagaccagagtcatctctggactgttggcattgggagtgaaaaagagagttactacacacatgaggcatactgtggtgttagtatttcttgatatcggcaactatcctgacatgtgaccaccgagggggattcagagatgggcaaagtacagttgttaacttttaggaatttagaacaagctgtagacataagaaaggtgcttctgtctgcagactgtagtaagtactctacagagtgcaggtggtcaacatgactgggaagaaagaggtaagtaccttcaattaaaataggttgtcaggaagcgggcagatttcagagaataactcttggtaattaccatactatggcacatttacacaaataggcaaagatggcaggataggaaatatagttactggagcctattaacctttacactgtgaaaaacgaattagaaaaactacacatatatgctaaatatacaaaaccatagttctatgtatgtctttaatcatggaatagcagccagaacatggtggttactttttcaggttttatttgaaatacttgaaatgaagatgccagagaggaacagtattctcctatctaatcttacaaaagtctgcttcccatcttattctgtcaagcactggtttccaaggagattccgtgggtaacctatcatgtcatcagtctcaagaatgtggagatctacccaagtatccctaacatttctttctttttcttttcttttttttttttttttttttttttgagacggagtcttgctctgtcacccaggctggagtgcaatggcgtgatctcagctcactgcaaactctgcctctggggtcaagtgattctcctgcctcagcttcctgagtagctgggattacaggcacccaccaccacgcctggataaattttgtattttttattagaggcggggtttcaccatgttggccaggctggtctcgaactcctgatctcaggtgatccacccgcctcagcctcccaaagtgctgagattataggcatgagccaccatgcctggcctatccctaacatttctagataacctgatatgatctgtcatccataaatttcctatcctatttcccaggctttttatatttttagactgcactccaccatgtcattggacactgtctcagtctgctcaggctgctgtaacaaaataccatagactgggtgacttaaacaacagacatttatttttctcatggttctggaggctggtaagtctaagatcaagattctggccaattcggttcctgatgaagaaccccttcatggcttgcagatggccaccttcttgctgtgtcttcacaggcagagaaagaactctctccctcttcttcctataaagccacaaatcccatcatgagggccctacccttatgaatttctcttaccctaattatctccctaaacacctgatcttcaaataccatcacatcggcagttagggcttcaacatatgaattgaacgtatgggtgggggtgtgtagggtagaggaagagatacacaattagtccatagcagacagtgagcttgtaattcagggagatactaccaattatttttcaggacacttacaatcagggcagaaggcgaaggggaagtaaggcatgtcttcccactgtgaagcagaagagagagagaaagcaaaggaagccacacattttaaaaaaatcagatctcttgagaactcactatcacaagaacagcatgggggagactgcccccgtgatctaatcacttctctcaatagatggggtttacagttcgaggtgagatttgggtggaaacacagagccaaaccatatcattgatcctattatgttttattcacttaatctgtcaaagactatgagaagtatattagtcactcatcattgtaattctatcattttctgtctgtatttctgcttttttattgttttgtgtgtatcttgatcttgttatttgaagcaagatttgtgacttaaattccattataggttttatcttttatcaacagcaaaaatgtctttatgtattctaaaagcattttgctgtcacttttatatgacattttcattgtaacttctgctttcttttttttttttttgctttaaaaaaaaatcttgctctgtgattttcattcattcattcactcattgaaacagcacttttttttttttttttttttttttttttttttttttttagctcttagcaatatatagaagtgagcaggacagccgtggtcctttcttgggaagtttattttctagtgtgggaaattgtacaataaataaaataattctaatagtagtaagtgctatgaagaaaacacaatagtatgctaacatgataaacatcatgataaaaggcctttaagtagcagtggagattatttgtcagttaataaagggatttaaaacaattacatttactgaaatagctgatatgtgtatgatcttacatcagttatcttattttaggttttctgaggttttgtttccatttagtttgtagtctatttagtttttagttccatttagttatgagtaatatcttgctttatttgcttgttttcttctcaattggtttggaagatgatgttatttttatttacataagtggatatttttacattcactgaaaacattctctaatctaaattttgcctttttatcaaatcaaacaattatatcttttgctttcttcctgtaacatgagaaatttaatcatccacggtcttgctattttatggtctttattaatatagtcttaaagattccatttaattaattgtattaactgtacttaataggttttcttagctacaataattataccgacttccatatttaacagcttttaatgcttactgtcaatttgtgtacaataatttaacctttctgaatttcttaattttagtggtaaacgtgtttacatattactttataaatgtcttcagtatattcttaagctcttggatatttaaaagtggttttctatggtctttacaaaggaacagtaattttactagctataaaagtcttatgttataatctttggtttgctcaaaatgatcactctatggttttctggccaacctgatttttcttcattagtagggaatatgttttatcttttctgtttcatgctataatttattttttatacctttgaagtttagaaatttactatgtatcaagataggtgtgtctcaaggccaagtgagagttagcaaaaacaggttacagagtcagatctgcaaaggtctcagatattggtatatctcatataacacaaactaaatatgtttactatatttaaataaataaaaggcaaacttaaaatattataatgatcatgagaattaaaaattaagtgtatttgggaaaaaatagaacattagaaattaaaaacagttattcaatgcataggttaaagagtatattagacataagcaaagagagattttataggctagaaaacagatctgaaggattactcagaatgtaacacagagagacatagaaatgcataatagtagcatgaaggatataatgaagaggtgtgtctaacatccatcttaatggagagacaaggtcagggaatggggcagggacaatatatgaaaattaggagctaggaattttccaaaactattaaaaaaaaaaaatctgtcttcagatttagaaagccccccaaacacaaagaagaataaatgaaagaaatccacattagacatataatagtgactcagtataacaccaaagacaaacaaaatgaccttaaaagactgccttaaaggaattaacagaactaaagctgatttgtcagtaacagcactggatccaaaggcagtcaaataatatcttcaaagtggtgagaaaatataactcaatctagaagtccatgttcagcaaaaatttgaagattaagggcaaaataatttttttcagatatataaaacctgagtgaatatgcagcaagagactctctctaaaggaaattctaagtgatgtacgtcaggctgaaggaaaatgatcccagatggaagatgtgacctacaagagggaatgacgaactaagaaagtggtttatatgagaataaatctaaactaaaattgattggtgaaacaataatgtaatggcttatagccaacaactccgtagagaagtgattagagtgaaagcattctaaagtccttgctttatgtaggaagttggttaaaacaaaaacaaaagccactgactaagtatgcatgttaacatttctagggtattcactaaagaaaagaaatagtataactctaaactagtggagatttaaaaaggaacaaaaaaagttagtcaacccaaaagcagttaaaaaaagaagagaaaaagaaagggagacgaagcataacaagatgatagaacaaatgtgaatatatcagttactatactatatgtaaattaaattttcctgttaaaaagcacagtttattagattaaattcaaaagatagactagctttaaaaatctaaatacagtactgtggtttacgtgaaaaccctacataagggtacgtaaaggttttgagaaatagggtgacataactacaaatataggtggaatgaactttaaggcaaaaggtgttaccagagatagagggtcacaagataatggtaaaagattcatttcaccaggaaaatatgacacttctaatgttgtatgcccccaataacagactaaaattatataaagtaaaaaatggacagaaacacaaggataaaaagaaaaaatgtcatcagaattggaggttggaatctacttcttttagtaattgatttattgaataaaccagggatcagcaaacattttctgaaagagaggccagataaatattttaggccttgcagggcgcatatagtctgttttgtgtattcctctttgcaccatacttagctcattgggccatacaacaacaggctaaacagattgagtccacagggtatagtttgttgacctctgaaatagagagtaaaaattagtgagggaatacatgatttgagcaacagagttaataaggttgatattgaccatacacgtatggaagagacattcttctcaaggatgcatggaagatttatgaaaataagaagcatacaggaccatagagcaaatatcaataaatggtaaaagattattatcttacaatcaacattatccagtcaactaatacaattagtaaaaccacttttagcaataatctggcatttcttcattaaatacgtgattctttcatgatccagcaagttcattcctggtcatatgctctggatgaactcttgtacactgatagacatacaagaatgatcacagtgctattcatggtagaagaagctagaaacaacacaaatatccatcatccacagaatgaataaataaataatgtttattcacaaatgaaatactcttaaggatatgaaaatagatttaaaactgcttcacatagcagtatggatgaatcttaacatagttttaagagaataaagcaaaccacagaagaataaatacaattatgaaattcaaaacatgcaaagctatccgatatattatttagagagaaatatatagatatattgatctatatatttgtcatgtagctataaagaagagcaaaacaagaataaacgcaaaattcagattagcatttactttctagcaggggaggaaaaggaatagatgggagtgagagcagactccagagttcctggtaatgttctgttccttaaattgggtggtgaaacacagctgattgttgtattttattctttatgccttacacatattatagtatctcgtcattgtttaataaatgaaataaattacacagtggggatggagtaaggaagtatggaaacagcaagggtgggcactttttttgttttttgagactgggtcttgctctgtcatcacccgttctggaaggcaggtgcataatcatggctcactgctgcctcaatctcctgggctctgccagtcctcctgcctcagcctcccccaagctgggaccacagacacatgccatcatgccaggctaatttaaaaaaaaattatttgtacacatagggtccccctatgttgcccagacggatcttgaactccggggctcaagcccttctcttgcctcggccaccaaacccggccagatgaacacttttttttgagcctttttactcttgctgtacacgagagcagagcaatagaacagtaggttggagggagacaggagtaaaagggtttctttgtaaataggacttacaatagcatgttcgaatgctaataggaatgatccgggagagagggggaaaagtcataataaggaagaagagaaggtagtttcaagaacaaagttcttaagaagcaatgcaatctacaaatgagtggtttggccttagggtcaagttgacaagtttaatggggattggggaagaatatatgttacagttgcatgtaggttggtaggtttgtttgtgggaagatgaagatcacatctagagatttatgaccataaatttaaaatgaaactagtcatcatgattctgtgctttcctccaactcatatccagctgctcaagtgcctgcaggtttgcagttggcagaaaattgggcttaactgaggttgaggttttgctagctgaaaacatggtcggaacaaacaggcaatggaattggggtgtatacaatgatgaaacagagaattcaagctggatgaagaaagaatagacatgatggtgacctagacagtgcaaaaatggaccccccattttggggggcagggcaggtcacaaaattggcagagtgtagcttccagagtatgtgaggcagattgttaggtaaatagggttctggggttagtgtagttgttagtgtcagggtctaagatgatcatgggaatacccagctcggttgaaagaaaaggattttggaggacatggaactgagaggatgaagtgttggatgggttgtatatgctcgtggtcttcaaccccgactgcacatcagaataatctgagggactttcatagaatattgatgccccggccccaccccagaccaattaaatcaggatctctgggtgtggtttctcgggaatttatattttaaaagagctccctgagtgattgtagcgtgcatttaggttcacgtagctacgtgaatgttggcattgccaagccaataaaagaagcagtagagagaactgttgtagactgggggactatgggaggaaggaggattgattcagaggatccccgactacttgaacagcacttagcacaatttattgtatatagtgtgcactcaattaatggtagctctttttatttttgttattattgtcatcatcattattattgacagtggcaatagcagcagcattatcctggggaaagtctccagatgttttatcaaaggttcttcacagaaggttaaaaagcactagttttagatgatcatcaaggaaagttcctaataaagtttggcaaaaaagctagaagttagcaatattctgaattgacgttctacagttgttgtgaagcttggaggagttgtactccatcatagcctggcttagcagtctgcacttgtcagaagccagcaggttaggagttgggtaccttcttttcttatgtcaaaaacctaaaggctaagacagctggttgctattttcctgccaataggaaccttagagccttttagttgtgtttcagtgtacctgtgccagggttgggattgggaagaggagacagggattaaacatataacattctaatattttattttacattcccaaattacttcgtgtgcatgtatacactcttactcccttctctgcaaaaggagtattatgagtcgggtaaacagtactatttaaagctaatgtgtacttgtgggtactttagtgactcccgaagatgtggttccactgaagaatgcaaggaattatagctacgaactgtcaatataacaagtgatcttttttttttttttttttgaggccaggtgttgctctgtcgccaaggctggagtgcaatggcacgatcatggctcagatttcaggctcaagcgatcctcccacctcagcctcccaagtacactgggaccacaggcacacacctccacactcggctaatttttgtattttttgtagagttgggttctccttatgttgctcaggcaggtcttcaactcctgggctcaagtgatcctcccaccttggcctcccaaagtgctaggattacaggtgtgaaccaccacacctggctcacaaattatcacatttttgtacaattgcatacgaaaatatattttaatatacattcactggatcactgggaaagctggcatgcaagcagcttagaaaagacaatatcaaagaaagaattcgaaaatatccccatttggaacattccagaatagttccgctctaatttgaagagtaatgagatacatctctctctttatatccaaccagattttagcttgctataaagagacatacctcctatattttgtttccaattgtctttgcactccataataattcatgtcagcttgcattataaatgaataaaagatctaatttaaaaacctatcatctgatatgggatgccatacacttttctccatggccctgtatgaaacaaaaataatgatgacaacattggacaatgacaccaggcagtaaacaatgtaatttctgtacagtgtctctgtcgggtatgttaggtaagcaataacagcaaactaaagtttatgttttataaaccaatcatttttgatactttcagcaacatctttgtcctcatttcaagcttgaaattcccaactgttcatttattattacgtgacactgagtggcttagttctgtgagccccagttctttctctgtaaaatgaggataactctgccttctgcgcagggatgatattattaaaagcaaatgattgtggaaatgctttgcaaattagaaatttctacacataatggtttttatcatcgtttattttttgttgttgtatttctaatccaaaacgtggaccttattttgataagcacaaccgagacctagacagctttaaaacctgatttggcattaccaatatgacacaaggtcttaagatgtcttatttccaacttgtgattgtgatctgtcaaattttagaatgacttattaaggtctaaaagagaaatattactgtattttctgataacctgtgggcagttccctgatggtattgagtaaaatgtggcaaggcaaattaagttacctttttttaaaaaaaaaaaaaactaatatgggtatttcactaagaaagcttattatctgaagaaagctattattaaaataaagagtacatcccttactcaatatgtattcttcagaatattggtcactggtgatccatccttgtttcttttagcctatcctgagaaaattctttttcaccccattcaataaatatttaagcacctgtgatatgccagccatggtactcagggaggaagacagaatacagttattgttaaaaaggtagacagtgtccatgccctcccagacctctcagtctataggggacaaaggtagttacaaaacccagtagggtctgtcctgtgactgtgaagggggacgctgtgggccaagtggatactcttgccatttcttaaataatatggttctttttgagatggttcatccagtactcttagcccttcaaagagagatttttctggacatacaaatttaagaatctagttagtgagtggattttgcagaaaataagtaaagtctctctgccactttaagaaagaaaagcagaagatgccattttaagttcactgctttttaaagttgagcatttgactgcaaagtttgtgaaaggtcaattgctttagcatgtaggtgtccctatcagggcccatgtttgtctattctgagattcactgcgaagttgaacctctttcttggctgaatcagttgctcattgggtggttctagaactaaaatgattgctaaagactggtagattctcctgtgaagaatagtaaacctgttttaaagtgaaagattgttagaacttagagtactgttcttccgattgcttagagagctttgtgtacctccctgtttatttgaactagtctttgagtggattggcaatgaagaataatattcgtattctaacacgcacataatatatgaaaggagatgaagtatactacctatagttgtcttatttattattacctaacattttattgtgctgtttatttggatagagttcaaacttgttcgtgaatatggacctagtaggctggaaataaacttaagacccagtaaaaaagagttgtaacaaaagagttgctatgttttctgcagtgaggattccttatcactttgtgattcttagataaaatcctttccatccaggaaaaattatacttccagaatttaccaaactgacagaacaactaacatgccccaggccaagtaatgtcagttctgtaatcccctaaagccattccttcccataattgcaaaaactaacagggaacccccacaccctggcccctgcacccttgcctgccatgctatatgtttaaaattgacatttgcttgcaagagtaaactgagtgagatactaattcttggtttatgacaaagtgttcctttctggcttgccagtgggaatgaaggaatgcttttgcgtaatgcctgaatacttatcctaaattcatagccgccttctacctgactaaataaaaatgtatgccaaaattattttgaggaccactctggtcgcctcttctttctcttaacaagaggctggcacagcatttcccacataccctgtatgccgtcacttgcagatgtgattattgcagaaccttaatctgaatctcagagtggaaactggttgacatgagggcacaaattctgacacagtccagaattttttttttctttttgctttcaacagcctctttgccgcagacttaccatttctcctttcaaggtggagctaaatgtttaaatactatcacataggtcctggttgttttaaagtgtcctacctagttatgcctctgctattaacttttattttgtattgttagtaggtcctcttaaaggagcccaggtgcattttatagcagtgactggcgttggtagtatcttccccaacatcactgtgttggaattggcattcattgatgttaagatcaaaatgacagctcttcttttgtatgacttcacctaacacatgattatctggattcatttttcttatcttttttccattttagttcaaagttagactgtaagaaataaagttagactctaagaacacaaggctgattcattaagtaagtacattttttcttaggcatctaccatccacaggtttctcatccctaccctccagtgccatgtaagatgctagtgatccatctaatatgttaaacacattcacataaaatattagggaccccttaatttactgtttacagcctttatgcttctaaaaagatttttagtttgcattaagaacttatctttttacaatttatactttaaaacagtagaaaagacatagataatttctgtttagtacaaaagaatccccacccaaggtaaatcttttttacgtaaaaaaatttacataaattattacataatagacttctagggctgcactgtccaatatggtagccacagtcacatgtggctattgaacatttgtaatgtgggtagtctgaattgaaacttgctgtaagtgtaaaatatgaactggatttcaaagtcttagtgtcataaaatgaatttaaaattttcattaataattttttataccaattatgttttggactgacgttttagatatattgggttaaataaaatatattattaaaattaattttagctatttccttttccttttttactgtggctactgggaaattttaaattacatatgtagttcttattaatttctatttaacaagctgctctatagggatcaagatcttctcttctaaccctgtcattttagacttcaggaaacctcatagaatttagagaatttaagtgacttgctttaggtcacatagcattttagtatagtagtaaagcttgagactagaaatttcttttaaatgttaagactagtgcccttctcagtgaaactagctttttgtgactctgacacttttattataagaggaaatgtctattcttcagaatttttcactgaactctttaaagcaaagagtctctctatactgtaggtaaatgttcctttttgtttgtttcataaatttgaaatatcagttattagctattcttaaaatggcgatggttttccctatgaaaaccttacatacagaaccgttatggcagcagaaatattttttaaatagatctagttaataccgtagtagagttttcaaatttccttgcacacttgtaatacaaatatgtcataaattacaaatttttattgggtatcttccaataacagctatcatgttagcatataactgggaaatgatgccagtaagaataaggcctccaggctatgtatttccttggtaaattgttaatactaggcaactatttattttctcttgctaagctttaacactctctttgctagtattgtgagaacagtctatctttgagtgagagatttactcaatcatagtaaagtaatccagaattcagttcttaagaacagtgtcgagtagtgctgcgtgatgtatgaactgtgaccttgggccatttatttaatgtgtctgtgtctcaccttcctatctgtaaattggggttaatactatttatctgtaaggtagttgtgcagatttcaatgacacgtgtaaagaatatatagcatgatattccataatatctcatagtgtccattttatctcaaagaaaaggtaaagatcaagtatttattcttttctttaaaatatctttagtcttctcctgttccctagaaatcctctaccactgaactaacagtttttggtcaaatctggtcatagtgacatcttattttccatagatacgtaaaaatttgtaattattacctgcaagagatattacaattcatacaacactaatagctggagatactttcattacaaatacaatgttcataaaatatcacatgtataaaataaatgtaaacagatgatactatcttaaaaagctcagctgagtagtaatattttttaattggattttcaaaatcatggtaaaattttgatatgttttgatggctattccaaatactgctattataacattgaattggattttaaaacttgatgtgtactgagagttagattgtcgaaaccaatacttttcaataataactcttccagaatttcaaatattttaacatggaagtatggaaattgagtcacataagtttacttaaaagacttttcattctattttaaaaatatatttgatccaccgcatattctcactcataggtgggaattgaacaatgagatcacatggacacaggaaggggaatatcacactctggggactgtggtggggtcgggggagggggtagggatagcattgggagatatacctaatgctagatgacacattagtgggtgcagcgcaccagcatggcacatgtatacatatgtaactaacctgcacaatatgcacatgtaccctaaaacttagagtataataaaaaaaaaaaaaaaaaaaagacagcaatgcaaaaaaaaaaaaaaaaaatatatatatatatatatatatatatatatatatatatatatatatatatttgatcataataattgttttaaagtgatacagcttagggtgaccaatgaacatggtttgcctgggactgtccagttttagcattgaaagttctgcattccaggaagccgtttagttctgagcaaaccaagatggttttcactctagctgatgcttcacagtttacatagctttgtgtatatatatatatattctcactggatctctgtgagataggaatgacagtattgtcatcaccatttcattagagaggccacatgctcagttaccctggctacctgaattagcttcaggtcccattctttatgacattgtctcctttcctccagatttcagttgaaacctcccctccccagtgagcgtttctctgaatgtgcagtcaaaatgagttgtctttttccctcttcatccctactgcccatcccatctcatttcattgcatgttactcccccttataacacttcccacagttggtttcctagtgttttgcccaagttccacactggactgtaattctcaccaaggcagcatcatgactcttcccgactctggtgccgggcacattatagggactcaaatctaaatgaagccttgctatgttgcccaggctggttttgaactcctggctcaaagcaattcttctgcctcagcctgtcaaaatgctgggattacaggcatgaggcacccaggatgcacattttttaactgcaaaaaccgaaaccattatctatacccatttggccaaatttctcaaagccacttggttttttctacatgtagctacaaaattcttaagatatttttagttgacagtcatcttttgatgtatcgaaccaatatgaattaagccaatgaggaatttttaaacttattaaataaagaagtgaattgttgaaagatacctgtagaagctcctttgaactaatgatgtattacctggcatagtattttgaaaaatgataatttttaaccattgttaacattattaatcaactacagtataacctgtttcaatttactagtctctgtttcatttttccctcaaataactgattttaacagactctgttgtactactaaatgtttcaagatatatattatggccaatctgtgttttagtttgccatctcaaaataaaatgacacatgattaatgttttcagaaagaaaacacattttagcaatttttgatacattgctgtgaaattggtaattgggctgaagttacacgagtgttggttggtttcctgcaggaagtcttcactttctatatcaacagttgatctggtgtctaaagtgttcacagtttggttaaaattatactcgataccaaagatagtacttccaccaaggagggtagagtcaaataacacttatggtgttctcaaaaatgacaatagaggatatgccaaatcaagcttactattattgaaatgtttgcttgaaaaagttatttttctgagcattgttaaaggaagggaaagggagagatttatgaaatcttgcctggaaggtgacacaggggtttgaaagccagtaaataattataaaaattataattattattcagtcatcaaacttaaaggaaaagacaaccagaaagtcaagtctgcttttaggattattaggtcaattatcagtatttttgaaggaaagaattttttaagctatccatatgctggcaattttttcatattttactgccaactttatttaaactactttctcaatttgcaaggataacaatacaatttctcttgttctttgaaaaactctatatgccacattcttaaagtattattgttctacctgttatgtaagttatggttcgattttatattacgtgcacttcttggaatgaaatatttcccttatgttgaaatttgggataatgctgagtatgatggacttgatggacatgttcaaatttcattgtagagagtgaggtaatagtgactaacatttattgattacttactgcattctgcattctgtattgaggatctttgccaacattatctcattcaatcctcacatcttacaaatagattcacttattcccattttgactgcccatcccatttcttttcattgcgtgctgctcctccttataacacttcccacagttgcttttcttgtgtttgagaataaaaagtgactgaggtacagaaacataaggtagcttttctaaggtcacacaaatggggagctgttaactactatatttatgttgtgtcctgcagttcaacacagttcactataaaagtagttgtagggttatgcacatagaagtttacccagtgtaaagctaaggagtgtggccaagagcaagacaggtactgtggtctagtgaattctgggaggtcttctgaaggaaggatagaggatgaaaccactctatgacccaaccctgcgatggtcattcaacagtatttattgagtgtctactgtataccaggtattctctcatatactgcacatacaacagagtggacagggaccctgcctcatggagtttaccatttagtaggagattcagaccaaaaactaaactaaaataaaaataggcaaacaaataaaattacatcagaccatggtaagtacagcaaatgaaataatctgtggattgaaacagcagtgtagagaatggggtgaatggggtcacatactttaagatggagtggacagagcaggcctctctgagtggttttaagctgagacttttaagagttaggaggatatgctcagtgggaagcaaggagttttagatagaactgtggagcaaaggcaaattaaaatatgatgccttttcacattcagattggcaaagattaaaaagtctgaaaacacccatttttgatgatgttgtagggaaaaggaaaaccttcatgcccagtataagtctgtacaactactctagagaccaatttggcaatagctagtaattgtgaagatacaattttgtatataaatcctagagcaattattcttaaaagaagttttaaaaactatctatccccatgacatttttaagctatcataaaacttttcctttataactttaatagttacaaagataagaattttttacaaattacaaatattgatatttaaatatgaaactcttacatcattctttcaaacatatttaataatatatccaatggaattgagatcccacagcaatttgatacattacatcatccatttaaaaaatacatgaacaagctaagctctttctcaattcagaaattttgcatcgttcctttttctccttgaactcagatttccatctacttccccccaaagaattgtatcttttatcttgaatgtcttttattgatcacaatatcatatttcttggcaacaaagaaaactgatataagttaatttaaaatatatgtatatttaccatgaccataaggccaagtgttataaaatttcttctgacttattattttaattatttctggtatataatcagtcaaaacaatataagtaattccatgttttgacaattattaaacatgaaggtaattttttaagaaacatatatcttaatgtgatggaagagcttgatatttttcaattaattcatatatctgaggacaattattactagaataatgctaacgataaaatgaagtgaaggatttgggggtcttacaaaggtgtattagtgatttttaagcaccttataagtagaatatacatttcttttaagttcatctaaatattatagatgggttgcaataaattttaaaatgaatgtggatttatgatatccaaaaatatttggggaaaaaatgaaatacttcttttatgagtctaattaagtgttcaaagatatataaaacctaacttatgaccagtatatatatttttacttgaacatgtagctttgatatgttggaagtaaaagtgaaattttcacaactaatctattctgtctcttatagatttacctattctgactggttcatacaaatggaataatataatatgtggtcttttgtgactggcttctttcagttagtgtaacgttttcaagggtcatccttgttgaagcagtactccattccttctcattccttttattgttgtataatattccattgcgtggctataccacattttgtttatctattcatcagtctatgaatatttgagttgttttcaccttttgactattgtaaataatactattctgaacatttatgtacaagtatttgtttgaatgcctgttttcaatttttttgatacatacctaggagtagaattactgggtcttatgtaactctgtttaaccttttgagaagctgccagaacattttctgaagtagctgcaccatttgcactcccaccagaagtgtgggagtgttccagtttctccacatcctgaccagaagttgttattatctgacttcttgattataaccatcctgctgggtgagaactggtatttcattgtggttttgatttgcatttccttggtgactagtaatatgcttattgggcttttgtatatctgctttggagaaatgtctactcatatccttcgcttattctttttaattcattgtcttttgagttgttgaggtttctaaaaaatatattctagatgcaagtcctttatcaaatatatactttttaaatatttcctctcattctgtgggttgccattttactttttgataatgtcctttgaagcatagaagtttatatttttgatgaggtcttatctattttttcttttgttgctcatgcttgtggtgtcatatgtatgaatccatttcaaaatgtgaggccctgaagatttacccttatgttttcttctaagagttttatatgttagcttttataggcttttgatcaactttgagttaatttttgtatatggtttgagataagggtccagtttcattattttgctgtgactatccagttgtcccagcaatatttgttaaaaagactattctttccacattgaatggtcttggcacccttatcaaaaatcagctgaccgcagatacgtggctttatttctggatgtttggaaaaactcaaactgtttttcctctactctcacatcaacataacagcagccaacacagaagatttctgtgacctcaaaatatgtggggatatcactctaccagcaagcaggcaattagttctgtagaagacacctgctgggtgtcctccagttcaattttacttcatctttttcgagatagtgtcagatcccacagattgtgggctcaatccccaagattgccccacacctcagacaacagtcacaagtccaggcccctggatcttctgacagaccagctttaagttggggttcccacaaccctctctttgggtttgactactttactagagtggctcacagaactcagggaaacatgtttactgattattacaaaggatattttaaaggatacaaataagcagccagatgaagagatacacggggtaaggtctggaagggtcatgagcacaggaactctgttcctgtggagctggcacgtgctaaccttccaacacgtaaatgagttccttcctgtcagcctccacatattcagctctgtagaagccccccgaaccctgtcctcctaggcttttatgcagacatccttggatagacaattgacaactatgtagaaatgtgactggacaaaatggatatgatctaatattaataaactgagtggggaaacccagcaagacctgtttgttcacattcttctcgcctctctgtgcagcatttctttcttcaggatatgaggcaggaccctctctggaatgagggtcgtatagcccaacattcagagtagagtcctgccttgggccatgaaaagagggcaggagaaggtcagaaagagagagtttttttctgaggcctaaagcaccccgacattatataacaaatgctgtgggagttatgagccagaaactgtggacgaaaaccagtatatatgtatatcataatatcacacaggacatttaatcgatttcattgatctatatctctctgcttatgtcaataccacagtctcatgactaatattgcctaaaattttgaaatcagagagtgagtcctccaactttgttcgttttcaagattgttttggcaattctggattcctggcaattccatatggattttaggatccacttttttacaatgaaatcagttgggattctgataaggattgcattgattttgtagcgcaatttgaagagtattgccatcttaacaatactgtcttctgatacatgagcgtgggattttttttttccatttatttaggtcttaatttttttctattatcctttgtagttttcagggtatgagttttgtacttctttcattaaatttattcctaatcatgttattatttttgatagtattgtaaatgaaattatcttaatttcatatttggattgttcattccaagtatatagaaatacaactgatttttgtatattgatcttgtactctgcaacctgctgaacttatttgttccaatagtattttaatgaattccttaggattttctacatagaaaatcatatcatctgtacatagagatagttttccttcttccttcctaatttagataactattattattgtcatcgagatcttgcttaattgccctgactagaacctctggtacaatgttgaatagaagtagcaagaatggataccttgtcttgttcctggtcttaggggaaaagcatctagtctttcaccattaataatgttgtcagctttggttttctatagacacactttatcaggttgctgaagagcccttctattctttctttgttgggtgtattagtccgttctcacgttgccataaggaaatacctgagattggacaatttataaagaaaagaggtttagccaggtgccatggctcacacctgtaatcccagcactttgggaggccaaggcaagcagatcccctgaggctggaagtttgagatcagcctgaccaacatggagaaaccctgtctctactaaaaatacagaattagctgggtgtggtggtgcatgcctgtaatcccagctactcaggaggctgagtcaggagaattgctttaacccgggaggcagaggttgtggtgagccaagatggcaccattgcactccagcctgggcaacaagagcaaagctccatctcaaaaaaaaaaaaaaaaaaaaaaaagataagagatttaattgactcacagttccacgtagctgaggaggcctcagaaaacttacaatcatggcagaagatacctctttatgaggcagcagaagagagaatgagtaccagcaagggaaatgccggacgcatataaaaccatcagatcttgtgagaactcactatcacgttaacaacatgggggaaaccacccccatgattcaattacctcccactgtgtccttcccacaacacttggatgttatgggggttacaattcaagatgagatttgggtggggacacagagccaaaccataccatcccacccctggccgctcccagatctcatgtcctcacatttcaaaacacaatcatatcctcccaacagtccccaaaagtcttaacccagcattattccagcattaacccaaaaatccaagtccaaagtctaatctaaagcaaggcaaatcccttctgcctatgagcctgtaaaatcaaagcaggttagttgcttcctagatacaatgggggtacaggcattgggtagatatacttgtcccacatgggagaaatgggccaaaacaaaggggctacaggccccatgcaagtttgaaatccagtaaggcagtcattaaaccttagagttccaaaatactctgctttgactccatgtctcatatccaggttatgctgatgcaaaaggtgggctcctgaggccttgggcagttctgcctctgtggctttgcagggtacagcccctcccagctgctttcaaggctggcattgagtgtctgcagcttttccaggtgcatggtgcaagctgtcagtgaatctaccattttggggtctggaggatcgtggttctcttctcacaactccactagacagtgccccagtgtggactctgcatgagggctccaaccccacatttcccttctgcactgccctagcagaggttctccatgagggctccacccctgcagcaaacttctgtctggacatccaggagtttccatacatcctttgaaatctaggcaaaggttcccagacattaattcttgtcttctgcatgccccaagaccaacaccacctggaagctgccaaggcttggggcttgcaccctctgaaggaacggcctgagttgtaccttggccccttttagccatagtcggagtggctaggatacagggcaccaaatcccaaggctgcacacagcagggggggccctagacccagcccaggaaaccgtcttttcctcctaggcctccaggcctgtggtgggaggagctggtgcgaagctctctgacatgccctgaagacattttcctcattgttgggtatttgcatttggcttctcattacttatgcaagtttctgcagagggtttgaatttttctccagaaaatgggtttttattttctactgtatcatctggatgcatatttttcaaactttatgctctgccacctcttgaatgctttgctgcttagaaatatcttccgccagataccctacatcgtctctcaagttcgaagttccacagatctctagggcaaggacaaaatgctgccagtctctttgctaaagcatagcaggaatgacctttactccagttcccatcaagtttcttatctccacctgagaccactcaccctggacttcattgtccatatcaccatcagcattttggtcaaagccattcaacaagtctctaggaagttccagactttactacgtcttctagtcttcttctgagtcctccaaactgttccaacctctgcccattacccaattccaaagttgcttccacattatcaggtatcttaagctatgccccactacttcaataccaatttattgtattagtttgttctcacattgttataaggaaatacccgagactgcgtaattaataaagaaaagaggtttaattgactcacagatctgcatggctgggagggcctcaggaaacttacagtcatggtagaaggcacctcctcacaaggcagcaagagagagaatgagtgccagcaggggaaatgccagatgcttataaaaccctcagatcttgtgagaacttactcactatcacaagaacagcatggggaaaaccaccccaatgattcaattacctcccaccaggtccctcccgcaacatatggggattgtggagattacaattcaagatgagattttggatggcgacaccgccaaaccgtatcattgggtgtgttttttttctttttatgaaagggtattggatatttttcatatgtttttttctgagcctattgagttgaccgtatgagatggtcatgtggttttaattttttattctattgatgtgatatattacattaattgagcttccctaaactcaagtaagccatactaggggacaatacaaagctcatgctacagaaaagcatatactttacatatattgaccatacaggtctcttttcaaaaacaaattaacttttgggtataaaaggaaaactgaaggaatagcatcagttgggcacatttttgtgcaagtcagaatagtttttatgtttccttctcactgatcgtctactcagaatttaaaaaatttttcaacttgtgatttgctttactttttatagttgatgatcccaggtattttcaataatttttcaagcaaccaccataaaattgtattttggactatatcacattattcggtttttgtttaggttttagttcaaagcaattaaataaataggaagtaaaatatacacacgggtcttttaaaaaatcaactgtactctttgagcatgaaagcaccactcttttttgcactattttgggcataaatgctgatgatgtacttccccttttcttccacagttaagggtccacccgggagtttacaactatattcagtcccggaaatgttctcattctcttttctagcctctgatataatctcttagcataattggttcaggaatcatgttaagtgggcccagatcatgtgtttcagcctgttaaaggcaaggtatattttcatttcctgagaacagattgcagcctaggtcccaaccatctggcactttcttgccattgcttgccaagtgctatgggctagagaatgtgggcagttgaatgcagtcagtccctgttactggacaactgaccacagaggacttgtctcaggaagagtcgtcctcatgaacacaggacactctgttgtgactttgagttcttaaatttcactggaatacatttaggtaaggtaaacagttatttttaaaatgtattattcagggatcacaacagtgcttttagggattaaaatagtccaaacagcctgtaatttcagggtgtctaagatccacatagaattagcatatcgagctggatataaaaatgacacataatacaacagccaacaatgtttttccccctccaaaaaaatggtgtcctccagattccatctgctttgtttgtttgttttgggagaaaacataagtatgatcattagaaaagaatctataaccctttctgaaagagaagataatctttggtctctagaaacaatagctttgcattttaaaaggcatgaagtgaaatgtccttatactctgttggatttgggaagcagcatgaaatagtggttaagcttatgactccagagttagacggtgtgacttctctgtacttcagtattccccatctgttaagtggagattaaaatagtacctacctcataaaggaaaaattaaattagactcaggtagagagcttaaaacagtgactggcaagtaagtgctcattcagtgtgaactgataacggtggtagtagaaataggcacactatcggaagcttaagaccgatttgatgtaaagttaatgaaacgaaaatcagtaacagctaatataatttatttattagtatgtatcagggctcgtattttaaaccaccttatttttaccctcaggagtgaaccataaattatttagtttcttcagagaattctgattatcaactcacctgcaaagagggcagaggagggaaaaacaaaagctctgttgggctgtaagcatagtttctatacacttaaaaacactttgggaaattatagctgttcacttttaggtcactttggcagttgaaaccatagcaatgatttctagaaggctaaaggaaaatctggtactgggttttaaaagttgactacctagaaactttggtgaaatacgtaatcatctgggtcctagagagctgtgtgatgttgcttcttcctctcagtcattccaggcttttctcttccctagttcggccatcagaaaaaccagcctgacccatggaaaagtcacatggtggccaggaaggaagtgtgtgaggttcttccctataacatccggttttccatttctgacagttagcagacggattatgctcacactttcacttcttgtaaccagtcatttccacctctagctaatggctttctttcatacatgtacatctttcttaatgcccttctctttccagattttgccactaatctcaggaaaattttactttatcaccttgctgtttatgggagtaaaacaaaaaattttaaagaacacaactcatgtatttcctagagatatttctaatgaaaataccccccagcaaactgaggccagcaatcttgaaagtgttcctaagttcctttgccagagttcagctcctccaaactaaattgccttttcaagcactagcattcaggataaattttaatttaatctaatttattgttttcctgatttcaaggcatatattataataatttttctacatctgtgtgttagaagcatataggatttttgtctctattgtgaactcattagcctaagaaaatacattctgacttcttaataattataaagattatttttaggccgtgcttatgagaagattggcacttatctgtatttttcttatttgactcctaagtgtttatgtttcttaccataatcaagaacagtgtgaagttaggtattcttccattatatgagtccttcacataacctttggaatatctttctgaattacgagtatcttttcagtaattactttctttctattgttaccatttatattgatttaagtactatttccttaagaatttttactattgcagatttgtggtctaagtctacttggaagcatggcatttgagagctggatcatctggttcaattatctcatgtttcagaggagtaaattgaaacccagaaaggttaaatgattcgcttaaggtcacacggtttaggtagaggcaggggtcattgagacttgagaccagtgctctttctactaagtcttgcagattaattttcaacttgacgtacaagtaacagaatatattctgataattacctttttcccaaaaatgctaggaatcctggaaaaagatgaccttaagaattgattatccattaatcaacttttctgttgttgatctgaaagcattttttcactagactgtattttcctttaagaaattccaggttgcttatgtaaagtttgttactttgttgaagcattataatttttgaaatttattaagctatgtgaactttaaattttcctcttatgatttttagacaccattgtggcttctcatttttaatcacttcttggtattatttactctattttattgggtagactttctccaagagcgggtaaggacatcttgtacccttataataaccacagaaaagtattgtagtgtagagttccagtgtgtgtgaaaggtcttagggattatggagctgtttcaaacaagattgaaatagtgtcaattatattcagattttaatttataaaatattaaattgaacagatttactttaattatgatttttaaagacaagcaaagagtgtattataaaaatgtacaaatttatcttacccaaataagtttataattcaaaataagcaggaaccatggtttgtgtttctctcacttcgggcccttgctaattgtcttccatctacttaaatattctgtattcctatattcatcaaatcctaatgaatctgttagacttgtttctcaacttttccaccttttacttaaaaatattgtcctggccgagcgtggtggcttatgcttgtaatctcagcactttgggaggccgaggcaggtggatcacggggtcaggagatagagaccatcctggctaacactgtgaaaccctgtgtctactaaaaatacaaaaaaaaaaaaaaaaaaaaaattagcaggcatggtggcgggcacctgtagtcccagttactcgggaggctgaggcaggagaatggcgcgaacccaggaggcggagcttgcagtgagccaagattgcaccactgcactccagcctgggcgacaaagcgagactccatctcaaaaaaaaaaaaaataacaaaaaaaataataataataataattgtcctacattagacaaaagatggaaacaaccaaatgtccattagtagataaatgaataaacaaaatgtggcatatacatacaatgaaatcttattcagccttaaaaaggaatgaaattctgatatatgctacaacatatatggaccttgaaaacattttattaagtaaaatgaccagacacaaaaggatatacattgtatggttccatttatataaggtgcctataataggcaaatatatagagacaaaaagtgtttacaaaaagcttacccagggcttggggagaggagggatggggagttgtttaatgggtatagagtttctgtttaggattctagagatggagagtagtgatggttgcacaacactgtgaatttacttaggccactgaattgtacacttaaaaatggttaagatggtaaattttatttttgtatattttaccacaataacaaactactgtcctgagttagccatgaaatgaaataatagctctgagtgtgcaccaagaagggactcagcctcctgccattctgaatggccacttcatcctcatactggggtggagaaaacacagctgtgtttacttttccaaccccatcttctattttgaaatataaccttttgcaagtgagagccaaggtcaagtgacacagctttctgctcacctcttcagtttgccaaacattgtttttctagtggagttctgggttaggtgcagcaagtgtgagtaacactatcactcatacgcccattggaatttaattagtctaccctcataatttctgtactcagtttggtatgacacatttccttactttcatctgtatatgaaaacacacagttgtgtattcaccaactatagtgtttccaagtatgtggattactctatatatcaaattcaaattacacagaaaataaggcttttcttctccaatattttcccatttcttgaagaattatttactttttgagattagagagatgtttatacatagggtgaacatgagcaattctaagtacatactaagtattagatatttatgtttttgtataataattgtagaaacagtggcaaagcatacattttcagcatatattaagagcagcagaacagattagtttttgtgctcagacaacagccttaacatgaaataactgtattcattgttgtttgtcataacatttaattatttgttcttaaaaatatatatcatacttaggttatgagaatggcaaatgttcattctatcaaagcacacaccaaaaaatccaacatgcagctggtacttaatatttttagatttactttcttcttgtatttttgactgtatcttatgccatttatttgcattcagtcgatatcatataagtgatgtcaatttatttatataaaaacaaattagtataatatatttatattttcttaccaggtttaaaatggaaagtgttccattttctttcttattgtatatgtagatgattgaagtactttatgtttcactgaaatgagtattattcccttcagtgaaattaatgttcagcaatgctgaggagatgggcaagatcatttctcattgttttccttttaaattatctggaaaaaatatgatcttgttgcattacattctgaagaagttgaatagatacttacaataaataaggctatataaatgggaagttaagtattaatagaatccagtgtgactaacaagggatatcaagttcttcagacctgtggtatacataataagcttgaagaattcgtgcacaaaagtcttaactgttttgcagccttggttgtggttagatgctgtagttttctaagctactacatgttgtaaccagcttggtagatttaacctagtaataagatgcttagtttaactgttagtttaaactcagtttctatagcggcacagtctttatttttggaccttcactttccaatccagatgacacttgtccataaagaaattgctaaacttgagacctaaaaacaaaacaaaaaacaaaaaaactacagacaagtaacctttaaaattatttcgcttgatggaaatttaccggaaggctttaaccaattcagtttgcttagactcataaagaaaattatgataatgtctaggtaaacttcagtaaaacatttttttgtgaaattatactatagtacataaaattgaaatattgctgatttaatgtaaaaaaaaagaaatcagcttggccaagttggattaccttgttagagattgcttatgtaggtggcatcgacattgttacgatctggacacaggggatacatacttgttttatagtctatatgtgactgtcattgacttggagtatgggacagggagcattggattttaagtcagaagacccaaagtgtaagtctctgccagttagtggtggtgtgatagtcactaacctctgagcctcagaagattagaatgaaataatagcttccctgtcaaatttagtgagttgtgaggttcaaattaaatacatgtgaaactactttgaaaactgtatagagcaccatacaaatgttatttgttatttttccaaggttctgatgagaacttttctgatctcttagatctaactgagttatcatgaaactttgataaaattgtaccagtatgttgtttcgtatagtactatggggcatgcacatgttttaaacccttagtttgttatattttaaatttccagatcatttaacatttgctttacttcggtttttgttttgtgttttgttttgttttggtgtggttaatgtgccttttttatgtaaatgggcagtagaagttggtgggggtcttaagtactaataaagggcactctttttccttcttgcatcaagagccaatggagaaataagatcaaagagccaccaaacagagaaacaagatacataaagctgtgggtggatagtgtaatagctaagatggacttgtgcactcccactgtcccatgtctacatctgtggggaagtttaaggcaccacaacagactctccctttggccactttttttccccagtccaagtagagagataaggagaaagagactctccctgggccttaggatattagggtttagcttagcccacctagaaatacaggcttacgcctgtcatccactgtgataagaagaaatatatatctggtctttgtctctggttcctgacactgagcttctagaacactttgaatttcctgagtaataggggtgagaggagcatcttttgttatccataacaagttcctttcaaccatgcccgattttatgcagtaaaccctctattgacatcctcgataggttcttggaagctacaactttaagcaaaacaacatataacaaaaccagttttactgtaggttgattgatagaaataagagttaagttgctatggtatatttgtggtcacaaaaaatcaccaaacttctaaataaagatcaaaacacttctaatagtaaacactgaaataaatgtgagctctacatttagaaatattaataaagacaagtaagaacattactcacccagttatttgaatttggacttgccagagcatatcccagcagctcagggtgtgagggggtacccagagctggacagggcaccatcccatcacagggcacactcatacacacccacactcaagcagatggggacaacgcagacacgccagttcttctaacatgcacagcttggggatgtgtgaggaaaccagggtacctgaagaaaacccagctagacatgaggagaacatgaaaactacacacacacacacacacacacacacacacacacacacacacacacacagtggcgtcttgaagaattgagttttttttcttatccatgttgtaacattgaataaaaacaatgttatctgaggacccactgtactaatgagatggctcttggtggtttctagatggcatcagaatgaaggaccatttgccagaggaaccaaccatgtaattagagggttggaaccatcagacccactccttaacctctgggaaggaagaagagctagagattgagttaatcaccagtggccaatgatttttatgcctatgtaataaaacctccataaaaacctctaaatagtgggttccaagagtttctggattggtgaacacattgaggtgctagaagggcgaggtcccggaaggggtgtgggagccccaaactccttcccctgatcttgccctatgcatctcttctgtttgactgttcatgagggtatcctctgtaataagccaatagtgtgaagaaaattgtttttctgggttttgtaagctgctctagcaaattatcaacctggaggagggggttgtgggaatccttgactttatagctcgtcagtcaaaagtacctgtgacctgaatttgtgattggcatctgaaatgggcgcagccttgtgagactgatccctgaacctgtggggtttgggctacctccaggaagttagcgttggaattgaattgaattgtagaacactcggttgttattcggggagttggagaattggttggtatgaggaaaaagcccatgtgtttagtgtcataagtgttgtgactaaaaacaatatagacccaccaactaggtaactcagcctacctccttggggaggaataaggggtggaggagaaggccagagttccttacagaaaaaaatccctgtttatggaaaccagagaagtagatatgaggcttttcctctaacagaggtgaacagcaattaaataaatggaattcacctgcccatccccttgcctaccctcctttgcagctctcatctctgaggctctccttccttttcagtacctacctagtcctgccaccctgttgctgttcatgtccattgtccccaagcataggctacaccacagcccctccagattataccatgtagctggagagaaacactgattcctgggagagaagagttgtgtaaggcaggttggttaaggggactttggagtagatgaggggactttggagtagatgaggctagctcagtgagaagatgggtctgtaggaaaaatctttccccaacaatttcatctacattgtggcaggaccccattaaacttcctttaggagatgtatttgtaaagctgttcatttggcaagtcaaggaataacttatctcatgcttgaggaaatggatgtagctggagtcacaaaccagtttatctctgcatttaataccatccatagtttatcatgttggtgataacgggcaaaatgggtttggtaaaatcttagaaaaacaaagaaacaaatgcaggaattgagggccaacatcctaattcctaacttatttagaagaaatgtgaatataaaatttatgaagagatttagattattcagtcattcagtaaacatgtattgattatctgttatgagccccacattgtgctggctgggaaggaaatgggaatgaaagctgtagtccctggctttgaacagcccgtaggtttgtgggggtgacagggaattctagtcgagtgtgatgtgtgctgtgagggaagtatgcataagctgttaagggaacacagggatggttacttggcccacgtttggggagttagttggggaagtctttctaaaagaggcttgtgtgacctggaagggcaaattgaaataggcaagatgaagggagtagaagagaggatgtcttaacttaggtttaagtaattcaatgagccaaggctcagaactaaagagaaagtgtgtgtacacacacatgcatgaatctacatacatgtctacttttgagggagtggaaagcagtaggcaccatgaaaaggtttggttaacagcggatagcttggtatggatgcagtaaagagtttaggaataagagtacaagaaattggaggggtaagcaaggccaggtcatgcttgtgtgtcgtgataaggagtttggtcttttttcaaaggcattgaggaatgttaagcaaggaagagaatgtgttttatatgctacaagtggtagggagagtgtagtgtagggtagtaaagctgtacatgggaaactcttgcagcattccaggaagaagaccttagtatcctgaatgaagagaatgacatgaacctgaagagaaatggatgaattaggggagatattaaaagcagaaaagtcaataggactcagtgatttattgcatggaggaagtgagagggagggaaacgtcaaagatgatacaggtttctgtgctgggcaactatataggttctcttcactgatagagaaaatattggaagattggaagagcattaagtttgaggtaaggttaaggtaaggaagggactaagctaagagccaggtttaaaacatgttgagtgtaagatgtcctgtggaatatgcaaaaggaaatgtataataggagttgaacatatggatcaggaactctagagagaaatccgagtttgagattggtatatgtgcatgtatctacatacatattacttttgggggagtggaagagtggagcagtaggcatgctccatatcagataagctcatccgaagaagtgtgttgagattaggaagagtaaaggaacagaaatggaaccctaaagaacaccatcacttgagaaatagacaaaaagaataagcagctagacatgtagaaaacaaaactaacaagtgtaccgaagccaagaactaaaaattcagagtcagtagcagtaagtgctacaaagtggtcatttcagattagcacttccaaacattttctgaatttagcaagagagtgattattagtaacctttgtgaaagcagactcagtagaggggtgcaggcaggaggcaggttgcagtgggtgagggaggcatggcagacagtgtgtgccaacaatggtctcagcctcgctgtgaaaaaaacatagaaagatagtatgggagttaggaaggtgatattccaataggcaatatagagttgagtcgaattttaaaaaatggttaattgcttctaggaaagattagcaattaggagactccccctaattgatgaagccatgtccttgaagagtttgcactgggtggatctgcagccctggaagctctggggaaggggttggatacaaatgcagatacatttgttggggggtagagcagatagaggagatcctcactcggtggttgctgttttctctgtgaagtaggaggctggcccacctgccagcagcgaggaggaagctggtgatatagggctagaggagagaagagaaaggggaaatgtgtgctgagaatcatgaggcgggaaggcctactgggaaaatatgagctgcctggacagcttacggttggagtttatgaatttctataaagcaactttaaaacaatttttaaaaaatcactgaaacagccttttgtgttttcaaaaccagtattaaataggatcctgcatttaacgcactatttcttgcctggttcctttcctgaagtgcttctctttcctctttccaccgcgcccccactctagttggctagtagagaagatttttccagcttcagacaaaccacttttccaagaatacatggaacagattacagaagcaagtaacagcctgcttacttccccttctgcacttgtatgtacgttcagctggagttctgaaaagaggaagtcgggagaacatttttttctttttaaaagaaagattggagaaccacggagcacaagcaggtagaaatattgaaggaaagagaaagaagagaaaatggaaaaaatactgaaaaaaaaaaaatcatgagccagaaggtaaaccaaaatgatgtcagagactaggaaaggaacagagaaaataatctgccttctaacctagcctcttagtttgctactgaaatacagcgttcttgaactggagccctcacttctaggcaaaactaacacctaggccacatggagatagaaatcttctgtgaattcagcttctcccccctaatttctgtatcagtgacaacatatcctgggtttttatttctttctttgacctaacctttcaattttaaaatcaagtctgagtgcctagagtatctgaaaaagaaggggaccagatctagtgccattcaaaaacatttaatgagcactttgtatatataggtgctgttctgggtactgggaacttggagaaaaagaggaaacaatctttgccgttgcaatatgatttctcccaagtgaaaggagactattgcttaggaattacataggtgcaggacaccaactctcaggcatttaatagctagacagacatttattagtgaccagcttcttataaaaaataaaaagcttgagtactgccttaactgtgccatagcttatatcaccttctcctaacctctgtcccctgatgcttctaactcagatttgcccctccacctcaccccacagtaatgcaagcagataccagctgaagccagaatagaatggatagttatctagggagataaagtgacagtgttgcttgttcaggctattgttcaaagaagcacgtcttttatttatagacattagaatttaaaggcatagacagccagagcttgatattacctcttctttttgtaacttgttttctagaaatatgcttgatacagctaccttctttgcatgtaaattgaatgtgttggaagagtgttttatacctggtttcatgttcttttaataggttctattgctgttttagttaaggctggtttctaaattttaatgcatcaatattttgcttttatagcatactactttatctctgtctgaggcataggttgcagaaaaaagcaggaggttttaaaagaagccaaatatagatgactttcatattaataaaatattcataatttagttggatatagctaagtagatgaggtctccaattgttagtgcgtctgcaaagttggcgcctcctaatagacttcatggtggttactggaattttgtgccaggaaaaatgtagttgtctgttcttaaacctgaatttccttgctttcaaacacccaagagcgaggttcacaaggatgccactaaccttctgttgctctggggaagtgacttcatttttccaaccctttgctgaaaagtgttatatgccttgtattcttggagtgtgttttttcctaagctctgagaagatttttaagattgaacctcatgaatttttacacccctctgcaagaaagggaggaacagtgcctgtaaacctctttgaattacttgaaataaagataatagaatgtaaggaatgaaaataaatttggccagtcaattttttaacaggttaactgatgaacaagaaatagtttttatacaaacatatgaaaacagcttataacagcaaactttatttgttgtaatgatataaataagaatattaactttctttgtaagattaaaaaaatctgacacggtatgctcatatttaaactaggtaagggcaaccgctaataatttgaaaaagaagtattaaagctaggtttatgaagaaactatactcagaaacattatgatagcatttctgtgaacaggattcatcacaaaaataacaaatacgctttatgaacttagtatttgaattaattttctgaaatttggctattaaccaaaaggttaattgagtcttttcttcttgctctattgtggttaacatactaattcttcccattaaagacccattttattatgcaaatgaaaaaaatcacaagactttgtgtctaagagaaagctgcttttttggaggggaactcatgcacctgtttaaacccccagcccccaccactgcttccattggctgccagacttagtgatcaggtttataggctgtagggtccttgaattttgactcacattttctttgtgacttactcttgttttggcttatatttctccccttccagctctcagcatgccaacagcagctgcatcatggcactcaccctgctgccaagagggcaggcagcctccttggagactgtaatgttgcactatagccaacagttaagagatagatgctggagtaatacttacagcacagctgaaattcacatcatcctaggaggcatttggtggaacactttgcccatcgtattgttaaactaatttttaaaaacttaattatgaaaaattttcaagcttatacaaaggtggaaagaatactatagtgcattcccacttaccttcatgtctgtttcaataattatcaactcacagacaatttttcactgtccacggtgtttttcccatggtcttatccagactgctggtagattcatttccagggataaatatatcttaaactagagttgcttttccatccttcttcagcctgtctgtaagatctgtcaccttaatgattttctcagtcctttcttctttaaggtacaaaatattagcatcttttttcttcctaaattaagccaagatatgctactttaataactgttatattttctaatgctgtaccctaaaattgttgaagcactgttcattcagtcaatcattctatccaaagcatgtctgaaatgtgcaggatcttggaatatagagctttaatggtcattgggtttgattatcagtttcaccactgacaagctgtgtaatctgggacaacttccttaacctctctgtgcctcagtttcctcttgtctttaatacgggactaataggagcacatacccttacaaggctgttgtaagacttaaatgagcaaatacatttaaacagcttagatacagcctgacacagtgttccgtatatgctagttgctgtcttgtcatcattgtcatcctagttgtcttcatcatcttcatcttttgtccctcttcactcattttacataatagtgggttgaggctcaaatgggtaaagcaacccccttcaggtcagatggcagttttatcaggataacttgaatgagaaagcatgtcccaatttttttactgtactagatatagtttgatacattcttgtcctcaaggaattacgttctcacaaataacagagaattgtcaaaaaaaaaaaagaggattaataaaaatatgaggaataaatattgctgctggagagttaagccttaggcactgcgtgtttcaagaggaagagagagaacctcagctgctggggagtccttgccacactcagtctcccaccacatcaagaatctcccctccgcagttccatgcagacctccgaaagaggagggggccttcatgtcccatcagtaaagtctgctctactcagccataaaaaaataaaaaataaaaaataaaaaaaaaaagaagttgtgtgtttagaaagcaaaatgctacaggtaatgtacaggcatacctcgaagatatttcgggttcagttctacatcactgcagtaaagtgaaaattgcattaaagtgagccacataaatttttttgtttcccactacatataaaagttatgcttacactatattgtcatctattaagtgtgcaatagcagtatgtctaaacaaatgtacatgtcttaattaaaagtatactgagctgtctcagggaagtctgaggagaggcagataggggaatggccaactagttggtggaacaatcagaacacacacaacatttatcagttaaatttgtcatcttacatgggcatggttcgtggcactgcaaaacaaatacaataatagcatcaaagatcactgatcatgcctcaccaaagcagatagaataacgaaaaaatttgaaatattgtgggaattataataatgtgacatagacacacaaagtgagcacatgctgctggataaatgactccagtagacttacttgatgcagggttgccacaaaccttcaatttgtaaaaaatggagtatctatgaagtaccgtaaagcaaagtgcaataaaagaatgtatgcctatacctccactttagtgcagaatgtgggatgtcaggaatgcttttgtttaaaaaaggagatgatttcgctaatgaaactctagaacattctatacacaaccaaaaaagaaaagaaagtttgagtgggatgagactaccagatctagggaacatttacacatgagattaagagagaaagcaagaaataaaaggagagggaaaggtattatttgaactaccagtgagtgtcaaaagagatgaatggattctaaacttcatctaaacccaaatgggatctggcatttctaaaatgttatttattcacttactttaacctgtgccgagcactgttctgcttacttataaatataactttatttaatccttgcatttaacaatcctatgaaatagctaactgttatcaatctcataatacagctaaggaaactgaggcacggagaagttaaatattttgcccaaggccatttgcttattaataaacaagagacctgggatttataccaagcagcgtggttctggaatctgtgctcctaaccactttgttctcctgctcacaggtgatcaaagccccggtgcatatggaatcttgaggttttatggtgcacccaaacgttgcttccctttcagtttttctatataaaccagtgtatagagaagccctttaaagagaatagaatggtggtgtcattactcatacctgcactcttggctgacccgaggataattagcatggtgagtcccaattagatttcaggagacaggatctgcccactgcagatgtacatctttataacaagctttatcataatagagtatgattacatttgttagttgcagtcctaaaacagtactctggtgttattttcacatgaaattataagaccactcttataggcatgtgctttttaactttactaattcgaggtcatccactaaaaaatatttcttgatggcctctgttttaggtattggagatgctttgtgacgagttccttctctataaattctctatggattttttcctttcttatgagctgtttcttattagcttataaattgtcattatttctcccaacttgaaaaacaaaaatcaaaagaaacttttcttgactacacatccctttttaactactggcccatatatgtttcttcatttacatcgtaacacctagaaaatactgtctgttctaattttctctccactttctccaccagatctcgtccagctgcagattcaaattatatccccctgcctactaacagctccacctgatgtccgctaggcactgaaacttccaaaacccaactcttgatcttcccacccattcctgctctctggtactctttcccatccctataattggtgattccatgtgtctcatcgctcaggccaagagctttggctttatccttaactgtgctcttgttctcatatccccaccgtccattccatcagcaaattgtgttccttttacccttaaagtctatccaaaatccaaccattttatctcacctttgctatccctgctctaatcgacttcataagtaatctgtcattcccagctatcttcccacttctttccccggccaccccacctctactatctgctgtcaacccagcaaccagggtgattattttaaaacatcagtcagaatatatcacctttccaacaatatgttcttcaagatttttttcatctaacatgcaacaatttagatgaatctcatccacataatgttgagtaaaagaagccagaagcaagagttcatactgtatgattgcattcatttaaaatacaaaatcaggccgggcacagtggctcacgcctgtaatcccagcactttgggaggctgaggagggtggatcacctgagctcaagagttcgagaccagcctagccaacatggtgaaaccctgtttctactaaaaatacaaaaagtagctggacattccagcctgggtgacaagagcaaaactctgtctcaaaataatacataaataaattaattaattaaaaaacaaaaccaggtaaaaccaattctgtgttgttagaaataaggatagtgattgacaggacgggggttgattgtgactgcaagagaacaccaggagggcttctgggggctggtcttttctatttcctgatctgggcgctggttgctcatgtgtattcagtttgtaaaaatttagcaagttacacccttatgaagtattttgtatttttagtacagacggggtttctccatgttggtcaggctggtctcgaactcccgacctcaggtgatctgcccaccttaacctcccaaagtgctgggattacaggcgtgagccaccgtgcccggcccagaaaattattcttctcctttagacttacagtctaagaatttgtcagcatttataaccattagcatttataaccaaagacacaacgtaccagaatctctgggacacagctaaagcagtgtgtagagggaaatttatagcactaaatgcccacgggagaaagcaggaaagatctaaaatcgacatctaacataacaattaaaagaactagagaagcaagagcaaacaaattcataagctagcagaaggcaagaaataactaagatcagagcagaagcgaaggagatagagacatgaaaaacccttcaaaaaaatcaatgaatccaggagctggttttttgaaagattaacaaaatagatggaccattaaccagactagtaaagatgaaaagagagaagaatcaaatagacacaataaaaaatgataaagaggatatcaccactgatcccacagaaatacaaactaccatcagagaatactataaacacctctatgcaaataagctagaaaatctagaagaaatggataaattcctggacacatacacccttccaacactaaagcaggaagaagtcgaatccctgaatagaccaataacaagttgtgaaattgaggcagtaattaatagcctgccaaccacaaaaagcccaataaatctttattgagcagtaggcactgatctaggcatgtggaatacagcagtgaacatgagctacaaaagcttcttggctgggtgcagtggctcatgcctgtaatcccagcattttgggaggcaggcagatcgcttgagtccaggagttcaaaaccagcttgggcaacatagtgaaatcctgtctgtacaaaaaaatacaaaaattagccaagcatggtggcatgctcctatagtcctagctacttgggaggctgagacagggaggatacagtgagccaggatcacgcactgcgccccagcctgggtgacagagcgagactctgtctcaaaaaaataacaaacaaaaaccacgtaaaagtaagttttatataagtgagaaaaggcctcattgagatggcatctgggctagcgcttggaaggagataagggaagtagccctgtgtatgtctgggagaagagcgtcctggtctgagggaatggaaagcaaaggccctgaggcagaagcaggctcggtgtgcacgagcaagcacttgcaaggagcactagcaaggagacagtgggattgaagaggaataggccagggcacacgagctggagatgagggcagaagcacacctggagccagatggcgaaggagctagtaggcctctgtaaagacttgggagtttcattctgcctgagattgagggtcaaggggggagtcatttttttgcccaggctggtttgagttaggttccaggtgcttgtagtggcaggccattcatcttcattgctgtaaataaatttcagtttattatccattcttctattgattgatatttaggtgatttgcaagacatattaattgtaaagaaattgaacaagatatatccttttttaaaaaattgcgtaacttttatgacataacaggttagttccaatgacaatcagacaatcagtactcatggtatacattagagataaattatgagtacatatatattactgtcaaatagtaaagtgtgcaaggttgaaaatacaaagatatgccagatagactgcttgccttcaaggaccctatagtctagttggagataagatatatttgcatatggaacagcaatttgcaaggacacatataggcaacaccaaataacatcttaggcaatttgccccataagcattctgaaataggcaagatcactttgtactccattgatacaagattttatagggcagctgagaatttagcagagcctgaaaacgtacataggatttggaaaagcggagacagaatttgcagacattatctgagcaagggaaataacaagaaggccagtttgtgtttaaggggtctgtgggtggtcagtctgagttaaagtttaggattcattttaaagcctaacagagatttggatgaatgtaattctaaagtaaagtaaagagctgcgttcaaatctgggaatatttatatagcccacattgctcaatcattttgatgtattaatgccacatttaccgttattcaacctcaaagttcacaaggcctaaatgttttaaatgtatgtatttttagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatagagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaatgggtttgattgcattatttatatctgaatgcaagttgttaattctttaggagccaaaaagtttaagtatatagtttgtatagtgctgggaaaaatatacgatttcctcttacatgtaagttttaaggaataacattaaaaatggtaagatccctagtcctggcttaacaggactggagggatttgagagagatgacatgagcatttctagattgataccatcatcacaacatttagtaagggccaatgttaatgatcttcttctttaaacaaaaatattgtgaaaattaccatttaattttttattctgtatataaattaatatttctatgaaacattagaaatcaatacgtcaacttcattttacccaagataaaattgaagcctagaaagactaaatgacttaaatcacttagtgataaataaatgcctactttaatagtgttagtaattataatatatgataacaaagctgtatgatatggtgggagagagttcaggcaattgaggcagccagacagagtttgtaatggctccctcctttataagctgtggggctttcaatcagtcccctaacttctggtgccctcagttctctcaattgtgaaacactaattgttcataacttgtagcgttgtgttaagttataggtggtgtatgtcaaatgcctggcagcctaaagccttgcacatcatcggtattctgggaaagggattgttataattctcgttattgaccatacacacacaatactataatgaaatgcaaaatacatattaattgaacttcttgaagagtaacataaataaaacagctacctacgttaactgtagatccccctccttcccagttatttttttccatattaaataccttactatgagaaatattcctaaaatatgttagttgactgttctgccttaactaagaattccatagtgaacatttttttctttttctcgttattacagtctttttcctaatatatgttattgttgcaaagtactatagatatggaatgtgcaggtgattttactgaatcttatttatttatttgtgacagagttttgctcttgtcacccaggctggaatgcaatggcatgatctcggctcactgcaacctcctcctcctgggttcaagcgattctcttgcctcagcctcccaagtagctgcgattacaggtgcctgccaccatgcctaattttttttttttttttttttagtagatacagggcttcaccatgttgactaggctggtctcgaactcctgagatgatccacccgcctaggcctcccaaattgctgggattacaggcatgagccactgtgcccagccttgaatcttatttttagccctaaaatatattcaagaacttgcatgtatttttttcccaagctttctttaaagacatttgcattctttcctaaaaacagaatgagagaggcgattctgaccaatttattatcctggctaattaaattttgatcaactgaacttttaaaattgtaccattaaaatgttaacaaagccacaatttttattaacaattgcaaatcaaatccgtaatagttttttaaggtaaatattcattgacgtcaacacttatttttttcttctcttaaagaaaaatggtaaattcaaaacagtatgaaaaaattcttctaaaattcccagagatttcatttctcataattctaaatgacagataaggagaagcaaggaaagaatctcactcatgttctgaaaccgtagtacatcagactacctctgtgcctcccatggtaacaattgatcaataagtgaacactgccctcagtaatctagcaaagaatatgtttctttcagagattagtgcgttatcttattaattatgtcaataactcacacaaaatataagtttattggaaatgcagttgaaggatggtttatcttttaaagtttttgggaaatacaggtttattgacattctcttttgagcatttgtcccatattactgagggcatgacctaggtattattgggaaatctaaaactttcagaataagtccaattccattcatactacagtggcttgaaggattaagtattcttatgtttcaggaaaaggactctttttgccatatggtttggcagataggcgtgtgtgggaaagagagaaagaggtattgattgacgcagggaactctgtttcagtcgatgtgacaatatgtcagtcttttaaaaatttaaataaactttttattttggaatagttttagattcacagaaaaattatgaaggtactacagagagttcccacatacccctcacttagtttcccctgttgttgacatgtcacgtaactgcagtacatttgtcacaaccgaggaatcaacaccggtacattgcaattaactacactgcacaccccgttcagatttcatagttttcctctaatgtcctttttctccttcagcagcctacctgggatagcacattacatttatttagtcgtcatatctccttaggcacctcttggcttcaacagtttctcagactttttatttttgatgaccttgacagttttgaggagtactggttaagtattttgtagaatatttctcaagtggggtttatctgatgttttcacatggttagactagggatatcggtttttggagaaatattaaaaaggtgatacccccttcagtgagattatatcgtattgagagtagtataagctatagacatgacttattactgatgatgctgactttgaatacctggccaaagtagtgcttctcaggtttctccactgcaaaagttattccccccaacctttctatactctttggaattaaatcacaaagcacagcccacactcaacgagtgggtaattaaactccacctccttgaaaggcaactatcacataaattatttggaattcttctgcatgagagatttgtctcttttccccaatttatttatcaattatttatattagtatgaactcaggaatcttcaatctttttccaagtcttaatcagtgctatccaagagacatatttacatttttatgaaagtcgataaaatttggaacattttacatggtgcagatgaataccattttatgttggatacgatagtatattctatggtttcctcaaaatttatcttcctgttaatgtcaggcatgtatctccttagcttgccacaaataactatatataccacagaccttcctttgtagggctaacagtgttgcattgtaagtggaggcctcatagatacctggccttttcctaccttattccaaagatggttgcatcttataaataatgtcattcttcagcaaatggtatggaaatgagattgtaatgtcattatttcctctttaaataatcaggacaactcatgatacaaagagctcttctctataaaaggtgggacttttttttttagtaatagcaaaaataaaattgtacctccttaatcttctacagaaagatggatttcattttcaacattaagaggtagttttaagaagcagtagaagtcagcctgggcagcatggtgaaaccccgtctctacaaaaaagttagctgggcttagtagttgcaatcccagctactctggaggctgaggttggagatcatctgagcctggggaggtcgaggctgcagtgatacagtgagccgtgattgtgccactccagcctggttgacagagtgagaccctgccaaaaaaaaagaaagggagaaggagaaggaagcaataagaggaagaagaagaaggaggaggagaaggaggaagaagaaagaagaagaaagaagaggaagaagaagaaaggaagaaggaagaaggagaaggaggagaaggagaaaaagaggaagaggaagaagaagaagaggaagaagaagaagaaaagaagaagcagcaataaaaggaaaccaatcttcttttggaggggaaaagtgcccaagaatctcataattttacttctcattagcgaaagctcactgcatgctaaaaggtaaatttgatgagtggatctcattcagtttcctttgggaaagacacaatcaaaacaaaaaacaacttatttagtctttgcaagaaacttgaatataattccttgtcaagaatttacccaatcccaattttcacccttacaaaaaataaataaataaataaatgtcttacaatcaaagctaaagcaaaggataattgcatccagaacaaaccgtcagttgcccagccccaacagagagcttgcaagtcactacccaggccagaaagggagtcagacaacagagcatttcagaggtcagttaaggagacaggttccaacttaggactgctgccagggatgtacaatccagtgtctgacatctgggttctacagctgccaaatctgccccttgtgtggccacaggtgttggctataactctgaggcacattggagaaggaacagggtaatgtcaacgtcattgtgcatatgtgtgtttatgtgtatggtttttcttttaattttttcaaaaggtacataattaattttgttttaaaatgaatgtatttctacataatggctgggaacattcgggaggctagcaaagaagaagcttttgttcaagaacaagggcaaaacaaagctgaatttttacacctacagggtacattgtacgctaacatgttgtgtgtgatattgttaacttagtcatttgaataggccttctcaggacaaaaataaataaataaatggatgccgaaacgcacacaggcagttggtataagatgaaacctaaatactcattctcttcctgtaggcttctcccctcatccttcttttggatcttcaggagaatttgtgtttatccacacatatttttgagcctggaacagactagactgtatgtagtcttctatctcacactataccagttgtagccatcaattaacacagcttaaaacaggaacactaaactttcctcttctttttgcaggaaacttagctactgtctgtaaagcaaatctggaagtttctacctcaggtagctgtttgagtttcctaaccctaaagatgtaggcaaccctaaagatgtagaagaaatgaagatgatttagagaatggaatgatcccggtaagaaacttaaagaacagatggtcagtaggttagagaaaaaaaatacaggtctatagctccacaaattaattggatatttcttccatgttttgcctattccatatcctgaaattagaaattgaacttcaaggaggaggaaggaatctacatattttatgttcatattgaatcccttctaaagagaaatgcttcagtccttgggccaatgtctgtcctgcttttaaaactaatgtgacctgcagtgttttttcactgtatcctctatatattccaccagccaagatttctgacaggttatagtttgtgttttctattacaaagatcataggtaaattgaatgcactttttcaaagattaacccccatcccctatttcacttaacaatcagtgctctgactgggcttgtgcttagcacatgataaatcctcagtcaggatttgttgaatgaatgagtgaaccaatgaaatcaatcattaagttatttatacaggagatttcccaaaagcaaaggaatagaatttaaaaacttttgtcatttctccagccttgggaagaactgtgtttgtgcagttgaaaataatgcttagctcaccaggcctctacaaattgtgccttttatctgttttgggtattttccatgtttctcaggttgtgttttcctctgcccataatgactacgtatgtcttcatgatgagtaagagctgattctagacaatacagtgtatgttggtccgaggttttatctagctgccaagtttcccttgtgtgttcttggttatggtagtgtgtattcctgtcccagaatttattagtccgatctgacctgtccttgaaaaatgttttcctttttcatttgcttgcctccaagcacatttgagtatttttaatgaccttgtttttttttaaaaaaaggtttttccaggagcagtagtgcacctttgtttcagtactctcctacatcgctgtcctacatttcctactcagccagttctatcccttcgtcatacaaacatgtttagcgctttcctgtctaactccaactatcaactcttttttctttctctttagagtcgagcttcttgagagagtggtctatatttgtgcctccagtttcttactttttattcattgtcaacttctgcaatctgattttgcgtccctcattagaacctcccctgaactggtttatactcggcccacctctaaagcctgccaaatgcctttatctctcttttttttttttgaggtgaagtttcactctgtcccccaggctggagggcaatggcacaatcgcacaatctcagctcactgcaatctccacctcccaggttcaagcgattcttctgcctcagcctcccaagtagttaggattacaggcatgtgccaccacacctggctaatttttttttttttttgtatttagtagagacgggttttcaccatgttggtcaggctggtctcgagctcctgaccgccggtgatcgactcgccttggcctcccaaagtgctgggattacaggcattagccaccatgcccaggctatctctctttgaggcaattaatcactattgattaatcctactctcttgaaattgtcttccacccttgatgtctatgacaccttttctggtgttccttccatctctgtaaccattccattttagacctttggggacttgttttcacttctacttgtaaaattttggtgttcttcagaattctgcctctgcctctcttctctaccttttcttttgcctacataatcatatccatgtcttatctgcataatcaatcttcagcccagaactctctcaagttccatatccatatacataatttgctatcaaatatctcccttgacccttgttctcagcttctataacagatcacagtagctgctatttttatttgctctacactctttttcatctctctcccctctgcccactttcctttgaggaattctgcaccactttatgtagtcctgttgggagctgtgatacttatggccatttctataccacaaggtgataaacacgtaacctagcctagtccaagtatcatccatcaaccagtacatagattttaggagaaagaaacacctattttgctgggttactactgacagccatccttccctccatgtttcatagtcttgaccatattatttgaggccctggattacccaagcaagaaatctaagaatctatccattcttctttcttacctccatactcaattgatgataaacttttgttaattatacatctaaaagatttgtctgtcaaatatgtactccagacctactactactcctgcttcagtcccggtctttatcatttcacccaactgatctccctacatccagttaagcctccctcccatccatcctctactctaaagccagatgaaatatattaagaaatacagataaattcctcagggcttctgtggtgtctctggaaaattgaggcattttaaggcaaacaagggccccccacctgcctctccagcctccgcaaatgatattgcaattcatatattctgtgttcttgccctattgagcaatgccctgcgccatttaacatgccataatttctttgattatccttatattctatttcctttccctggaatgccctgaccttcccttcttcacccagctaaatcctattacaagactttttttttctgtatcatctcctctaggagtcttcctttatttttgctgagctgcactgatctctttccatgtttttgtgctaacctgtgctcccctctttgaaggttcttgatccatagtattgtaattgtttgttccctgtctgattcataactctgaattgataccaacatatagacttctgtgcttaacatgatgcctgacatacagcgtgtgctcggtaaaatttgtccagtaggtgaatgattgagtcactattgattcaaggaaatacatgagtttatatgccatctatattagactattagatgttgcccttgtgtctgtgttggaagcctttaaggaaacctttcagatatccctattagaatatgctacatttctttaatgctcccaaacatatcttgtattctaaataaattagctttttaaatttctaccccttttgtttggtgacctgtatcagcattaatacaataaagacattttatatttattataatctttcagacagtgttaagtcttcagattaaatttttgggatgtaagttactatgaatctatgtattaatattattattttagacacagggtcttgctctgttgctcccaggctggagtgcagtggtgtgataatagctcactgcagactccaaattcctgggctcaagtgatcctcctacctcagcttccccagtggctgagactataggcacctgccaccatgcctggctaatattttaatttttgtagagatgggatctcactttattgcccaggctggtcatgaactcctggctttaagcaatcctcctgctttagcctcccaaagtactaggattataggcattgagccaccatggctggctggatctatgtattataacttcagttttattttttggtttactttattttttattttattttatttttttgaaacggagtctcacttactctgtagaccaggcaagagttcagtggtgcaatctcagcttactgcaacctctgcttcccaggttcaagtgattctcccacctcagcctcccaaagtgctgggattacaggtgtgagccaccgcgcccagctaattttttgtgtgtgtttttagcatagacgggctttccccaagttggccaaggtggtctcagactcctgacaagtgatccacccacctcggcctcccaaagtgctgggattacaggcgtgagccaccgtgcctagcctatttttttggcttattttaatatctacctgggaagacctttcttcctccttctattaaattaacattatttaatgccaattaagttacatggctcttttcaaagcatggacttgaatagatttaaatatgtaccataaaatggaatacctgattttttaatgggctgtagcattttgtttttatgtaatctaaccttactgaaggatttggaaatgttaacccttttggtgatggcccatattgaaagataagctcattttgcttttgaggaaaaataacaattatttgagaaaggaaaaccacaatttcgatttttcatgcaatcaaaacaggttctaaaatattctttaactggtccatttatttgatagccagtttactgactgaatttaactttttaatttctgtaatggattataatgattttgtgcactattagttaactgaatttctaactagtgtggttaccacattagttattgcaacctcttcatgggtccccttctctcccaagatgcaagtgcaggtatgcaatacatcattttcaataaatggggaatagtagccaatctcttaaaactttgatttagccaagaagaagaaggaggaggaggaggaggagggggagggggaggggagggggagggggaggaggaggaggagaagaaaccctgttgttggttaacaaaattctcatttctgttacctaaataacaagttgcaaatactttgtaacatcaagaagtcatacaatttttcattagaaagagtttcagcaaaaatagcctccagaacttaaaaacaaattcttttttttttcttgagacggagtcttgcactggcacccaggctggagtgcagtggcgcaatctcggctcactgcaagctccgcctcccgggttcacgccatgctcctgcctcagcctcccgagtagctgggactacaggcgcccgccaccatggccaggtaaattttttttgtatttgtagtagagacgggggtttcaccgtgttagccaggatggtctcgatttcctgacctcgtgatccgcccgcctcggcctcccaaagtgctgggattacaggcgtgagccaccgcgcccggccttttgactaaaatgctagattaaattagtgtcaggggtcaatagtttcttcttttccaaattgaaagactacctgctgaaactctctatacccaccttaggtttcccacttgagtaattttaagcaactcttaagtttctacgcttggcaatatttaactatcagagagtggttgtaggaattaaaccccctttaagcaaaccagttgtcttctgggtgtaggttatttccattcaggcttgtttccattggggcttttctagtatatgtagagatacacctgaggcatgatttcttttttatgtggattgtgataagggcctcatttcccagtgaaatttctaaccactctagggggcgagaccactgggcttgctgcttttgttgtgttgaagtacagcaaatgtgatatccttcagcctgggtgtgctttcttatgcttgttaaatacagagtgccagaaaatgtaccctaagcatgacaaaacataatacacaaaagacaagttctgtatccttagcacttttcattctagagtctaatattacaggtagcagtaacagtatcaagttgaccaccaaagacaggtttgatcatcatgaaatgccaagtaagtgagccagtttaaatgaaagtcagggaaggaggtgattcagaggccaagcactggttattcagagcatccaagaaaatttgttggggctagtttattatttttttaattaccttgcctggagtgtgtgatttataatgcaacaagatatagaaagaatggacaaatggacaggggtggtggtgataaaacagaatgcaaagctgcagcacctagacatgaagccatattctcgtcactagcctggaaataatgaactattgagtacatgtctcctttttggccccattctcactattgaaccttatttcccacagggcccagtcaagccaacctcttttacacctactcattccttatctcctttctggtgccatgtcactcctctgttgatggtattgctccctcttttggtcttatatcctgcctgcacacatactaacgctcactgcagctccgttttcagccccctcatgaatgtgttctccaggaatggccgacacatgtcatctcagagcccctctggctctggcattcggattttcccactgtttcttccacttgttttctcacaatattgtgtgatgaatcttaactctctaagtacattgtaagatatgtaagggcaagctgattatgattttatgtaataaaacacattgcacacagcaggtgctcaatgaatatctgacttccaaacattattggagttgttggatctcaaatgattgaccgcctatgttagtgtcaaaggtcttcaatgccgaagtaagatgtgttatcaccactgtcactagagggggattaccttccctcctccccacctctttcccactccctgtttaaatgtgttctttagtatatgctccttcccctaaagcagatcctctcccagagatgcacctcttataatcaaagttttgaagctcacgattgattgtagaactatttcatcatcattagaaatggttaagtgctgccccttttcttctttgtcatttaacaatttaattatgtgtcacttcagcttaggtttgaagcatagtatttttcccataggaggtactcaataaaatctggatggatggatgggcagacggatataagtggggttgtatccattatacctgcaccacagatggccacagacctatgaacatatcatttgctccaaattgtatggtaggtcttcatgacactttcagtgtatccgcatactacttcatttccccttgaaatgaaggacagttgacaaagtggatgtggtgggttggtatttagcaatagtaataatagtttttttagcttacatttgctgagttcttaggtaccaagcactgttctaaatgctttacatatattacttatcttttaaaaccctattattgccaaaagtagaaataacccttgtcctgatatcagttgatgaatggctaaataaaatgtgaaatgtttatacaatggaatattattcagccacaaaaaaggaataaagttataatacatgctacaacatggatgaatctttaaaacgttattctaagtgaaataagccagacataaaaggacaaatattgtgttattcaacttatatgaaatatctagaatttgcatctctatgtgtactcataaagatggtaatttgattataaattaccaaggactttagtgggagggatggcagttattacttaatgggtacagtttccgtttggggagatgaaaaattttggaaatagtggtaatggttgcacaacattgtgaatgtaattaatgccactgaactgtacacttaaaaatggttaaaatggcaaattttgttatatatattataccacagtaaaaaacagttttgcaaaactctattcctaacctaattttaatttgactatatctggaatgtttaaacaaataggagttgtgtatactaacataatgagaagtctaggagggtgctgtggcactggttcagggtcatcctctcctcgaatctcttggctgaccatccacaggcctttcctgagtgcttattatttagcaataacctcctacaatttagaaggaatagagtatatgatggaggaacaagggtcaagtcactgtaacccaagtattctcaatgggaagactggttttggggagaccaaaaatatcttaaatattaaatggtttgtggccctccaaggctcatccctacccaacaaatcttttcccttagtatttaattctctcataagagagtatttaaattaaattcttttttcttttttggagaagagtaatgaaaaaaaattgagaaatacttttgtagcctaaggaagaaggtggagcaagggatatttttcagagaaggtgagaagtactgtttcctaaaatgagatgatacagttctgtagaatatgaatggtgagtgatttttttttttttttttctgagacagggtcttgctctgtcactcaggctggagtgcagtggctccatcatgtctcactgcagcctcaacctcctgggctcaagtgatcctcctacctcctgagtagctgggattgcaggcgcatgacaccacgcccaggtagtttcttttattttttatagagacagggtctgactatgttccctaggctggtcttgaactcctgggctcaagtgatccacctcaacctcccaaagtgctaggattataggcatgagccaccatgcctggcagtgagtgaattttcaaagtcctgctgggtgttttcgttagatgcatccctttagctgttgttaaagtcactattcatcccagtgaattcactttcattctctctgttcatgaatgagatgttcagagaatacttgctttttataaaggatgaagtagacatggacactagatcacttttgagagtaactgtgtctgctttttaaatatcttatctgaaaataactgtactatttagttaagatttctttgagtcactaaatctgtagttgggggttggaagaggggacatgtaattctttctgtaccctatcttttcgacacttttcctaggttttaaaatatatgtgagatgctaacattatggagatacaataatataactcatagctgcattttacatctatgacttcatctggctgtgaaacagatggctcacagaatacagcagccactcttatattgatagttgtggtttaaaaatcattgtaacaactactagcaactactgtatttgctagaaagcacatagtccagactacattttggcctagggaactgttattaattcaaatataggaagagtcactggataattttagaaatattcatagctaagcattggatttttgtcttctctgacactgtaccaaattccataacgaatttcttcttgcttagatgtgactgggacaaagcctccccacatttgacttaattgttgctggtcccaaatatttgactgaaagtctcattaccttttagccatcctcgcaaaaacataattgaatatgtattttcatctctactgaaatatcattttccttcaaatcaactaaatttgcctcttcccccaattcgttgtaggattcattttatcatatatcagcttttttttctctaaactataggaagggaattgtctgatgataaagcggaaagcacaaaagtcatgaaatgctaggctaaggctctcctgtcaataagcacccactatggccctttctgcaaacctcagtacccagttagtgccataactagtcatcgtccatcctttgtaaggaaacagtttctggttccctggcctttgcatgattgtgttcaaatgtttatttcacttttggatatttggctcatttttttctttccaccttatctcctttattctaaggcagggtgaggttggagatgatatatattgaggaagaaaaatagaaaaacatacactctctgaaattccctggaatttaagttagtttcctttagaaccagggataaaactctttgtccagatttatccatcccttttcatttcttaaatatggtaaggaattcttacatctctggtactggcctttggtatccagtaaaataaatggagagacgctcagtaaatgtcttttaagtgagtgtcctaataaatgttccctaaagtgtttatttgagtcccgtgtcttatatcatttgacagaaccacacaatttgggttctgtgaggtggatgctagggtctaggtgagatcgttctggttaggatttcctataggcatgtatcaacagagccaaagcacaattattttctccaataaaatagaacttcatttaagcacataaatacaaacataaaggaacattctgtgtaattaaaagacacaatatagagctcaagctaaagacattcatgtgtctaggtgtagttaaatgcctcactaacattcagccattctcagtcactgtaatccaaacccaatatttccctgggcttaagtagatcctaacttgtatatagaactttctagggcttgtccaattgaagctctgtgggtacatttctagtaagcctttcatttctctctaataacaatgatctttgcccactggttttcaattcaaaaggggaaagaagcctatttgccattccaagactaaagatatatttgctttcctaaagttgttattctctcatctaacttgaaacatacagaaagtctaaaaaaggtgataccactaaacctaatcaaagaggaaattccctgccacttttaaaatccctacatcttctgtatctgctctgaattcagtctgccttataattcaagattcaactagttcaaagaactcactctgtcataacattacatagtattaaagtagaaatatgagatttttttcacagcgtattgtcatgcttatagtacattttatctactggagtaatctaataacttcatactctcttaaacacagcttcttgtaagcacattaaaacctatcctaggaagcccttccaaaggaagtgacagcaaaattccccaaaatgttgcctgcttggaaagttacctaaaagtttagttctgaggaagttgacattgagtgtttcttggtttgtaccgtgctcctctctagaggctgccccgtgtgcatagctggcagagagggacatggacaggcattagaagcagctccagccagtcagaattggaggtcttgatggcattggagctggagttggggggagcagtgagaaaaggaagcagaaactgtggttgatttcatgctcctctggcttgcctctcttaccctaggcacagcccagagatgctctggcaggggtgggaggcagctggatagattaagaaagggcttttgtccctgcgattctctaacagaccatatttgagatgacagatgcaaaataaacaggcatgactttagacaggtccagaatggtcttaatatcctgaagcttattcttattcaaacttcgcgttttaattgtttggaattcttagacagagtaggtggaatttcatcctttgtatgttttaaggagagcttcgctcctctctttaccacccaccccccgccacccagtaaaatactgaactttcattttaatccataacactaaatgcttttgtgtttttctttcttcaaagactgtcattaagaatgtctacaaggaaatcatgggaaatgacaaaatctcccccagattgattttttacgtgttgttggaaataaccacataactaaaaaaaaaaaatgctcattctgggaaaaaaatctgtccaaggatgtggaaaacctcagcattaaaaataatatcctaagtaatccaaaagggaaattaactttcactttgaaggcgttcactagcacaaacactaaaataatgagtaaactgtctctcctgagaaaatgccagctgtcacctgctgcctcccactgggctccaggtctaacaagcctcgctccctgccctaacttgtgactctgtgtcaggagacttttctgaaggacattttttcaagcaattagaaacaatctactgtgggccaggcacggtggctcatgcctataatcccagcactttgggaggccaaggtgagcagatcacctgaggtcaggagttcgagaccagcttggccaacatggtgaaaccctgtctcttccaaacacacacacacacacacacacacacacacacacaaatcagccgggcatggtggtgtgcacctgtagtcccaactacctgggggctgaggcaggaaaatctgttgaacctgggaagaagaggttgcagtgagccaagattgtgccactgcactccagcctgggagacagaacaagactccatctcagaaaaaaaaaaaaaaaaaaaaaggccgggcgcggtggctcacacctgtaatcctaacactttgcgaggccgaagcgggtggatcacctgaggtcaggagttcgagatcagcctggccaacatggtgaaacctcatctctactaaaaatacaaaaaattagcggggcatggtgctgtgcacctgtattgccagttactcgggaggctgaggcaggagaatcacttgaacccgggaggcggaggttgcagtgagccgagatagcgccactgcactccagcctgggtgacaagagcgaaactctgtctcaaaaaaaaaaagaaacaatctattgtgttattaaacaccaacttctcttattgtcaaatcactcagaattggccaatttccctattaagtaaaactgtcattgttattaaaacataatagcaatgcaaggcactgtggagtacagagggtgtttaagttgatgatgcatattttacgaccctgcagaggggcaaacatgttcaggtatccattcacacccacaaacagtgagtagtctcctagggggtgggtttgttgaaaatttcagagatcacctagggtctatgaaatatatcaataatttcacttttaaattgtatagtagatttacaggtatatgtaatataagtaatttaattattcattgtgtataatgtgacacattatcatataaaagctaaaagttagaaaaaacaaaggtcctgagcaatatcttgagtgtataatcatttattggaaaattagaagttgatttgtgaatgccattgtacaggcttgacttgttgaaaccaccctcttccatgttaccctccaccgagattgacatatcttagtgtcttccacacttcacagggtgacacaggttctgccactcaacgctcacttcgaccctcgcccataaaattcctaaacagcttcatctgttagtggttttcaagagtagtagcatatgtggaccatgctgtaataatctccgaaagacagatttgttaaaggttcacaaatgcttaagcacaactatattcaaactaatgttacattagactaaaacaatatctgcttttgagaagtggagctacatgctggaagttttttacgagtagaggctgagctgaaagggatggagaatgaaaactgaacaggagagaaaatcaaaggagaaaaaaaagtaactacattatcttcccttgcatgttaacatggaaataacaaagacactgaaacattcttggagaattttaagaaggggtgtatatggccaagtcacctgaaaagaactttaagaaacatctgtctccaccctcaaccctcaaaacatctaaaattaactttaggacataaacccaattactttaaaaatacgtttcctagacttaagctgtaaagtttaagtgttctcaccacaaaaaaatgttaagtatgtaaggtaatacatatgttaattagctccatgtagccaattcgcagtatatatgtatttcaggacattatattgtacatgataaatttatataatttttgcctgttaaaataaataaccaaaataaaatatatctaagcaaagctaataaaatagaaattaccagatagtatttaagaaaacccaaggtcgctactagtggctatgtataacttcatggagtgctggcatatccaacggtgtgtttgtaatcttttcctctcaggttctctgatagcaagattctctaaattgaaatgactgctttactgattgcctctagttttcccccttgttctccctgaactatattaactttgtgctatgttagtgactgtgtatgttgacagatttcctagagaactgctgatgaatactgcccacaagaaatctcacttttccttttcattgacgtatttgtgtaatttataattctaacccatgagttaattcaatgcagagattatttaaaagactacttgagacatagtgtatagctaatccaggtcctcataatctttaccagaagttatttgctcttgtgcataattgaaaacaaatgttctgtgttgtgtacaattattttgatcttaaaggctatgcttcgtagaaaaagagaaggttaggattctgtagtttcccttagtgctttcaaggtatcttctttatagtcatacttatctatatattaaattataatagtttatatataggcttgagtttatgtatgtatatgattgtacatggatatatgtatctagatttgggaatgcatagacttaaaaataaaattgtagaccttgtcataacttaaaatattacagatggaatttaacataacatgtcttttaaaatcaggtctaaagattattagaaggatttgttgcaaaaactaccggattggacataaaacatggtttccagtcttcctttgttatgaaatgagtgagtcacttagcctatttgggccccagtacttatttttaaattgaaaatacaaaaataattgtagatacttgaccctttaaatgataatgtgctgagaaaacaggcagaatggtcagcacatttattttatttcttgaatttcacagatgaagaatagcactttcacttacagcagcaatggcagacaagacactctgtactcgaaaccaattatatccgaaataaaacattctggtttgctgctggacttcctggaagtgggtaaaaccatctgtaagtccaacctctcctcccctccaaaaaataaaaaggaacaaattgagacaatgttggagcttagagccatgagcagataaatgtcctgagcaagaagcaagggagagaaactgtgattatattgaggggaaatgccaatagaagcactgtaaattgcaaccgggatactgagcttggggtcaacagcaaggaaaaggaactgaatctgagattttgcattaacccaggtccctcaaagagtagtaaatggccccaggttagtagtcctcccacctacttgcagaaacacaccaaatcaccataggaaagaatcttacggatatttcatcagattcccacaatgtataatcagataagtattagttcacaaccaaagacatgaagcgacaagaggaaataagccatctatattagaactgttagacatagaaatgctgtttatgaagtacttaaaaagtaaaatataggatcaaaatagtgagcaaacaacagaaaattatcaggaataatcaggcaattcttacaaataacacaatggaatgtctacataaaatacgtaaacattgaaagaaaacacaagacatgttaaaaagcagactagccacagatgaaaagagaattaatgaatttgtaggttgaagtgaataaattaaccagaatataatcttgaaagaaaaagggccagaagaagttagaataatttaaaatgttgaggataaaataagaaggtctaacataagtcaaatcagagtcgcagaagaaaagaattaagtcaaccaagaagtgataataaaattaatcaaggagaagtgttcagaaatgctgaaagctgtgaatccccagtttcataaaggacagtattcccaagcaagacgaaaaagaaaaccaatagctggcatagtggtggctctctagagaaacaaggcaaaaatgtttaaaagagccagagagtaaagacacatcacataccaagaaatgatcatttcattggcagcagagtgctcaacagtgataccagaaaacagaaagcagtggaataataaagtgttgagagcaaatagctattatctatcaatcatgagagtaaaaggcatttgccgttaaacaaaaatggagaatttaccatcggtagactcacactgtattaatagtctgttctcatgctgctaataaagacatacctgagactgagtattctataaagaaaaagaggtttcatggacttgcagttccacgtggctggggaggcctcacaatcatggcagaaggcgaaggaggagcaaaggcatgtctcacatggcagcagtcaagaggatgtgtgcaggggaactgcctttataaaaccatcagatcttgtgagacttattcactatcatgagaaaagcacaggaacaacctgcctccatgattcaattatctcccactgggtccctcccatgacatgtaggaattataggagctacagttcaagatgagatttggatgggaacacagccaaactgtatcaaacactaaaggttattccttaggaagatggtattttggggctgggcacagtggctcacgcctgtaatcccagcactttgggaggctgaggcgggtggatcacttgaggtcagaagttcaagaccagtctggccaacatgatgaaaccctgtctctactaaaaatacaaaaattagccgggtatggtagcatatgcctgtaatcccagctactcgggaggctgaggcaggagaatctcttgaacttgggaggtggaggttgcagtgagctgagatcgcaccactgcactccagtctgggcaaaaagagcgagactccatctcagaaaaaataaaataaaaagaaagattatatttttgacaaaaattcagttaaggtaaaagtcaatagcaaaattatatttttacagtcctcacatctttggaaatagaatacttaattattcattgctcaattaagaaatcataatgaatttttaaaaatacttaaagccaaattgtaatgaaaatgtaacatgtcaaaaccagtatttttgagggcagtctatcaaccataaatacatacattagaaagaaagaagtctgaaaatgaactaagcaccatcataagtatttggaaaagaataaaaaaaataaaaaggaagcagaatcccctaagttgaaaatgatattacaaaagaaaaaattatgaagataaaatttagctttttgaaaagactcataaaatagacaatcttttgctaagactgagaaaagagtacacataatgtaaggattaagagagaatataaatatagctatagcacagattgaaaagaaaatacgatgggcaatgttaagccaataaattgaaggtgaagtgaaataatctttagaaaaatagaatttaccaaagctgaattaggaattaagaaactttaatgattctataacttttttttttttttttaagacagagtctcgctctgtcacccaggcaggagtgcagtggcgcaatctcagctcactgcaacctccacctcctgggttcaagcgattctcctgcctcagcctcctgagtagttgggattgcagatgcatgccaccacgcccagctaattttttatttttagtagagacagggttttaccacgttgataaggctggtctcaaactcctgacctcatggtccacccgcctcggcctcccaaagtgctgggattacaggcatgagccaccactcccggccgattctataactagtaaagcaactgaattagtagttcaaaatttcctacaggaaagaccaaaccatttaattttacaggtggaattactaagcattcaagagttaatttctatcttttacaaacttatacagcaaaatggaaaagaacaaatactctctaaatcattccatataacctggacaccaaaaatagacaaatacagtttaaaaaaataaattataggccaatctcactcaagaccctaaataaattataccaaatggaatacagtggagttaaagacaaaaaaaggtgtatttatcatgaccaacttggctttatcccaggaatgcaagggtagtttaacatttagaaatctagaattgtgatttacataatagattaaaaggggaaacccatatataatctcaataggaacagaaaaactttggataaagttaaccactgatttagtataaaaagtcttagcaaagtatgagtaaaagagaattctctttacatgaatgatgttatcagccaaaacctcagtaaacatcattcttgatgaaaatctaaaaacattccatgtaaaatcacaaatgggatacgtttgctcactatcatgtttttaatcacaattaaaaccgaagcttctagccagataataacatgaggaaaataaataaaggcataatgattagaaaggtgcaaataattcttctatgccaagtttgctttaaaaaaaagaaagaaagaaaggaacaaacaaacccataaatatttgcagataatatgataatatacaaagaaaatcacaaagaatctaaaactaacgtgatagtaattaacttagtaaggtgtcaggcctaaaacccatatacagaaattagttgcctatttttgtgtttgttatgttttattttatattttgtttgctgtttgctttgggtaatagtttcagaataagtaggaagcaggaggtcagggagacatactgagttgctgagacatctgcagaaacagcacagagactgggaaactgttctcccagtttgcttggtactgagggtttcataggatgcaggactttcaggttcaataccatgactatcccagtctgcctgggactgaggggctcccaggatgcaggactgtcagtgctaagaccagaagagtcctgcacaaaccaggaggaggtggttactctgtgggagaactgtaagtagtccagtgtcattgcaacttaaaatgcagggcaggaagtggtgacagacaagactggggagaaaagcagggaccagatcacaaagggcctgatgttccatactaaaggaacttgtaccttgttctccaggcagcggcaagctgttgaaaggttttaagtggggagatatgtgacggtgacagtttgcattttagttagaccacttcagtagtagtctagaggctggatttgaaggggctcaggctggaggtaggaggtggttgctatagtccaagtaaagatgatgaaggcccacactaaggggcggtagggatggagtggaggggacagtcccagggactacttaagaggcaaaatttgtagagtgactgactggatgtgggagtgatagacaagagttgacaatgatctctgcccttcagaaaaatgttagacaacatgttggctaaatgaaaatacaggctgggcatggtagctcctgcctgtaatcccagcgctttgggaggccaaggcggtcagttcatctgaggtcagaagttcaagatcagcctggccagcatggtgaaccctgtctctactgaaaatacaaaaattagccgggcatgatggcacatacctgtaatcccagccactcagaaagctgaggcaggagaatcgcttgaacctgggaggtggaggttgcagtgagccgagatcgtgccactgcactccagtctgggtgacagtgagactgtatctcaaaaaaaaaagacagaaaatatagaaagagaaatataaccaacactcatatgtgcatcatccagtttaaggaataaaatattaaagataccattgtatccccctgcatatacctgatcccactcccctgataccacttccccttcccttcccagaagtaacccctacattacactgatacttctaatcgccatgactttctataaaattctgctacagagatgtacattgctaaacaacctatactaattgcaacgttttgcatttttctaaacttcatagaaattataagtattagtctgtaacatgcagtcttctctcaccattgtatatgagatacagcccctgcacaagagttctctgaaaaggaatgtggaagaaagagactatattccagtgaacagtttgcaaactagggagatgcaaccttcagtgtaaaatgaaggtgcattccccaactgcttttctaaacagtggtcatggacagttttaaaatgtaatataaaaaaggtaaagtttatagttacaacaaaaatgtacacatcagttgagaaaaaccaatagaaaatgatcaaaacacggtaacaggcatatcaaaggagaaaagtgaatggacagtatataaaaggatgctcattctcatcagtaataaaggaaatacaaattaaaactgaagtgaagcaccatttttatacccagaattggcaaaaattaagaaattggacaatgtcaagtgttggaaaggatgggggttaacaagatctcttatatacctttgtcgggaaggtaaacttgtataattgcttcagaaaacaatttggccttatccaataaatttgagaatgaatgtaacttactcctagatatatatcctagagaaactattacccatggttacctaggaacttgttcagagcagcacaattcacaaaagaaaaaataactggaaatgactgaaatctccatcctttgacaggagactaaataaattgtagaatatttacttggtggaatattatacagtagtaaaaatgaatgtttttgatgaatggataagcaatatgtggtgtagccatacagtagaatcatattcagcaataaaaactaatgaagtacagtcatgtgctacatagtgacgtttctgtcacaatggaccacatatacaacagtggtccgggaggattatagtaccatacttttactgtaccttttctatgtttagatacacaaatacttaccattgtgttacagttgcctacaatattcagtacagtaatatgctatacaggtttgtagcctaggagcaaataggctataccatatagcctacatgtgtagtaggctataccatctaggtttttgtaagtatactctgtgatgtttgcacaacaatgaaattgcctaacaatttatttctcagaacatatccttgttcttaagtgatgcatgattgtactgatacatgctgcagcatggaagaacctcaaaatgttattttaaatgaaagaaaatcacatattgaatgattccatttatatgaaatgcctaaaagaggcaaatcaataaagacagaaagtcaggccaggggatagggaaggaggggagagggatactgggaatgactgccaattggcacaagatttcttttgggggtgatgaaaatactctgaaggtagaagatggtgatgaatacacaactctgtatatacactgaaagccattaaaatagatacttgaaacaggtgaacttgatgatttaaattatgtatcagtaatgctattaaaagtgagtactctatagtaacacaatgcaacatgagtctgtaaaaatttaaatagtaagttgaatgaaaaaagttccaaaagacaatatatggtattataccatttctgtataacttaaaaataagcaaaatgaaataatattgtatattttttaggaatacatacttacatgacaaaaccatatggatattgaaaggaaggataaccatacaggaaagttgctgcctcagggggcgaagaggcacatgggacagaggaggaatccacaggtagatgcagtgctattggggattcttttagttcttcagttgagtaattatttaaaagctgaaatcttattttgattataatttacatattttatatttaatcttgtataggtatcaaatatattacatttgagataataaagggaaatgctttaaaaataatagtagtatgggtatactagcaaaaaacaagtcacttatgaaagagaaaataagattgaccccagatgtctccacaccatcttccaagccaaagacaatgcagcagtatctacaaagttatgaggaagacagtgaatggctttaaaattttaagcccaaattatcctcctaaggataaatgcaacagatggatagtaagcattaaagaatgtaaagaaataagaatccatgagccttttatagaataaaaataagtaaatttaaaacttttgtataataaaatctaggcaactaagtagacgaatcaaagagtataaaaatggagaagccaggcacagagaagttagatgatgaacaccaaattatttaaaatagaaatgaagagtaaacagtggtttgaattacggtttcagaacaagatgtaaatgttaaaaccccagatgttatgaagaataatataaccaataaaatgcatttggaagagggagagaggaggaagaaagtgaaatgatgtctcttttatcaaatttcataaggaggttgtcagatattgtaaaaaattgaaatataatttttaaaatatgttgattggttttgcagcagatatactaaaattggaatgatacagagaagaccagcatagctcctgcacacacagggtgatacacaaatttgtgaaatatatttttcatttaaaatgaattaatcttttccccctctaaaatgtcatagaaatagtaagtgcagtaggatataactatcagttgccaatcctaaattttcatattcaatatctaatagatacgttgcaaattttgtaatttaagatttgtttatagatgtgcatatatttacagtatgaactttaaaatcatttaaaaatgaatggtggtaaaatctgtgaattatgtgaaataactgtaatgtacatatatttttattctaataaacttttgaatcctagattggattttattagaaaaaataaaaataaaacatacattgactcttccccagagtcactgggggagctattgacatttcggttgggtatgttttgatgtcaggtctgtcaggtacataataagatgtttgacatctctggagaatgccaggatcctcataattgtgacaaccaaaaacatgtccatgcatttctagatgcaccctagggaattggcactgccatggattgagaaccactgctctaacttcttacaggttttcacatctgtcctattacatttagagcaatgttagagaattaaaatctcttaaaatctcaaaagggaatcatttacctgaaattcgttcagcttcatgttggtgtccttttctcctattaaactaaaataaaaaataaacttaatacagaataagcctgtttatagaatgcaacaattttcattaataaaaaagtatttgttgaaacaaggaatctgaaaaaatacacagttactttgcgtatttttattgtgataatatatgtgtaacacacaatttaccattttaaccattttaaccatttcaaagtatacagttccatgggattacttacattcacattgttgtgcaatcatcaccactttccatctccagcactttttcatcttccctgatatggtttggctgtgtcccccacccaaatctcaccttgaattgtaataaaccccatgtttcaagggcggggccaggtggagataattgaatcatgggagctgttccctcatactgttctcatggtagtgaataagtctcatgagatctgatggttttataaatgggagttcccctgcacaagctttcttgcctgctgccatgtaagacatgacttagctcttcctttgcctgccgccatgattgtgaggccttcccagtcatgtggaactgtgagtcaattaaacctctttcctttgtaaattacccagtcttggctatgtctttattagcagtgtgaaaacagagtaatacattccccaatggcatatttaacatgaattatatatagtcatttgccatttgccaatcttttaatttggggccaagatcttttctttgagagtggtcccctgattggaattccccctcaccatcttttttgcatgaattacctaccactctctaagattatcagttttcaatttttaaaaaatgaaacaagacacttggaaaggaactgagtgtagaatcctcctagattcccccaaccccctatgtgtcatgcatcatgctcacagctattttgaaagcaaactaaaaaaaaaaaaaattgagaaggattctcgctgtgttgcccaggctggtctcaaacttctgggctcaagcaatcctcctgccttggcctcccaaaatgctgggattataggcatgagccactgcacccaccccgaaagcaaatttttaatcaccctatatttatccagtctttctaacatactcaatctagtttgtatggaaacaaaaatttgttctttttgcatttatattttgtcagttttcttaacatttatttaaattatataattaaaaaaagtttgggttcaaacacccaaattgaatcatggaaaacttccagctgaactggtggggacagaagtatagggcatctaaagagctatctgcttgcacatttaaagtgaagggtgacacggcatgatctggcaagtcagatattatattaacataatagattgaaaatagtatgtatacttgggatggttaattttatgtgtcagtttagctaggccacggggtgcccagatatttggttaaacgttaatcttctgtgtctgtgacagtgttttttgatgaggttaatgcttgaataggcagactgagtaaagcaaactgccttccataatatgggtgggcctcatcctatcctttgaagacaacatgaataaaacaaaaagactccgtaagggggaactcctcctgcctgactgctttgagatgggacaccagtttctttctggcttttggacttgaaactgaaacattggctgtttttttagtctccagcctgctaagtttcagattggaaatacatgtcaccttccctgggtctccagcttgccaactgcagatcttgggatttcttggcctccataattgcatgagccaattccttataataaatctcttttaggatctctctagtaggataaattggtatattgttgtttttttttttttttaccttaagaaaaaccaatagcttaatttttcctcgatatatatttagaaaattggtctgagaagagttttcatgaaacagaccagagaactatgtataaaattaagagttctaacccagtaagaaaaagtgcaaaaatgaagcacacattcccaggggccactgcagcctaggaccctcccatcagagggaaggcaaggtctttgatggcttttgagttcagctgagggatcatgctgatcttcaggaatttgttgcttgcatacttattcttgatggcgatgaatttagttaagttttcatttactttcagcacatttttggccacgtgctgcatgacttccaatacttcattctgtgtgtatcctgtataacactgctgctttaagttccattttccttggcccagaaccttctgagacaagcaggaagcagctgttgctgccttagaaggatgataatgcatcatatcgtagtcaatgagagtcagctccatcaaatatttggctaaagtgtgctgttcaacatcagccttcccggcttttgatgcttgccttaagaagtgtagtggcaagggtccacccacctcaaatttcagttctttcaaaattagtttccatttcttggatttggaaactagtataagcattgtctgtgatgtaaacaaagccttcagtatttggagaaaacatctcctcatacttggaagccaagagcagagcagtaatccaaactagttgaagcttcctctgggaaactggctgaaccagtaaagatcaatccataatggcaacacacacatacagagtctcctgaagaagcctaaacttggagtggatttgcaccaaccagtctaccaggatggtatgcttatgtccatttacatctcatccacctaagacatgtgggtttatgaactgcaaaatctccagctgcctgaggtactgatagatacccttaaatagtcactgcagagctgagggttattccaatctttgttatcaatatcctcaattttgtagagcaaagcatcagaaaaagctcggcagatgttctcttctttcacggaggcatcctcaggtatgggagaaggaccctttggagccaacatttccatctgtactgtttcacagaagcagtaggtttcagttgtttgttgacatttgttgtttccctgggttgaactggcactttggtgttctgagctttcttagctacttgtgctgctctggctgtaactctatttccaatttattctaaaatggaatgcctaatagtcacatgactcttaggtttagaattaactcctgtctctctgtctctgcatatacccatttaccctattggttctgtctctttggagagtcctaatagaatacctgacaactaaatgcaatgtggatcttgggacagaaagaggacattagtagaaaaactggtgaaatttaaaaagagcctggaatttagttaatagtaatgtaccagtgttggtttcttagttgtaacaaatgtaccatagtaatgtaagatgttagcaatagaggaagttggttgagagctctagaacgctctgtattatctttgcaacctttccataaacctaaaattattcaaaaataaaaattttgttttaaaaaatagcatgtaccatacaatctctctctctgaaactgctcctaattgtctagctttctatttgtatttatggattctattcaccaaatgttagtaatctttactttgggaagtaatttacttctttctttgtgcttttctgtattgtttgaattttaaaaatatatatatatatatattactaaaatagtgaagtcattttttaaaacattggaggctgttttgaaaagatgacttctaaaaatcttccagaaaactctatgatctttgatttggtgttatttttttaatagcactgtctcacctataacattctccttaggcacccaaaaatgattttatgatgaggctccaagattgatactctgtggcaggacttgaaaaatgaccaggttgtgttaccataagaacatgttcctgttttgttttgttttcttttttatttttctagttcattaaggctgctataacagaataccataaacgacagaaatttatttcttacagttctggaggctgggaaggccaacatcaaggcaccagcagattcagtgtctggtgagggcctgttccctggtttatagatagctgcattctcacccttacatggtggaaggggcaaatgaattatctggggtctcttattcataaggacactaatccccttcatgagggctcttacctcatggcctaatcacctctcaaaggccatgtctcctgataccatcacattgtgggttaggatttcaacataagaatggggttgggtggggaagcaaacattctttaaatagcaccgacccatacatagcttaatggtttatgtcagtgtgttactatagctatttgctggcgataagcatcgtaaggaaatgaaaggcttttggttgcaattctcctgtggttctgtccagtgaagcaatgagtcagggatttttatctccaaatcaaagcagagctcaccttttagtaattggaggaattaaaagaacaaatttcctaaatgttctatgttctagtacaaataaaattttttaatactctgtttatcctcatatcttctattttctttgttctcttcatcttgtctctatgtctcctgatgtccaacctctctcttttgatccttttttcttttgagtcagggtctcactctgtcacccaggctggagtgcagtgacgacatgatggcttactgtgacctcaacctcctggactcaagccatcctcccacctcagcctcccaagcagctggtaccacaggcacacaccactaagcccagctaatttttttattttttgtagagacattgttctgccctgttgcccaggctggtccagaactcctctaggctcaaatgattctcctgtcttggcctcccaaagtgctgtggttacaggaatgagacactgcgcccagcctcctttgacttaaaatattaggtctattgtaaattctcaagggagccatttttttctttttccactctaatactgtgaattctttgcggatggagagactgttctcttcatttctgtttcccttcacctagcacagtcctcacccatcaaatcatggaggattgtagccacagctgcaaatggaaccctggagttttccagttcctcctactcattcaagttctatgtctcccttcttccctttgtttttctttctcaggtcctttttcttcttgtaatgtagttataggcttatcgcctgtattctgtgccttctgaatgtccaggctctaaggtcattctgctgattatatgaggccaggtcttccctttaacttgtgcttctgtaaggtaataatctaagctataccagtggttcttaaactctagcaggcattagaatcacctggagagcttgctaaaacagactgctgggcccactcctagagtttcttaattagtaggtctgggatggcactggagaatttgcatttttaacaagtttctagtagatgctgatgcaaatactgatgctgctagtccagggactacacttcgtacatcgtggatctacattctacagaatcattggctgggctagctcctcctttgcaaggaggcaaaaagaaatgcagatgttcagtgtctagaacttatccataaagtaaaaataataggaagaatatacatgttttattttaaacccaagatataaaggcgttttttcccttataatgattattcttcaaatcatctctatacaccataagtaaagttaaaagtgctaaaggaggaaaaactattgatatttctatcagaacacataaaaaggttaattatggcatgcacgtcttaaagatctccttgccatctgagccatctccagaaatacttgccatagaacagaaatagaaatgattatatgagtaaattatcacccacactcctcgcatgcatcatttcataccacaagccttttctcttttcaaggaataatggttttacattttactttgtgatggcactctaattgctaaatataataggggcattatgctacaaagttaaaagactccaagtgaaaagataagtcaaatatagtaatttcacacagccaatgattcttcaaagtatgcttctctttttttccagctgtctcccaattgtgaactctcacagactcatgaaaattgaatactaaggcagagaaaagctaacagggatcctagaatatttctagtccaggagtctgtaactatgatctactggccaaatctggcccaccacctgttttcataaataaaattttattggaaaataggcatgcccatttttattgagaaacagccgtacccgttgtttacatattctgtgtggctgctttcgcactataataacagagttaaatagttgcaacacagaccatgtggtccaaagctgaaaatatttactatcttgacctttaccaaaaaagtttactgactcctgctgtagttccagctactcactggacagattagaaacctgtctagagggagagagttggggagggcaggagagaatggagggagaggtagctcaggtttccacattcaaatagaaacaggattgcagaatgtgaggcttctccctaagcaactcctgtaagagctttggtccactgaaagccagtcacagctgcccttcatgtattagtagagaaggggacactggagtaagtttgtatctcgttataattttcaaagaacctcttcaaatgtccaccccaaaaagaagagcagtgagacagaagtgtgctttgatgttagtccaaagtgttatttatggcatttatttgcacacgtatacaaaaacacattagcagcctaacctttggggctcatttctaataatgaaaaagtcctttttcattgatgaggaaatcattaggatcatcttgtctttcagaaagtatactagcattctgtcatgtagtattctccatagtgcccaaagctttcaggagaatatgccttatagtgggaattcttatttcttcaagttattagtcactaaattgacaaaagtatgtgagtgtgtgtgtgtgtatgtttacattgctattttacataatttatatatccacgtctaaaataaaatgatatagtggtgctaggtgttccctaatctctctcatttatatgttaaaaatatatctattctgtaaatgaacagaagccccaattccatggtttcaggtaagtgcaaagatatttacaatgagttaaaatggagtattgtcacaaaaaaggaccgttattttatttggtcattcatcagttctttattgggtacctcttctgtgccaggaacccactgtactgacatgatacgcaccaagaggctaagaggatctcgtaatctgatggggtgatgggggaggtcacatgcaatacaatgtctgcaagttctgccttggagagagccctggaagagacatttgagtgaagtccaaaagatgaataagggcttgccatgcagatatgcacatgctagggaaatgaaattcacttttaatgttaattctcctgggagatgttcttgactccttagtccaaaccccttaatatccctattctgtgttcctatagcatctatctatcacaggacttttctgtctgcctggcattcagtaggtgtttagcaaatgaatgaataataagtgagtgagtgaacacatggagtgagtgaattatgagtatacaaaagtcagaggtgtgaaccactatggcctattcttggaactgcatatatggctagaagatagggcatggggaaggagggacagatgtaccgggatatgaggctggagaggtaggtcagggtaagattgtggaggaccctatatgccaatctaagaattgaattgtatttattatttcagcaatttcatgttggcccccattctgtgccaatcctgtgttaggctctggagacacaagattcagcccttccccttgtagaccttactgtttcactgaagctacatatatatatatatatatatatatatatatatatatatatatatatatatatatattttgtttgtttgtttgtttgtttcagagacagagtttcgctcttgttgcccaggctggagtgcaatggtgtgatcttggctcaccacaacctctgcctcctgggttcaagtgattctcctgcctcaccctcccgagtagctgggattacaggcatgcgccaccatgcccggctaattttgtatttttagtagagacgaggtttctccatgttggtcaggctggtctcaaactcccgacctcaggtgatctgcccgcctcagcctcccaaagtgctgggattaaaggcatgagccacggcgcctggccactgaagcaatattaattgtggataggatatgggccctggatgtagactgcctgggttttagttttaatttactccatactagctgtgtggccttcaatttctcaatgcttcggtttccttatctttaaaattggagtaataatagaacctacctcatagttactgttgtgattaaaatgagataatatgtgtgaaacttcctggcacatagaaagtacccaacaaatattaagcactctttttactggggaaaatggacattaaacaagtaattaaaagtgtgatggggaattgcagaagatgaggcccatagtgcaaagacaatgtaatggtggcaggtggtggtgtgctgtggaaatgatctggagattcaaagaagtactctctaatggaagaatgggtggaaatgagactggaaaggaggcagcagccagctcatggagagggtcagggtcagattttggacttcattccagggtcattgagagccactgaagagattaagcatgggtatgacaaaatcagagttgtgaatttttttgtttttgagacaggatctctttctgccacccatgctggagtgcattggcatgattaaagttctctgtagccttgatctcctgggctcaagcagtcctcctgcgtcagccacttaagtagctgggacttcaggtgcatgccactgcacttggctaatttttttatttttttggagagatgatatcttgctgtgttgctcaggctggtcttgaactcctgagctcaagcaatcctcctgccttgaccttccagagtgctagaattacagatgtgagccaccatgcttggcccagagttgtgctgttaatagatgaagagaagtggacagatgtaagagattgcaggaatcgaattgacaggaattggtgattgattgactataagatgagaggggaaaaaaaagaatgtaagatgactcccaaatttctggattgagccattgaattaatagtgtgccatttactcaggatctatgaaaggaggagcagactttcaggggccgttgaagttgaactgccagtgcagacggtgatggagcttagaatataaatgggcatggaacctggatgtggatgagattgtcaaggaaaacatttaacaagaaaagacaaccaagatggaattccgggtgtagaagaaaaccccagagtagactgagcaggagtactcaaagaagttggttaaaaactaggagatggtgatatgacagaaaccaagggaggagaaaggagggcatggtcaacattatccaatgctgcttcattttttaataaggattaaaaatcgcccactggatttggcaattagatctcttatcagggtcatttaaaactcttctagatcctgaacacagtggtttctgaggatccaaccacatattacagcaaacattaaaatgcaccaaactccatattaaatttatgtcataaaaatttaggagattaacctttttccctttgaaattattacaaattaaaatgttctattttcttctgtatttgagtcagtcaatttttaatttttctaaaatgtttttctaaacattttttttcaaacattttataggttcttgaaaatgtggaggacctaggctgtcataaatagtgaccatattcaggctgggcacggtggctcatgcctttaatcccagcactttgggaggccaaggtgggcagatcgcttgaggtcaggagttcgagaccagtctggtcaacatggtgaaaccttgtctctactaagaatacaaaaaattagccaggcgtagtgggggctgcctgtaactccagctactcgggaggctgtctggagaatctcttgaacccaggaagaacagcctgcagtgagccgagatcacaccactgcactacagcctgggcaatagagccagactctgtctcaaaaataaaataaacaaaacagatagacccacattcagagaaggctacaggggccatggagtgaatgagtgatggagccaagacagttaagtatgaacttctctttcccagacatagcaaagaaaggaaagaaagagatggagagagcaaagaaggccgtaaaatccaggtagaacatgatttatttaagattggagtttttcacatggcttagaagaaaaatgtagcaaaaaaaattgatgactcaggagggagtagtaatatttgatcaaaatgctgcttaaggagacaagaagaacagatccagaacataggtaggattcaccttctttaatgtccctctttgtctgaatccagatggaaggaggtgtaagaacaggtggtggataggtgctcacatcctatagctatcattaataatgaaatgttaaaatcacaactctctcaagtaactgccaccaccatttggcattgttcttctaaagatcggagactacaataatggcagcaaaaggtcccagcagttaacaactctgtttcataaataatttcaaactactctgtgatgcagagtgctgtgtagatgcctgttggggtttggcccctgattcctttatgagccaagaagagtcaatgtactctctctataatagatgttggcagtaaaatgcccacctgtgtcaagcaaattgatttgtcaaaagcaccatctgataaatttgtcgatttacagagaaggcaggagctttatgggaagtgcattaactctttggggcccttggggcaacagaactaaatcattgctgcagtactaaatgatttctctaatggccccaaaagtaaatgcgtcccccaaaatctcagatgttcccaggtggtcattcaccctctgagacttaaaatgattacaaatacttttcaagagctatatcggtggcccagttctcactttgcagataggggaactgaagttcattctaggccagttagtaacagtttagagtagatactagccagcttaagtggccagctaataattagcattgctgctctgacaccaatagatattccagtgatcatctcagtaaatatttgtcatttgaagtgtaactgctcacagtaaaaatactccatattcattcccacagagtagacaattagctccaataagattgacttattgaatgtccttttgcaaaaattttattttagttgtggctttttttgttgttgttagatggttgtcaattgtagaaatagaaatgaaaactcaataaagaagataggaaaactttgtgatagatgctggaagtaggtctcaaatttcatgagcaagtttattaagctcatacactgaagacattgggtcatctttggaggtgttgcttaacaagccatgagtgtttcagagctgaagggggccttgaaagccttaactcaagagtgcttattttacaaatgaaaaaattgtctctaaagtggcccagccaggccttttgccttaagcttgcaaagtgagaaaacctgtttacataaagacaacacagaatgggggtcagggactcccaagacttgaagactagtggccacagaaagggggagaaagcattgtacatggttattattattatccagattgattgtaaaaaggcccaccaattcttgggcctcttccctcaaaaggaaaagacaacacatacacacacatgcacacatacacacacacacacacactcacctacacacataaagcaaaattagttaccaaatgataagcatgtaaaacttgaggcaaagaagttctattctgggcttatccacctctaacctcaaagcttacttgcatggctaacagcttttaggaacttcatgaccagatactcaattgtaaatttctctagaaagaaaaaaataaaagctacaataacaaaatgtactctgtaagcacagttgaaccttgaatatttttgatgttgcttcccagtgtattatgaatgtgttattataaggtttacatagaagagcaatgatctgtgtaatttcttgcctaaaatggtagtcttttggtcagttgaccaagaatgagaacagcttagggttctgggattgcatggaatgagacattggttttgtttgtttcgttttatcttgtcattggcgattagatttaggacataagtgccaaaataggccattttaatcaacattgggacttccctgttaaaatcttggctgagttcagtgagtttcacaaacacataaaaagcaagcttaaatactggcagagggtggcctgaaaaggaaattcagctttcttgctgaatattattattaatcaaaataagtataaggatcaaataattataattgcattaaactctttggggacttgagacttctgtcatttctataaactaagaatagctattattgaattcacttatgaatcacaattccttacacttatttgtcatcttacacatcacaaaatgctttcacctgttatgatttggtttgatgttcacagtgcaaatgtgcaggacaggtattattagccccgtttaatagatgagtgagttgaacttacgaatggtcaagagctctttccataggcaacattgcctctaagatcctcttagctgtccctttgtgatgaataatcacttctttgctcaaggaagaactaggccttcaaaggttgctgtcattttatataaatgttgactgaaggtgtgcacaacctgacctggaaatacaagaagtatgtcattgacatatctttatgatattcaagcaggttaccttttttctaccaataataattgaaataaattaaagagagtacagattaaacatatgttttcaattgatggtgggaatgtaaagaggctcttaatgaatttgttaacggctgtttccattttgctcaatgctcggttatcaatgccaatgagttttggactttgatcataataacatttacctgtttctttaaaagctgttttttttttcatactgaaggttaccctagttgcatagtgcacttttgccagcctgatgacgcttctgaatgcctccagaccagtgctccctaagaatctgtaaactattcttttcatgccagctgttgtgctccttttattcccccaatttgcatatggtgctttactgaacaagagagtttttctttcggtttcacccaatgcaggtgtgcagtcattctgtgagagcttttgtaattggctatgtaaattatctctcaggtccaagggccaaaaatatagtttttcataaagacaataaaaaaccacaatatttatattttattttttttcagtcttctgagaaaatctttctgccagtagcaacatcacaaacggcatcagtcattgtgggaagagttggcaattatttttctagctggtgtaggttcgtagaaaacaaaaattttcaaaaaccataaatacgtaataaaatgtattggcttactttgctttctggaaaagcccaccaaaatttcttttttgtatttacttttaaaatcttcccagatacttaagaattcctggactctatatcctctcagccactgttttttattttctcctgcagtcattttctataatatgcacttatctcagactcagaacaccaaactgaaataggtggaaaatttttcttttttcctcagttatatttatgtgtacggatgctaattggggtaaaatgaaggtactgtgaatcttcagacattatagaagatctgggcttgtcaaaatttaagtgcccttaacctttattaagtattgtaaccagaagtcctacagatatataaaaggtcaaatatttatcatgtgtacaaatctgaccccaataataatagattatttatcctacagctcttttaaaatgtcaaaaatcatatcacatctcatataaagaaaatatgtgattttcatgaaaactaatttcattaattattcagatgtcactagccaccaaattttagatgattttggacttaattccttctcaataaacataaaataaattaaacttttattgatatgaactattgctttactccaaattttcacagtccttaaataaaaatataaagcaggaactcagacattttcgccaaatggctcctttcacccttaagctttgttcaaagttttggccaattctatgaaagccccaaaaaataaaaaataaaaactttctctgctctgtccttaaaaacttagtttccaagttaaagtttataatcacgttaaagtcacttgacttttaatgtttacattttatagaaagaaaaaggagtatttgagttggcttctagtaggttccaaatgaggcagagtagagccttaaatttcttgtaatgatcagaaggcaatgcatcctttttattatgtggtaatctgttggctgagttcagattgccaacctctctgtaccctgctttggttgactagttggctcactcctctggatgttacataatagcctgtgctggtagagaaggggactcagacaccaactttaggctcagactgacttgagagagccatagtctcaattggctttgcagaaaaaaagtcatgttgtaccatagacatgagcagtttttctaaattctgtcattttaaatatgtcttctggtcacttctcttagttctctattgatcaggccactggagaaacataaggatttttacaaagtgtttgtctttccaggagaccgcattccggatatgaaagtatctaatccccacacactttcctaaagatggtgctaagtcatcttccctcactcattcttgctggagctcactcccatgttccttttgtaggtggcatctatttcttatccactgtaaattgtgccaacctgctttcttcagcagattgttggtgctaaataaatggtgtgatttgtagtaataatggtgatgataatgactcttaaaacacctaactaatcccagtgaactctcagtgatgtttaggctgtggaacacatggttgactaacagtgataatgactgaaaacgaggtgataaattgctatgcagattgttgatggcctataattgccttaaaagggggatattttataacagactaatcccatttaaataaatgtgtgtgtagcattttagatatataggactgtatctgtattttttaataataaccagctccctaaaatacaagatgcaaaacaacttagataaacactccttaggtcaagggccatgggaggtaagaattaaggttgtgtttgctctttcttgagtgttgcattgttcctgggtcggtaagcataactttagagactccaccaatataaacacgaaactacctagttatgagcctgtgtttacacagtccggatcaaaagcacagacactcaggttcatttgcatttgctgccaaaaatgtcctaattcttcttttgaaaaggagcaataattcatattttgatgccatttactcccaaggttaatttatatttacaaattttataacaggcctcatgttctttaccatgttgccagcactttcttttcttttgagttgcattgttcttttctaaggaactgattgtgtggcagatcgtcggatcattgcagggagcacagatgaaaagcctgttattccaaaggattaaattgcaattcttagtgaaccattgccaagcgattttttttttttttttttttttttacaaacccgaggaggattggaaataggaaatgttatgccttgaaaaggggtgggaatggttgaatggatgaggaaggacaatcatcctagtaagtgttattaaattctcttcaagtaaaatcatggagcaaataaatgataaaatctgtaaaatatccaaatggtcaggaataataagtaactgagtttgtaaagaagtaataatatcatgggatagattttgattgaatctatcccatgattcagtaaaaatttactcctgatttttattgaatgtagcatgtagcattaatacacaaaaataattaaaattccagctttactttagcattttcagggttcaaggactatgggggcagaggacctaagatttgcaaatcacttcaatacgacctctttggggaaggatagaatgtagtaggaaaaaaacaatgaaagggaatctctatcttggagcatgataactgagcacattccccaaaatctgacctgaaattaggaagagaaattagttccgtttgaggttctaaacaccaggaaagtttcatataacctgagaggggacaggataagtaaattttggaaagaaaacaccataaagaagagatgtttcaaaattcaattctgaaatatgttaatgaactcagaggaagataaaggatttaaatgcccaatgtaatggagaaattagagtaaggaggaaagaaactgacaatttaccgtgtgctctttgcaacaggcagcctacaggatgccattgtggtttctgtttgtgtattactctgagaatcaagaacaaactccacatgaaatgctgtaataaagagttgaaaaatatgcactgaaagtataccatgtttcaggcacatatcaagcatgatggtacatgcttgggattaaaaagatggatgagatacaatacctgcactctaaaagttcatagtatttgggagaaaagagagacatacaagaggatgattgcagtcaaaacattggagcagatgctacaaggatatgtaatacaaatgaagttcaagaatcacaacttgctttgcctgggaaaatcaataaatgcattgaaaaaggggtagtgtttgagttgggtcctggaggatgagtagttcttcaggcacaaagaagacagatgcaaaggataaggtgcatgcagtgtgataagttcagagttgcctgggttgaaggagtcagcaggagaggagtttggaggttggtggggttaggctattgagggccttttgtagttgctgaggggtttaactttaaccagttaggtgcaagacagtgttaccagctttaaaacaagagaatgatccaatcaaatgtgtgtctcagaacagaagctctggcagggagggataggatgaggctgaagtctgcaggtagcagtcaggaggcagttgcagcagggacaaaggggagatgagagatcagattccatagatagtttggagatgatatgagtagatctttgggagatattaaatgttaggagtgaggaaaaggaaaagttgaaggggtttgcagctcctaaggttgtgataccactaactgaaataaagaacactgcaaaaggaatacatcatttatgtctacagcagggcagtatggggggtggcatgcagggaaggctagcagataggttgttaaaatcctgcctgtgtagtggagaagactacagcttggagagaaccaaccagaacagtgttcttaccctgccccaccctattgtgtccctgaggagaatcatgggtcaagaaacatttgattggaattttgctaattttttatctattaaaaatgctatttatttttattgatttatttatttgtttttttgagatggagtttcgctctcgttgcccacccaggctggagtacaatggtgtgatctcggctcaccacaacctcagcctcctgagtagctggagttacaggcatgcaccaccacaccacgcctggctgattttgtatttttagtagagatggggtttctccatgttgatcaggctggtctcaaactcctgacctcaggtgatccgcccacctcagtctcccaaagtgctgggattataggcatgggccactgcacctggccacaaaatgctatttttaaaacaggcacattcaagcctgccatgtactgaatattattacaatagagaccaacaacatgccaactcgtctcagactaacctagaatgtggctctcagaacaaatgaagttccctctcattacttataaatggaatagtgtcctgatattacaaggcaacttgtttaaaaactcatatttttaccatttccaacagcttatttttgttgtcaagaaaatctcaatactatgcaactagtaagaaatcacagaaatatcaaaacagtcttacttttccaattcattgatatgcataaatatgataaatttaaactaatgaaatgtttatgaaatattcttatttatttctcatagtctatctgatatattaatagtttggatatttgttgctgcccaaatctcatgttgaaatataatccccaatgttggaggtggggcctggtgggagctgtttgggtcatgggggcacatccctcatggcttggtgctgtctgcgtggtagtgagtgtgttctttctgggcccattccctctctgctcctgctttcaccatgtgacatgcctgctcccaatttgccttctgctttgagtaaaagctccctgaggcccccctcagaagccaggcaggtgccatcacaatgcctcctgtacagtttgcagaatcatgagctaattacgtctcttttctttataaataaccccgcctccggtatttctttatttcaacacgagaacggccttacacaccatcgtatatggattgtgattattcataagatttctttgggttctacttcttaaaaagttttaaaaacactgaatataaagtatatattacatttatttctcctgaaatttatttctcagattgttaatcaggtcttcaatttttggactcatttaaaattctaaaattgttcttttgctcttttcacacacatatccatattcttcttctggctcgccacttctccttctgagcttgggatttatgcaagacaataacgggaacaatctgatatggcagcataataaccaaccaaaatatgtcttttctgtttttcattttgcttgatcatgacaacatcaaaatgcaagaatgggtgaactgttttgaagtctaggttttgaaaacacttgtttgctggtgtggatgtgtgtgcatttttatatttaacattaatagcagctttctctgtcatttttacactttcgtttcaaaaacagtggcctggacagatcctggcaaaatacattacgtggttatggtagcagctaaaatgtttgtggaagaataaaaatgtacattaatacaatttacacttattttattagtttatgtaatcttatatgagcaagaatcaactcttctgttgtatataactttttaatatgttatttgaacttcatcaacagcttcttgattgggtctcaagcattaatcaggcccctcacaagtactatgcgaggcttaaacatcttgcatccatcataaagaataagtaggaccataatgactaatcacattagcataatttaaaaatgcagagcgtgaatagcttttttccccaagatttgtagtaaaaacatatgcacaataagactgaaatgattcattacaccattgacttgtttatattataacatatttatgtgcccggcagaatgaaaccataaaactgccattaatgagtacaggaaagaggttctgtttttaactaaattacatgaattcataatgaatacattttaaaaaaattattttaaggaagggatcttgctatcatgttgtgtccttttgggacattacaaaacccattctcatcatagatcttttttgtcatctacactttgcacttttcacttaggctataagtaaatttagcaatttatgaacaagtttctgcccttaaagccaaacaataagttgcaggtggagtcacttcgtattgcagaagcaaacagctaaaggaaaatgtattcttaggggaaaaaacaagaacaaaaacacctttttctttgtagccacttacaaataaaaaaaatcttgccaccccaatggatatgagttcactggtcccctctcggaactttgggatgtctgctttaggattgaatttgtctgctaaatactatttattgagtgtcaggcactgagcaagatgcttcagaggcaacaatgaaaaatgacaaacatagtagtgacttaattgccattgccttaccatctggtaagaaaagcagaaagagaaacagacatttaaattatagtataaagattttatcatggaagaacaagcaaggcgtccaggtgcaaggacagtgttgatacctgaaggtaagcaggagtttgccatgtgaaagggcatgagggttaaacagaattattccaggcagagggtagtattctatgtggaatgtttagggaaccgagaatagtcattatcaaataattgttgaatacatgttgactgcatatagctaaaccataaatcccaagaaaaaatatagcaagagatgaagctagacagtattcaggggtccagatttattcacttaaccatattcaggagctagggaaatatcagtgtgcaagatagacatggtattttctctcagggagcttattgtttagttggggaaacagataaaaataatcacaataataatgtcaaattgtaatgaatgcaatgaagaaaacaaacaagttgctaagagacaataacaagaacttactttaaatgggatcaggatgatacctctgaggaggtgagatttgaagaatgagaaggagtcagatcatgaaagtctggggaaccttattaaggagctatggctttatcttgagagttacgcatgtttaaagattttaaataggggaaagatgtcatcaatttgcattttagacaaatcaccctggctgctatgcagagtctggagatgaataagtcaggaggtagggaaacaagttggatggtgtatttgtctgtttcattgctataaacgaatgcctgagactgggtaattaataaagaaacgaggtttatttggctcacagttctgcaggctatacaggcatggtgccagcatctgttcagcttcttgtgaagccacaggaagcttacaatcatggtggaaggcaagggggaagccggcatatcacatagtgagagacggagcaagagagagaaggaggaggtgctaggctcttttaaacagccaaatcccgtgtgaactcatagagtgagaactcacctgttatggtgaggacagcataaagccattcataagggatctactcccatgacccaaacacctttcactacacccaccttcaacattggagatcacatttcagcatgagatttgggggggacaaacatccaaactatatcagatagcttttccaggaatctgggtgaaagataatttcctagtgctagaatattttagtcactgtggtattaggcagggataatattaaaatacttagctattttggcataaacattgatccatcagaatggatgcaagccttagcactagagcagagtcttcaggtgtctgctagaccaggctggatggggcacgtggaccccagaggtggagccagcacaacaggagcttaggccagcagttctttaaaacaaatatggacatatttcagtattttagcaacagatgctgctataccagcctaagaattaggtatagagagccagggaaatatccaggagatgattaggaaacagaaggcttacgttttggtaatgcgaaagaatgccaaagggaggagttaatgattaggctctggtttctgcttgggaaaccaggtaaactcatgtatgtatttattcaatcatatttgctcagcactttacatttaagacatctatctgagagacttgcaatatcaagtgggcaattggatatatgagtaaggaaatgggggaatgatctgggctgaaaaagtaaatttgtgagtttccagcataaagatatcatttaaagctatagagtagatgaagtcccctagggagagaagcaatagaacccaggacagagtcctgagcaactccatcatgtagtttgtgaagaggagaaggagcctttgatgattgacaagtattcctgctgaaggaaggaaatcagtcttgaaaggtttcagaagatgagtggagagtatttccagaaggaggagtgagtggctggctgtgttgaaagctgtgtagagattgagtaagaaagagaagactggagtctctgagggatttagcaacatggagatcgtcggtgaccttgataaggacaattttagtaggtggtgagcgcagaggtcggactatctagagttgaaggtaaatgagcagtggagaaagagagctggtgagtacaaaacaactttttgcggtgatgtgggcttctttgatttttatttaggggagggacttgagcaagtttaattgcaagtgggggagccattgaggtatttcgatagattctaggggtgtacaaactagagctcctgtctatttttgtaaggaaaattagaagacagccaccctcattcaattatgtattgtttatgactgcttttgtgctacaagggcatagtttaatagttgtgatagagacctatggcccacaaaacaaaaatgtttactctctggctctttataaaaaaaagatcgccaatctctggattaagctaaaatattacgtgcccttgcccatttaatttcccccaggaaacccaaataagtacatatgtatataaatgcatgcataagcacataaaccaaataaagaatttgtttcccaaggcaaaagtgcgatggaaattctctctagtcagtttaccaatttatcaacaaaaaagagaaaaagactttgctcttctgtcgataatacacttatagctgttgttgacaatagaaattagcctattgtagtcaccactacatacccagtacctggtgctgagcctgacacatggtaggtgtccaatacatattgtttgaatcaaggaaggaaaggtaccaggtgctgtactacatgattgcttggagcaagaagcagaggatctttcctagatttgggtagatagcggagaattcccaaggtaaatgagcttatatggagctatcccagtgaggtttgtggaacctggaataaatcacattcctttagaattaatttgagaggtgaatgggggaatgggttggggagatgaagtcaaagctcatgtcaagagtaagctcaatatggaaacaaagtcacaaagaggcagtgtgtagcttggctgcaagaaagggccatccctgcagctctttatttgttgcggtgaaacagcaaatagagatgagccaaatttatgtatagtccaagccaacttatccctcaggagtgggaccaggagttggtctgttaaaaagtaggttaaagcaacaagtcaaaaaatgcgattttccacaaacattttaactgaaaaaaaaaaaatgtatatgtcatcagttttccaatcctttgacataggggcaaggccttttcttttctttctttctttttttttttttttaattgagacagggacagggtctcgctctgtcacccaggctggagtgcagtggtgtgatcatagttctctgcagcctcgacctccagggctcaagcgaccctcccacttagccccccaagtagctgggactacaggcacatgccaccacatctgactaatttttaaaattttttgtagagatgaggctcattatattgcccagactggcctcaaactcctgggattaagtgattctcttgcttcagcctcccaaagtgctggaattacaggcctgagtaaccagacctggccagcaaggccttttctttgagcacaggacatcacagaacatcactcttgaataaagcacaactcctacatattaactaagatttaaagtatggatttctttaaaggagagtgagagcttatagagaaatgggaagaaatctgagcacagcatccttctagatttttttccacaatctttttgcagctgtattactcacactttgtgatgctttcaacttgttttcatagaaacagctcttttgccttcacattttattgatttatataatatttaatgaaatcacatcattattataataaaatacaactatcataaacagatttaggaaataagaactgcttctcagggagcacataattcctatcagagagtagcctgctaattttgttctgtgttggggagcattatgatacaaagggaatagagactcactgattctggtgagtccaggaagggaaagcaggttaagactgttgtcggcaagggtggtacaagcacgttacaggcaacagctggtgctccttgagtcactgacaagctgccagaacagctaggtcccctgaatattgacctggggcagctgtaccaagtcatcccactctagggaccttggagtattgtgtgttggaaagcatgtattaagcacttgctgtagctgcttctggaatacagtatgtggaataatagctgaatcctcctaacaatgcaactttcagagaattgcaactgatgagaaaccagccttgcttatcctgtagcagatttagctttggaaagtatacttaaaattctccaactgctagatctagacagagacggtaaaatctcagtaaacttattctggcagcttgttacatggtaactaacaaagaacacccaaaatagtgggcagaaatcactgaacaatgtaaaaatcagagtagtggttaatgtattaccatgaactgagactggggaaccctctgttctccatcaaatgcctacccagctttctaacttattttgagctaaatttgggctgataaaaatgattctattctctactaccaatattttggaaaattatttccaataatgtggaaacgacagaaataagattgccctgtaaaatcaagactagcattgatgaaaaataggtattcagcatcttaagaaacagaatatttccaatttaagaacatttacaatattaaatattctatattgagatatttaatggtagaagttgaagaagactaaaaagttcagataccttctttgacagatgtggatatcaagacccagaaaggttacatgatttagtcaaggacccatagccagttatgagctaatccagttacaacccaagtctctcaggtcctagtctaatgttttctcattataacaccctccttctacatgaaatcttctgataagttggtgtccttagtgacctggctactgtagctgagtcataaattaccccataactcaatgatgtaacacaaccatttagtatgctcactgagtctgtgcattacagatttcgcacagggcactgtagcgctggcttggccctggtcttcgctccaaggctgagggctgggattatttgaaggctcattcacatgtctgctagttgacccatcttggaagtcacacagcatgacttccactctattccttttttgttgaggcaatcataaaggtccaccctagtacaaggggatagacgccacttcttgatgggaagtagcaagatcctcgaagagcatgtgagaccagaaatattgctgtgactacttttggaaattacaatttgctacaattaggaattaaaagaattctttgcaagaagaaaactagagggagaaaagaggcagaagaacaataacaaatcatacctgcaggctgagtgtacctactcccatttctctccctctggggaacttcgcaatctgtgcttactgcaaattgaataggaataaagcattttaactcaacatgattgaagcttttatttcatttaactgtctagtttggtgtgttggaaagtatgtttataagatatatccctagcataaaagccttcacaatgaggaaaaagggagaaattattttaattgaagaaattatttttttaaatagcttatatactagactataaagaaaacatcaataaatctcttaaaatatgaagtgcacagacatattctctgaccacagaataataaaactacaaataaaagtacaaatcagaacaaaacatttcaacaaaaatttcccacccacttgaaaataaaaaaatatacttctccatatctcttgggcataaagagggaaatatgattgcagttacagaatatatagaaaataagaatgaggacactacaaaagtcatgggatgtgacacaagttagatttaagtggcatgtaaaccagtgaggaatgaataaatgacaacaccagcagcagcaatggctgacacttcatgtgttggacacttggagctttacacgtataaattcagttactccacacaacaacctataggtagacactattatgttcattctcattttcctctgaggaggaaattgatgtacagaaggaatgagtgattggagcaacactgtgcaactagcccctatcatatgccaggcagtgtccaggcactaaggttgccaagatgacccaggcaggcaaagtccatgctctttgacagctccccattactgctgggcagggcgggaattcctcttcccactgggcctccacagataccctcctggcagggaggggtagaagtgcctcataactcctctacatgaggcctccactgataccagggtgaagaggtggcctcatttccactgggtcatggtgaaaaccctgaagctccaccaggcctcctctaatggcaccccagttaggggtgggagtggaagtccaaactccctatgtggtctctactggtactggggagggggatggtggaggaaagtgtgtgtcattactgcctggtgctccctactcagcattctttcacagcaccttggacagcatgttgggaggacctcaatgtagcctagcagagggttacagtctaggcttcctagtaggacttgtttagcatagatgggaatagggccacagtttttttttttttttgtcattttaggagtggttattgtctaaaagttttctgttttactaggctgaccctttcctggttctttggcttgacagatcttgcttttgttgaggcttttttttttttttttttttttggtttctgcctgttggtgtttgtggcttattgtggcttaccagcttattcagctcaaagcctgggatatatgaggcaaacaaacaaaaagcacagagaactattactatgttgttcctcaggttccaaatcccccatctggtctgccttcttctctccacctttcaatgtttcaatatttcttttatatgtaatgccaagaggttttcatttgatttagctggaggaataggggaaagtatgtctattacatcttcccagaagcagaagtctcctgttttgttttttaagaaaaaaaaaatctgacagcatgtgctcattctcagaccaaaaagacaaacagaatgacagggagttatatataatgataggtagaggggaaaagtgggatccatgcactcaagcgtttttcacttttgcatttgtcacttttttgacagttcatcaaagttacaagaaggaaagctaagaatatacagtactacagattcaaggagtttagtggatttggtggtgggtgaatgagaaagctctccactgttggattctattgtccccagtagaatagaagggaatccaccaattgagaaaggagtcgctcggggaaggctagggatttgcagagaggaaggtgtgaatcagttgctttgaaaggtggtagaatgaactgatagagaaatagagtaggattgctgagcatactgaagccacatacatttcgaaggaaatcagtcagcatagttgcttgttaccttccagaactaggtacagagtaggtgggtagatgtaggtttaatcagtagttgttgccagattaaatattagaaggggaaaggaataaggacatggaaggtgtgtgcaagggagtgattatgatgatggaacacaggatcagtaccacagcatggcacaattgcagaaggcacattgcattttgcaacacagttaccctgcatagattctaatctggataaaaatgaatttaagtttaggcgtggtggctcaggtttgtaatcccagcactttgggaggtgggagaatcacttgtgctcagaagttcgagaccagcttgggaaacatagtgagacctcatctctacaaaaaataaaaaacttagccaggtgtggtggtgcacatctatagtctcagctactcatgaggctacaggcaggaggatcacttgagcccaggaagttgaggctgcagtgagctgtaactgtgccactgcactccaacctgggtgacagagcaagaccctgtctcaaataataataataataataataattttaagatgaatttgagaaggtggacagtgaacatgaacatatgaggatgaatgggttggcagtcctaatggggttgaataactcttaacatagaactgataaattaaaggaactcaaggacaggagatgttggccatagggtagatatttgaaatttaggaggtgaaacagatcttggaaatgaaaagttctagggtatgagaatgggtagctgaagtggggtggatggaagaccattggcaaactggatactcttaccaaccctcctattgagaataattaaaaacaatgaataaaatatagaaatatgttttaaaatgcatcaatgaactggtaataaagtaaggccaaaacaactcaaagcaaggccctagcaagatgacagaggctctaatgctggcttctgtactgagcagttttgacagatccaggggatcttgagctccagttttcacagccttgtgagatgtggacaataggtcacaaagcctaggtccagcccaaagaaggtagtctaaaagacaacatcctacataaagctcgaaagggtataccagaaacaaaattgcccccacagcagacaacaagaaaatttgcttatcttaaaacttggcactgggtaaacaagaaggaaaatctccccgaaagtttataagtacaagccaacccttatgtgtgagttttgctgcctgagttttactacctgggtggtctggaaaaacttcaagctgagaatttagtttaaagtggccctccttcagtagtacccatgggcatctggcagaaacaaatgcaaatcctctttaaatgaactcccttcaatctaggcttcaaagaattcccatagaaatatgaatccacagtcaagaaacaaaagcaccgtgaatgatacccaatacaaataataagcttctgaatatcacccacaaaaaactttagtcaggtactagaaagatgatacaaaatttatatacaatttgtaaggattagataggcagaaaagttacatagtcatcattcgcagatgatgattttttttgcatagaaaatacaaaagaatctgcatacaaattagaattaagcctttttagcaaaattgctacttataatgttaataatttaaaaatgaatttatttatagccacaaataaaaacaggtaacatttacaatactataaacatattaaatacctagggataaatttaacaaaatatgtataagatctgtacacaaaaaaatcataaaattattgacagaaattaaaggacgtttaaataagtagaaagaaatactatgtttatggataggaagattcaatattgtaaagttttcacttttgttgtaattggcccatatatttaattcaattacactcaaatcccaacaaagtggggtttttggttttgttttgttttgtttttcttttcgaggtttttttttttttttttttgaaggaggacgggttgaagagtggatagtggaacttggcaggttgcttgtcaaatgtatcagagctggctgatcagagctgaaaatcagctgggaaagcataggctttaaataggtgatgctgaaacaactggttattcctataggaaaactcaatttgaacccctatctcacaccacatgccaaaaaatctattctagatggattaaagacttaactttaggtagagctttaaaacttttgaaggataatataagagaatgcccttttcaattaaaggaagggaagggtttctgaagctaaattgaaaagcgcagatagtaaaggaaattattaaagtcaaccacattaaagttaagatcttctgtacataaagagatacctaaagagagaaaaagatgagccacaaactgggagaggggatttgctatacctttgtgtcaaagaattagcatccagactacataaaaactgtaagcccataaaaaaaatacagcctaatttattttaaatgggaaaaggatttaaatgggcctgtcactgaagagaaaacacaaatggtgaacaaacatacgaaaatatgctcaacttcatttgtaatcagggaaatgcaaattaaaaccacaatggcatattatttcaatcccattagtttgacaaaagttttaaaatgtcaaataacaagaatgagaaaagatgtggaaccactgagttcttatacactgttaatgagactgtaaattttttcaaccattttggaagaaaatttgccattatctaaaaggttgaaaatgtgcatgcctttgatccagtaatttcgcttttgatatttggccaagagaaattcttatacgcaatgtactgtgatacaggtacaaggatgttcatagtagcattacttgtaatagcaaaatctattcattaacaggagaatagatttaaaatatggtatattcatataattgaatactatataacagtaaaaatggatacactgtagctatgggcaacaacatggatgcatctcaggaatacattgagtggaaaaagcaagtcaccgaacgatctatgcagtaaaatttcaatttatatagtttgaaaccatgcaaaatcacatattatatatgttcaggcatatgtgcgtatggagacaaaagtgactccatcttggatgctaatcaaccatgttgacttctgattagccccagtcccatgaatgcctcctgatttctgttttagttactgtccttagtgtaaaaacatgtactcctacttttagatcaaagcaaccttgatgttatcgcacaaattataggctgtgacgcacatagcattctcacctgttctggagggttgcctttcattgtcttgctggagcacgtataccttttccctgtggtataaagctgtggttctgaggattaacaatgcgaagatctgcttgtcttgtggccacccaagaccacgcttctgtttgtaagttctcttaataaatcagccaatactgacaagctggatttatttgcctccttctttggtttctcggctcctttggcatttgggggccacttggcatatatggccctttcatggaaaaatatgcatgtggtaaaatacaaacaaaataaagggaatgatgagcaaagaaggatgagattggagagggacgcatagaggattagatgtggtgtttcttaggatagtggctacaaaagtgatcactgtatagtttttaaaaacacttaaacattcattttataaatatttttgtatatatttaatatttaataaaaataaaattccaaagatctttggggttgaggaggtaagagaggtttatcacagcattatttcacgctggaaattgggaaacagcaaaggtcacataagagactgtttaaataaattaaggtgcgtctatacaatggaagagcatgcagcaatgacagatgatgtgttagaaatgtacgtactgataggaaggatattcctggtagagcaggtgaaagaagaagattatagaacaacattgtatctcatttgtataaggaacatgtaaaaatacacatagataagagtattaaaagtgacgcctataatcccagcatcttgggaggtcgaggtgggaggattgcttgaggctgggaggtcaaggctgcagttaactatgattgtgccactgcactgcagcctgggcaacagactgagactctgtctcaggaaaaaaaaaaagtgtttagtaggtacaacggaaagttaacaatgttgggatctgggagttgatgttaggatttatttaatttattttcttaatttctcctagttttccaccacagacattattactgttatatcaaaaccatgtcagagaaagaataacaaagaatgtctaagaaaaatcagacagaagaatgtaaatataaaatatttggaaatgaccttcacaaaatatgcttcttattctcttcttagagctaaaaaaagacttgatgataagtagatgtgtgtgtgtgtgtgtgtgtgtgtgtgtgtgtgtgtgaagtttctggctaaatataatgaagttaaactcttcccaatttaatttgtaggattaaaacaatcccaaacaaaatcccagtggatttttttaattgataaaatgtttctaaggctcatctggaagaataaatagactattaataatataattctgaaaattaagaaataagaagttagacttgctcaaaacgatattgaaatgtatgaaagtgacaaccctttccacaatgatagttaaataggaagctcttaaacatcgaatagaaagtgcttaggcatctctttgtacttttaaaaacagtatatgatgaagtaattgtaacagagaaagtgatgaattatttagtaaatgatgttggaataatggctaaagaaggataaattttcaccttaaactgtattctgaaataaattctagataagttaaagaaatataaaaaattaaaagcattataaactacaagggaacacagaaaatatgtaacagattccggatgtcatttaagtcactaaatccaatgactgcagcaccagttgatagtcttgactgcaaacgctttttttattccctttgcttcctttggctttcataacacttccctaatttttctcttaccagtttggccactacttctccagtgactttgcaggattatcctcctctggggaccattatatgtttgagtttctctgggcccatcccttctctccactgtcttccaaggattctcatcatgcctatggctgtagttaccacctcctgtcaggtgactctcaaactccagcctaaccatttccaacttttcagtattagtcaggatccatgcaggaaatgtatggcacattcaaaatgggtaattaagaagactttagttaagagatcatttacagagggtttagggaaggcaacaaaggataatggtacagtatctcagggaacattactgctttaggcctaaacaaggaagcaggtggaaatgattactgaatgagagtgagagagaggaggaggtggcaaaggagtggtacaagtaggaaaaggtggggaagaggggcaggagaaggaaggggaagagagaatgcagtatggagataatatggaataaataatcagcctccacgctctgccttcagtcttctgcttctacctcccattggctgaacctaactagaagacagagaacacgggaaccaggtgctaaggttacatgggatgttgattcatttcatacaggtcagtctctctggatacagcagaatagagaagggtggagagtggctctatgtgggaaagcagaagatatccacctagcattcacctcctacctggcttcttctccaggacatcccaagagcatttcaaactcaacgggtccacaattgagctcataaactgcccgctgcataccctctcctctcaaaaaacaaactaacaaaaatccaaactggttctttgtcagtgttttccttcttttttgttaacaagtttattttcttgcatttcttattttaaaaattttactgtatatatttaaggtgtacaacatgatgtttcgatatacatatagaaagtaaaaaggttactatagtcaagcaaattcacatccattatctcacataattacttgttttttgtgtgtggcacctgaaatctactcttttagggaaaatctcaagtacaatacaatattatttcatggagccctcctgttgcacattagatcttctaatgttatcttatgtcatcaaatgctatcaatgtcaggattgaattctcattaccatggaatggattaaactggggcaagagtaggagcaaatagatcaatgaggaggctgttccattagtgcaagcagaaatgatgatagaatggactaaagcagtgttggtaaatatgaagagaaatggacagattaaagtggatagattaaagagatatgtagaaagcaaaagtaataggatttgggggtttgatagaattggatgttgggggtaaaggtaatatggttgtcaaagatgacaccatggattttaggaaggaggcagcactctttaacacggacttattaaccctgcatagtcagcttctcccagctccatcccccaacctctcagcctttccagcttcatcttataccaagaccctctcaggatccggtggcgtttactttcttttatccctcttatttcctgtgcttgttcctgagcaggacctttgcacctatagttcctactacctgtaatgcccttacccagctacctgactccttttcatcattcatagttcaatcaccgtttccccagggaagcttcccctgatttccttagttagtcctaattttcctattagagctctcatatattgtgtaccttctctttgtaggatctgtccactggcagctcacacttatttgggtggcttttcagtttaatgtttgccttaccctcggtccccccactaggatataaactaggatataagacagggactgtatcttttttggctcgcttgtgtattatagcctggaaccctgtggttgctacgcacagacacacacacacacacacacctattagtgaatgaataacagtaaaagcaatggaatatatcacaaagaaaaatactggtatatttaattacattaagactatattcttctctgaattaaataagactacatagcaaataatgaacaagtgataaacttggagacatagtcataataaatagacaacaagattacaccctcaatagagttcttaccacatcaacaataaaaacactgataatgcctaataggaattggcaaaaaccaaataaaaaactccaaaaatcccataaagagaaagggttctgacagcttctcactgtaaaaattggaagcccaaatcaaactaacctaaacactaaggaaataatatatttttgcatgtaaccagaaagtcaggttgacttctctgaggttcacaagataacacccagcagcacgtggggacaatacgctttcctgttcacattcatcagaggagaagtggaacctctctctctctctttttttttttttttttcttggctcactgcaacctctacctcctgggttcaagcgattctcctgcctcagcctcccgagtagctggaactacaggcacccgcgaccacactcggctaatttttgtgtttttggtagaggcaggctggtctcaaactcctgacctcaaatgatccacccacctcggcctcccaaagtgctgggattacaggtgtgaaccaccacaccaggccgtagaatctcttttctagcaacaaaatacaagtgcttcttctcagccttattgactcagattaggaccaacctggattaaatctcttgtcacaggaatgctatgttttgattttgaacctttcactagccaaagagattggattactatgcttggttcaatagtaatcaggactcattccgagagctggggtcaattccagaaactacattgttgttgaggagtgaaacacgatgtccactgtaattggccataaccataggaaagaaatggtcaactttaggattgagggagatagaagaaaataaagacagctgtgaggcatcatttttcaactcaaatttaaagctggcttttaaaattacaccattcactgaaaatggattataaattgatttaacttttctggagggcaatttggcaatatatgaagcacctttaaaacatttatgacaaattttggaaagtatacatatgtgtagaaataaggaaacacaaaaatgttcatgtggctgccactaagtggtaagtttatagatgattttaattttctttttaatattttccatagtttttaaaaacaggcctaattacatttatttaaacacaaagaacgtgaagtaacctgttatttaagaacatggacaaattccagtcaagaatatcctctagaagcttgagaggtgggaaaagtagtttgggggatttatttgctctctcaaggtgatgaaaagaaaaatatctgaatcaaagagtctgagttatggaattctctgcttctggggttctagtgcagccccgttggtctggaattcaggaaaaaagatacaaggcataaaatcccacagaaagttacacagttgcaacagaacatttagcatttattgcttgttcttctaattaaacctctaattcaactcactaggcccttgcctgctagctttagtgagtaaagttgagaccatgtgactggacttagcttgatttaatgtcatgttcattgaggagaatggttggacttttttttaaaaaacatgagcataggaaatatctgaagtcacttttaacactagtctgaacatgtaggataaaggaatgtgtgttactgaattgggatttccaatagatatttaacccaatgtgatttggtgatgatgttctttcttcagatttaatttcataatttcctcacttatctcagaccactccctcagttcgctttctgccttaactatcacctctaagtaacatgggataagtcacttaacctttgctgtatcctttcaaaaataggcctctgtcacggaatttcctctctctaaacatctctaaagttctgttggtgtgaagaattagtacgtctcttctggttatatgaatttaagaaagcatttaggttaatgagggaaaattgaattttaatggtcctcccttaaaaggctttacaaaagattttttagctagatgaggtgggaatatatatgctagcaccagattccacttatcagtcatccagcagttacagcaagccagcagctctgcctgcgcctgagttggccatgtatagacaagtgaggactgcagaggcaggaaatatggggttacgttgatttccctctattagcagcagcttaaaccggcatgctgggcagcactgtctcctattggctacagctgctgagagcagcaggatgagggttgacctatatctgtcaggtgtaggtcaaaccctgaatttttgttgcaaacttcagtcttctagaacgccaagtttcacttgtgctcaaccacatacaatatttttatcaggatctgtgatatactccacctgcaaagagcttgcatctgtgggtttccctctctggattcttttgctttctttcttgctgcctctccctcctgtcaccctcttaccatttttgtcccctgcttccgtgtcatcctctggctgagaagggttgagatggtcacagctgtgctccttctagtaatcacagtaacaccagcccttctctgcctgccccagtttccatctgaccaagctgtgcccgttcctttcagttgcagttattgccccaggttggcacagcctgtgcacatatgtgctcctctgggccaccatggtttcggaatgtgtcagttgctaattacaactgcagctgtgcacagaaatacagcacacattcaaaatgtgggtcctaaagttcctacacagtaaatatttcttgatagttttaaggccattttttttcttattttttttttgtaaagatagacttttaagtatttagacatgtatttttctagatgagagaataaactacttgaattttcatttattcagccaccatctaactgtgacaaaggtcctttccctctgcctttggtctcagtcaatatatgtatgttgttttgggacttaattggtattgtgtttttatttatttacactgacatcacaatgtgaaacttaccatagtcagtcctgccttcatactaaagcatcagtacactgtgggcttccacttacaatgcagaaactgcattccatgacccgttatcatttcttcactgaggccttgtagtaatagtaaagaagcccaaatgctggaaaaattattctagaacctcaggtccccatgcgtacaaactacatcacagtaatttgagatggaaaagacctattaagtcatcccactgattctctgaggacctgcggtgttttttccctctccaacaggctgatctactttttaatggcttttccaactgtaaatggcacaagtgatggggtttccacccttcccaaggctgtacagcctataatagatctctccattagggcctgtgactcgttcagctgcctaaatcatctttgttttgactttcatttaccatcactcctcctgctgtccccttgcacactaaataatttctctctgtccccactatttacacccttcaagtacttgttgcccatgagccagtcccgttagagccacatggtcatgctgagagacttgtctctttcatcttctctctgaaggctgtcccttcagacttatgaatcatatttgttgctcttcaatgaatgcccatcagtttcttaataatttgcttcatttctttgttactgacactgctcaggaaaatcttctttgtctccgtcgctgcaaaacaagaagataatggtagtagaatctctgctaacagaaaatagagcggagcttttcagctaccaggtatcttcctacccaggacaatggaatcatctaatcagttatctttaactctcttacttggggtgcacaattgctatgttaacaggtgttaggtgtgcatgtggagacagggatagttcatctatattttatctgggaaggctttgttgtggtgtatttagttaatgcccattagctgtttaagtcatatttccccaccaacctcacttcccagttggaaaagcttccttgaactccctcaagagaatgctaacctcctcctttccattactatgcctatgtttactgatactaaattgtgtgacatcagtgacatcagcatctttgccagaggaggaattcctttgctatgagagaggcagagtgtgccctttaccttgaatgaacatgaatggtacggcaaaccgggaaattctggcagtgggttttgtaattccagggttaatagtgttcagcctgtcccgtctgtacccctctccagagcctactccctggctactgtgtgtgcttatacaccatctaaagtactgaatttaataaggtctggcctactgtgctcattgttcgtatttatgcaataataataataccaacatagtgcttcacaaactgtttttgtctaattgcatcatcccatttagtagttccaaccatcccgtgaggaaggaattaccatctttctttcaccagggagcaaactgagacttagagatgctctattgccacaaatttcacaaacatcccataaattctcctttggagtccctcttgtcctccctctgaaatcactggagaacatgctttctgagcagtatgtgaagaggcactaactgcatataagttcctaaagtcactgaaatgctggccatggcataatgtttatctgtgttctccttttggcaaaaatagagtagctagacatcatccacagttttatatgaatcctattatcagtaggataattcagttgttacacgatgacagaaagagtatatacaaattttaagaaatagcttgctatctcttcctaaacaataaggtaatattattaggcatggactaaaagtgagcttatctattcaaacaccaattcagaccctaagggtatctgtttttcctgcaaagttgatgagattatacacctaagataaaagaagaaagagctatatttcattaaatgttaataacatgatttgaagaagcaaagaaccgaaaaatactgacttttatttatgaataatataaaaagcagaaatataattttctaccaaatacatggtggtaaaggaggcacagcagcctaaaattatgttaatagctaagcaaaagaggacattttatttattctacaactgattttcaaataggcttaccaatattttaaacttggcataaatgtggttatggtaggagaaaagcctgtactaaaagggttttatcctttaacaaactgaagtgacatcaaataaataaaagactcttcagctccagcaatctgaagaaaacccaggtcaagaaaattatgcattttgttgctacctgtacaagtagtccattcctttttattgctgagtagtattttattatatggatagtacacaatttgtttatacattcacatattgatggacatttggcttctttccagttcaggggtattataaataaaactgttatgtatatttgtatgcaaaacaaagaagaaaaataaaattatgcacttaagtgaattgccctcttctgtggcctggccagagaaggcaaattgcaagtgtatgcatatattgtccacacacagaaatgtttagaagttaccatgtctatcaatagggagggaagaattatttcttatatattagcttgcgggcccccactgtctcatgtacggctaactctaaattcagctttgtggctggactggatggtgcctgtgactttctaggaaaaaaacgaagccaatgcatctttgaagatacatccttaactatgccagctgtaccttacagtacccactgtttaaccgtaaaaatgggggggaggggtaaatgctatcatacttactgctttttaaaattactgcaaatgcaatacatgcttactacggcaaaatttagaaacacagaagaggaaaaaacaaactcagatacttttcattccaaagtaacaacttttgacacacccttccaagccttatctacatacctatatatgatatgtgtgtgtatatatattcatctttttaaaacagtaagttttgggtttaaatcttccatagtactaactaattgactactctgtcctttaacttaagatctctgaagcccttattgaagaactgatgctgttttgggctgatataaatagggtgacaaaaatgctttagttaggttttaaaaaatgcatttactttagatgaatcttatgaggctataggttttttaaaagtacaagaccttttacagtcaaaccttggataaatataatgcctagaaaatgtattatatctgttattatggacattattaaggtaaatgaatcttttccaggggttgcagtgtgtcattgaattctacaataccaagggactgaaactgactagacccagctttatgaggtttgggagtgaggcaggaaagacatagctgagttagatgccagcctaagtcactatggatgtcattaaactcactgtctttacccaagaacttcctcctgacaatgcttttcctttttgctctcaagaccagacgttctaatgaatgtttctttagcattttccagtttatcctaagataattcacaaatattaaaacatctatgatgtccctattgaagacagttcatcaaatacctcatgatttgattaaatacttcatcaaatctaagacaccatcataaattgtgccattattttaagtgatgccaagaaaaaagatgctgccaattaaacaacaacaagccattcatttaaaattttatccacgtttcagggccgggcgcagtggctcacacttgtaattccagcactttgggaggctgaggcaggtggatcacctgaggtcaggagttcgagaccagcctggccaacatggtaaaaaccccatctctactaaaaatacaaaaattagccaggcgtggtggcaggggcctgtaatcccagctactggagaggctgaggcaggagaatcgcttgaatcggggaggcggaggttgcagtgagccaagatcttgccgttgcactccagcctgggcaacaagagcgaaactccatctcgaaaataaataaagtaaaataaaataaagtgttatccacatttcagagatgttaaaatgtaaaaaagtttcttataataaataaaccgtggcatttgtttaacacctacacatttcatagacaatattcagtcatataccatgaacagatttttagcgcccactgcataataggttatgaacagagaagttccaaattagaatggatatctttgacatttaattcatttatttatttttggattgaaataagaacaaaaatgttcatattttaatatgtatgtttctatagagaatattctgtttccataccttacattgcagtctctaagtgggagcagaagccttccatgtgatcttgagtgtctttatctccttgtaatttgtcctcagagataacaaaattctcagttagactgcccttttaccttaagaagcatgactgagttctttcctttcatcttcaggctgccagttagtgacttaattcagttttaataaagtcatcaggcttggaaaatgcagattcattccaatttatgtgtattatatcttttgcccattatatcttttgctgggccagtctaatcaccagattttacagatgaagaatgtgaaactcaagcaagttaactgattcatccctaatcattcagaaggggttttttccctgtcacagacagcctgtccaacacaaagtccagttctcttgaagtctcctttcatcttaacagatccaaatatgttctttcagttgcctgagaaatccattttcttctaaattttctgaaatcaaaattcatcctctttttaacattctgccccgtattagcagatcctgtctggtttccaaatttagagtcatacatttttccctagggaagagaaagagatatcccctatttatccacaagagtaatctgctacctggaatatatacatggaaccgctacttggtcaaatataaattagctctaagtgggagaaggtaaggcaacaacttttcatagactcccatcctttcccctttgaatttttaccttgaattatcttgttttcttgctttaaagtggattatctgtaaagcatgtgatagaaacagaaagaaacataaaataaatgtttaaaatgtgaaattttgattaagttaaagaatcacactgagcttacgcaagaaagtatgggaccctatcatcatcggtggaatcagtttacccagctatgtactaaatgattatggtttattgagccacctctgagctcctccccctcttccccagtgtcctgcttccttgggccaaaaataaacctgttagctggaaaacaagctagatgagtgtattagtccattcttgcattgctataaagaactgaagatcgggtaatttataaagaaaagaggtttaattggctcacagtttcacaggctgtacaggaagcatgatgctggcatctgctcagcttctggagaggcctcaggaaacttacaatcatggcagaaagcaaagggcaagcaagcacttcacatggccagagcagaaggaaaagagagatagcggggaggtgccacacacttttttttttttttttttgagatggagttttgctcttgttgcccaggctggagtgcaatgggacgatcttggctcactgcaacctctgcctcccagatttaagagattctcctgtctcagccttctgagtagctgggattacaggcactcgccactacgcccagctaatttttagtagagatggggcttcaccatgttggccaggctggtctcgatttcctgacctcaggtgatccgcccaccttggtctcccaaagtcctgggattacaggcgtgagccactgtgcccagctgccacacacttctaaacaaccaaatattatgagacttcgctatcacaatgacagcaccaaggggaatggtgttaaaccatgagaaattgcccccttatccaatcacctcccaccaggcctcacctctgacatttacagtttgacatgagatttggtggggacacagatccaaaccatatcaatgaggctgggcaaggcttgacataacccagaacaaactttttcctgaaaaagcagaaaaagcttgactagccttaaaggaggtggaatacagaaggcattaattaggaatggtcctagagggaaacatacaagggcttctgagaagatggtctaagaatgagatacaaaggagcagagttgatatgtgaggtatagtccctaacagcatttctgaaatgactacttttggcagaagacacccttattctgcagtttaggaaaacatttgccattaagtcatctgggtttttttgctccccccataaaaacagttcttttcttagagtgggagacaagtccaagtttaaatgtttaaaatcctactcatatttctgaaccactttcttatcagttataattgtagatcttacacttactaggtaactgaggtttgtatttttgatcttgaaatgtgatgccagacccaaaccatattctttgaaatcatcaggttaatgtgtcctcagcaagcaatgtgaccccctactaagatgatttcccttaaaaaacgtgggacatttagccattccaatttcaccaaacgtagatttagtatgttgaggtcaggtgctgtggctcatgcctgtaatcctaacactttggaaggccaaggcagacagatcacttgagctaaggagtttgagatcagcctgggcgacatagtaaaaccccatctctacccaaaatacaaaaaattagccaagtatggtggtgtgcatctgtggtcccagctactagggaggctgagatgggaggatcacctgagcctgggaggcggaaatggcaatgagcaaagatcatgccaacgcatttcagcctaggtgacagagtgagactctgtctcaaaaaaatagaaaataaaatatattgagacaagtctgtgtgtgtgtgtgtgtgtgtgtgtgtgtgtgtgtgtgtgcgcgcgcgcgcatgtccaaatggacaatgatatttgcaaagaacgtagatgtgctttttctttgcattatagtaaaggacatagctaaattcaaagctgcttttaatcacaaataaaaataaaaaattatcttcagagagacaaatccaataaataattacataaaaataaaaattcaaataacattgtaattacaaagttctaacattttattgatattgcaaacatttttggtaatataaacataggaaaaatgattttaaaaaattgaattatattatggcttcatttgctgttttcattactcattaaaaccttgaaaataaataaataaataaagaaaaccttgataagtatggagaatgaaatgagctatataattacaatgtgtcaaagattcctttagatgccatctacattaactacaagactattttaaaatgaagtatgtgtgccaggtggctgataggaaattcttagatcaacaaccattttttttgcagaatttttctgttctttagctaacaataagaacataactaccaagataacatttattgagtgcttactatgttccaggcactgagctaggcctagctttaaaagtattattttatttacatcttaagatttaagaaccccatgagccaggtatgattattatcttcattttatacacatagtatcatgtgcttagctgtgtgtcttctgtgtgccttctgagtagagggttttaggcaagagctaaaagaattctggtagttgtatatgatagtttagcataataagaaattatggccagatgtggtggctcacacctgtaatcccagcactttgggaggctgagtcaggaggattgcctgaggtcgggagttcaaggccagcttgggcaacatggcaaaattccagctctacaaaaaatacaaaagttagccaggtgtgtggtggtgcatgcctgttgtcccagctactcaggtggctggggtgggagggtcacctgagcctgagagagagaggttgaaatgagccatgattgtgacactgcactccagcatgggcaacagagtgagaccctatctcaaaaaaagaaagaaattataagaaaagctaattttatttctagtgttggacagagtgacagtttgctgctaacaatgggctctatgctatttaataaatttttcctcactctatacaaaattccattcctaatacaatgttattctattctcaattttaaaacctttgcagaaaattattttacatgtgtggtatgtgcaaagcattctttctagtaatatatgtagacatgttcagtttagaaaaatgtaaagaagcccagagatgaaaataagtcaccctttatcccagtaaccacagggaaccactattaatgttttggcatgtgttctcttggttgtttttatatatgcatatgtaaatatatatttatattcaattagaaacatactttacagttgagtttggtttttctggtttttcaaattcacttgataatatatcattggcattttgttatgtcattaaaatttcttccacataattctaacaataacacaaaattccattatatggatatactctattagactaatttcttaatgttggatatttaagtaggtggaggaaactttaaatataaatagctaaagtcttactcatgctataggcctcagatctttaatgattaaaaaaatgtgcccagtaaaagccttggactaaagctctattgatctcaattttaatctaaaattgcagggctgaaggtggcctcagaggaatatagtccatttttctatttttcagataggactatatcactatcctagatatatgtctctagaaactattcttgaatttaatgagagcagaagatttcataacactgcccaatgtagcattacagtgacttggtcctgtagcacagactctggaagtaaacagaccctaagaccaaataccaggtaaaggactttgacctttgactttgaccttgacttttctacctcctcattcttggtttctatcagtcttgcagggtatctgggaagattccatgagataaaatacatagagtgcatagcagtgtgaatgctgaacatatgcttttatttaccctgttcctcttaaatctttaactaatttccttacattctttctatgacgaaaaatccccaaacaccaatatctatggcactaaatatacctgaaggccatgactaaccccttcttgaacttcttctgcaaactaaataaagctaaatcatttgactttttctagcgtctacattcataattctttattaaattgtgggaccccaaattaggcaggatttattataattgctctgggtggtgatagagattgtggtgtaagttgtaagagtacaccttatttattgttatgttgatgccactatagcaagaacttgctggattcttattttaatttctttctttctctcttaacttctctttttctttctttcttttctttctttctttctttctttctttctttctttctttctttctttctttctttcttttcattttgtttttttgcagacatgggatctcactcaggctggagtgcagtggcactatcatagctcattgcagcctcaaactcctggactcaagtgatcattctgcctcaggctcccaaatagctgggactatagccatgcaccaccatgcttggcagatttttaaattatttttttagacacaggatcttaatatgttgcccaggctggtctcaaacttcttgtctcaagcgatccctcctgcctcagcctcccaagttgttgggattacaggtgtgagccacaatgcttggcttgaattcttaaaaagaacttatgatgtaagttctatgatataagtaaataactcgggttgtacttgtaggccatcatgacaaggatgactgcttttctgtgctgtacttatttcttggttctgattctttatcttacttagaagcagctccttcattgtttcaagttgctttcattaatttgagtcagttttacttctatggtgttatccatacactctttcttttttgttacttgttttgttaattttgattacatttagaggcaaatgaatttatgtgcacttccctagatcaaggtgaaaccatgacacatctatgtggtaaagtatagctatgacatagaaataaagggtacctctttttaagcagttttctcctaatgtaagtccaatagtgctgaaattgtcttcagacttacaagtttgagtagattttagtatgtcatctgtatggattatgaatttgtaggctttgggtctgaaagctgtaattatcaatgtttgaaagacatctgtgaaggtgaggatatggagacaattagccaaaagttagatatataattaccacaccctgccttcctatcaggaactctggatatttaaaacaaattaggacctttagacaggcccttctcttatcagggtgcatcatcgggttgccttgaatgtaggtaatcaatctcttagccagtaagtgtcctctcttgcatatactattagctcacaggtctttcagagaccaacgtggaaaagaaccatgcctctcaattacatccctggctcttgctacagagggaatttttatagtgaagaaaaaacactggggaaaaaagtcacccaatttttatagtgaaggaatcagaagacctggcttctacttctagtctctcatgtgctatctgtgaccccagccaaggttgtgggcctccatttccccatctgtcaaatggagacagcatacatgttctaacgtcacagaattgttgtggtgatacaaaaaagtcatagatctgaaagcgcttttaaaagttctgtgaagtttctataaaacccaggaaattgggaaaaaatcatgcagagtcacatcatttccttggaatttggaacatttgtttctcttcccatctgtgactaagtactacacatatatgttttgatatttatgaaaccattgagtacatagttacactatgaatagttacgactggaaggtattgagaaaaatgacaaaattccttgttattgataattaacaaaggaactaatcctttcaagggtaaagctacttagacctggctcacagcacttatgctctaactgattttctttaaagaaaactcctgaagagttttctaagaacaagtgaagcaagattggaccctgagtacggaaagtgggcagctaaagcttctttcctcaataacaagtttaagtgccttatttatttttgtattattaagtgacacttgtgaaaatactttgttgagtaatgatgctgtggcaaaactaaagtttatttaggacactgctccgcccaaggtgagcaattaaagcaggtatgtaaacctgctcccctgggctcctccactcaaccacttaagtaagtagtgctagaaatgaaaaagggtgtggggcaagatacatggcatggctgggggtgagaagaagttggaaggggaagaggaggccccatgaaagaatgaaaaaaagtgtgaaggttgatagggaatctataactaaaaatggattctaactgatgactgatatcactatatcaagttaatacaaattgagatggcataagattgattaaaaaacaaacaacaaaaaaattctttttcccgcatggtataataataaccaccttattttaaatgtagccaggaagggttgtgtttgttcatgtgatcaggtttcctcacttcccacacctggggaagtatcggctaatattgatttagcactaatttatacctgatggtcaggatcaactagaatggagaaaaactggtacaaattagaggggctttgtgttcccagaaagcagtttgggctgcgactattgtgtatcaatacaaatcactttttctaggaggaaatggaaataaatttttcaaggacccgtatctattctcagctgctgtactgctagtgtgctcaagattttgtttaaatatgttaggaatggataagatcaagttgcattcttatattttactatgttagtttattaatctgggagctaagcaaaccagaagcagaacaggctttaaaatatctgactcattattatattatacataataactgttagctagtcaggtccatttcccttttcctcaatgaaatttgctataataaaaaaaatctataacctagtcttatatatttaaacaccactgtagattatttggaaccatagaattagataccaatcatgtaaaatgagtagacctcttagattttttaaaaaaaattctacaggtagaattttaaaaggtgttttcttttggtaatttccatgaattgatgtcaggtatcaatgtttctatgtatttggctgaaaatggagataatattttgggcctgaaattatacttggtaaactttcatttatttcatatctactgttgcgcaaatttgcctgatcataaagatcacctgaggaacttgttaaaaattatacagtcctaaccctcccaccagcagaccagctgaattagactctccaggaaaggggactgaaatctgtgtttttagcaagggacccagatatgcctgatgatctgacacatgtggaaaatacagttttgtttccttttcgtattcctcatgatgccagagctcttcaaccctatattcacttctgactatcttgctctccactgattgcactgttttctactccaccctacctgtattaatttgttttgtgctgctgtaacagaataccatgggctgggtaatttataatgataccacagactgggtaatttataatgaacagaaacttactggctcacaattctggaggctgtgaagtccagtatcaaggtgccagcagtcggtgaggttcttcttgtagcatcatctcatggcagaaggtgtcacatgctggaagagcaaaaagaaagagagagagagagagaatgaataaggggggtgaacccccacctgcaatagtgaacccactcccatgataatgccaataatccattcataagggcagagtcctcattacctaatcaccacttaaaggtgccacctcttaatactattacaatgacaattaaatttcaacatgagggggtgggggcagaaagaaagaaaaaaaagttcaacgtgagttttggaaaggacaaacattcaaaccatagcgccatctaagaagtaaggcacacttcatcagccactgtggccttttgtagcagtgagtgtctgctatggtggtagtggaaaacaagtcttgggcagggaggtaagggatggaatgaagggttggaagtatggttcagaaaagtctttcaagagattctgatcttctccttgacaattggtttgtagatgactttgctaccttctgaagtggccacactcaacctccctttgctcgatccaaaactctgtcttacttttgacctcttatcctccttccttcctgtagtagaaggggaaacattgtgcctttttgtcaatgttgtgctcttgatcaaatcctttaatgctaatggaaactaaatctattaatcttcctccccattcaaacgcttcttgatgtttttctccttcggcttctttggcttatgggtatatcgataggaatattttctcttttcttttttctttttttttgagacagagtccaatggtgtgatcttggctaaccacaatctccgcctcccgggttcaagtgattctcctgactcagcctcccaagtagctgggattacagcatgggccaccacgcccggctacttttgtatttttagtagagatcgggtttctccatgttggtcaggctggtctcaaactcccgacctcagatgatctgcccgccttgcccccccaaagtgttgggattacaggcgtgagccaccgcacctggcctgtcttttcttttaaactagactaacatgtactttctttggctctgctcaaccccaagatcccattttatatcatgccttattttaattgttacactcttaaaaggaatattctgcattgatgcatctaccttcgtacccatcttgctaacttagttgtaatctggcttcgattgggccatattttatggacactattggcttgaagatgatcagtgatgagatccagtgctttttgcttagctcttaacctgctttcccattcagcagcatgtgacattgctgatcaccttgtccttttaaaagctgcatcaattagtggtcatttgatataacagcagaaacctactcaaattattgacatgacaaaagggatctgagtacaagactataggaaactctcccacagaaagtatagtaggactgtacaaggactggaataatgaatgatgaagccatcagcaacaagtaaagttataacaagtaattattgaacacgtggtatatcctaggaactacataggtgttaagtgatcaagtagtgaacagaagagacaaacaaggtcgctgcctctagagactttacaatctagtaggaaagacttgccattaggaggtaaacaaatgtgtattgacaacatttaatgagcaaaatagatggaaaaaactgacttaatgatagattattataggttattagtgatgggtgaggactcaggaaggacattctaagacatggcatttcaagggaattgaggagcagggaggtagaagtgatttaggctgaggagacacctgtatgcaggccatgcaggagcgtttcaggggaagtgaaaggaggcattgtggctggaactgaaaaggggaggagaagagtagagcaaaagtagtcaggccaggtcaggccttttaagctattttaaggaatttggatttcattgcaaagttattggaagacaccaaacctttttttttttttgagatgaagtctcaatctgttgccaggctggagggcagtggcatgatctcggctcactgcaacctccacctccctggttcaagcgattctcctgcctcagcctcccgagtagctggactataggcacgtgccaccatgcccaactaatttttgtatttttagtagagacggggtttcaccatgttggccaggatggtctcgatctcttgaccttgtgatccacctgccttggcctcccaaaatgctgggattacaggcgtgagccaccgcgcccacccgacactgaacatttttaagcaggaaatgtggctcaacatatttccaagtttaccctgactaataagtagaaactaaattaaagaaggcaagagtagaagctgggaggcaagttgagtagctgcagcaatagattaggtaagagatgacagtagtttgacttaatgtaatagcagaagagatagaagtggatggattagacatccatttattaaaaacaaatgagaggactagctgctgggttggagggggcgatggtggggagaaaaatgagaaatcaaaaatattgtctaggttaattgtttggaataactggatagatggtgaaaccatttgctgaaatggggaaaaaatggggacaattttctcagaggttaagagaaagcaggaatatggaaattaagattttaggcccattttagacacattcacttcaagtattcatgggtacttgacgtatcaagcaggcaactgaatatacaaatatgaatcttggaggaaatgtctgggctggagagtttcatttaggagttgccagcattttgcagtatttaaagccatgggaatgtctaagattaccaagaaggtgagtttatacagaagcaagcagagaatagaggccaatttttagagggaactagaggaggaagaacctgaagagcactgagcagtagtggttagagaagtaggaaacagaacaggtgagtacagtgtcccagactcctatagaagagatttttttaaagaactgagcctgaccagcaatgtggaaaactgctaaaagctggaaaaggaagaggtcccagaaatatccactgggtctggcaatatggaggcagttgatattgattagcagttttcagtggcatgaagccagattggaatagactaaacaggaaaatagtagattaataggattaaataggatatcagaagtaacatgtagacatctctgtcaagaactgttgctgtgacaagatcaaagaatttggaccatagatggaaagggatggcagaagaatctttgttttgccttttaaagtaaatgttggcataacagcatgttcaaacattactgggaaaaatcaataatttgatgatgaagaagatggagataataactgcagaaatgaagtccctgagagacaagagggtcagaatttaaatcagaagtggaggagatggctttcgataggaaaggagaacatgtattacctgtacagaaaggaaaaagaaattgatccaaatgttgaaaaaatcatagatttgatggtgggactgtagtggagatgtatcagcaggaatgggtctggagttggggtggttttggaggattgaataaaatgcataagaaacaaaataatcatcatgggaaagtgaacttcctctcagactctctccctctttctggtcacctggtgtgatttctccttctttctgtaagtcacttcattcttttctctcagaaggcaggtttcctctgcttctctgtgcccatgacagaaaatggccactctatgcacaattctttatagaaaaatattttatttcttaatttcagattcccaaaggagaaaatttaattggcccagctttagtcagttgttgaactcgggtgaaatcaaccatggccagaggggcaaggttatttgggacatacatagctgtcaggcccaaaccctctatgtgttgggggaggattggttctcagagaagagggatattagtttgtcagatgacccacgaagcagctaccaaacttattttctgagaccctgaactctattttaaggagtacttctgccctgccttcttttctagtattgttttctttcattttttttttgttgttgttgttttgttttgttttttacttatccctccatgactcacgtataaattttcacaattttgtttttcaccttcttttcatttctatgcttttctcctttgtgaccatggcttcagctaccatatggacatggatagcccccaaatctatatctcttgtcttctcaacttcactgtcgtttaaaagctgtctctatttggatattctctggttattttatttatagctgaactcattatcttttcaccaaacctcctccttcccttagctgccttgtttgtgttaaagccatgactatcttctcaggcatccaagcttgaatcttcagaactgtctggcgttctcttttcaaagtccacatgatcatcagctgagaaggagcatgactttcaccttatttcactctccatgtcctttgtcattcccctgactcatgccacctaaactaatgtggagtatcctctaaaccttctacatcgtcttccaaccatcaatctctaattcaatgctttaagctattcttgcattaatcttcataaagcacagctccactcatgttctctccacccattcaagaatcttcaacagctcctcactgcatatccaataaagtgcaaaccttacctggcaaccaagggccgtcatgacccgtcatcaacaggctaagacttatcttccattaaccatcagccaaaggcaaactgttcaatcatcttctgcctggttttgtgcattcctacctacatgacttcttcatactcttcttcctgaagccttttctcaagtgagctttcctttccctcacttcaataatactctatttacatcctttttatataaggcaaatctgtagatatggctttagctttgtcggcatatctttttactcctctttaccaaagtgtgagaacaggtaaaccctactgagtgtaaaacagtgtctgacacttcaaaaacattcaataagtaacctgacaaggagttgctatggcttgatgctagtattgttgctactaagcccgcatttagccttattaggggcattaatatggaccttttcaataagatgctgagtagggcactctgaaaattgtgtttcaaaaagtttaaaataataaaaagaaacttctctagtccagcactgctgatgaattgacggcaccctaacaacagtccctcaacacacttactcgtgtggcaaaaaataagatttggccacataggaagaaacctatgacatactttaatgactttcaactctcaataaaaaaaaataacattatgataatcaaacatattcccttcataggactactattgctttcaggtattatgaacactctatttgggactaaaacaaatagaatgtcacaccatagaaagagaatatttatagtcctttggcccccaagttttacctgtgaatgtgctgactttatacaatatagtcttttagttacatggtgagagtattatgcatcagcttaagatgcattggaggtgccactggcatcatagttggcaattggagctgctatggcgatgaaaatctgaaaaaccagtggttttcattactgttttctatttttgagaaataactgtacacttattctggatgaccttaccagttaaaaataaaatatctattactattgcttcttctgaacttcttttagaaacaaagttttcattatttacatataatagtctcgtctacttaattatcatttattttcagttcctttacacaggtctcttgagaatagctcttcttaatagtgagatagaactaaataccaatcagcagatgtcactccttaagtgatcctcttcagttttctctgtttatttcagttgtcctttttttttcaatgccttttctccattgccaattctattttccttcttttggagataggttcccactctgtcacccaggctgtagtgcagtggcacaatcatagctcactgtaacctcaaactactgggctcaagcggtcctctgcctcagccttgccagtagttgggaatatgcctggcccccattttccattttcatcctctgatgagcctccaggagccagtaggtctaacaaccataatgcaaggtattctatctttttgaatggcagcttcaatacaaatatctgtgtggtttacagtagccacatcagatatttttctactctgcgactaggcttttgtagcagagatacacctgttagattttttttcctgaggaaaagcacaagttttagttcataagataaacactggctaaaatttgccactcttaacaacattaaacaaatatttattgatcatctaccatatactaagcactgttgtagagattcagcagttataaaactgataaaaagtcttcacttcatggctgttctattctagacagacaaaacaaaaaataattataatatattatggtttggttgctgataagtactctgcaaaaagagtaggataaagagcaggaaaagccgaggggtgcttacaatttttaaaaaagtgttcaggaaagctctcatcataaaggtggtgacatttgagtaaagacctgatggaaatgagtgagcaagccatgtggatatctgggcaagaacctttcaggcagagggaacacctagtgcaaaggtgcacgtaggctgtcacaagcagtaaggagtttaatttaagcatctgccagggacaaaaattcagtcaaggcttttttgttgttgttgctattaggaatcaatctacaagagagtttaatcagcttaagatgaacatcagtgcagatctgtttagtgttctctcccagccatgacctcattgcaaatactgacagcctggactgcctctcagatttggatgggccttggatgctcagccaggcaaacccagatggagctagaagaggaaggttttggtagctctgtgggctctgtggcttcttcatcttatgatctctccacatagggctgcatataaatcgcatgtaaccaatgattccaagttttaatttaacctaaaatgtagtctattaccatatttgcactaagaagaaagtagaacagaattctacctcagattagctaatggcagatcctcgtcccacagatagccatggcatggggctactgatacagaagtatttctcatgccaccaaattgtgccttcaattttgtcttctttacacaggacaacatagtaagaggtcattgttaacattaagtcttatataagattttcagagattgttacacttacattcaaccagtatggaaaatcggcactaggcctaactaccccatagctagcatagtagcataacaacgctcttctagcctagcaatccacatctcattctagggggtttccaatttactaagaacattttcttaaagcttctatatatccttggagcttactttgtcctcaataagaataaaatattatcaagaactcaacaaatggacatttgaaagcaggcactgagtttaatttattttaggccacctttgatttgtttgaagcctgtattccttaaatatgaagatcagtacttacgtcgtgagaataaaggtttaagagacaaccaaggtttctatagcaaagagaaacgactgagcttctagattggtcataatgacttactagtaactgaaaatagtattttaagatcatactaattctctgtttctctgtgtgagttatttagatttgctttagatgtctaagtcagctgtggtagatttgaacaaacacagaaagtccttaaaatatgactaggtatgttgctttagatccaaattaggtattgatcattgtgattgtgacctagaataaatttagaattattgtaacctaatgtgttgaagttgttccataaatatatttaggagtagctagagatgacatttctataatgcaactatgctgtaatcaaagcaacaactcagaaatttaccagcatgtaaaagaaaaatcttaactttttttcttcttcttcttcttttttttttttttttttttttttttgagacagggtgtcattctgtcacccaagctggagtgcagtggtgtgatcaaggctcactgcagccttgatctcccggccttttgggctcaggtgatcctcccacctcagcctccctaaccgcgtccagctagtatttttacatttttagtagagatggggttttgccatgttgcccagactggtttcaaaatcctgagctcaagtgatccgtctgccttggcctcccaaggagctgggattacaggcgtgagccaccgcacctagccagctttacatatttttaatctgtcagattttttgttcttgctattctgagaaaagtcactgaaaagaaatcatttatcattctttttacacacaaaataatgcagtttttaaattaatgagataggccatttatataaaatttgaaagagtaaagtttttattcataattaaaatatatgttattctggaaaacaaaaaaaaagtagtggtctgtcttcatttgtaaaatttcctttgaactgatgggaacttatctcacagatgagatttgtgggccattgtgaatactctacagattatgtaccccacagctttgagctgccaggtactatagcagagtgcttcctcagactcttgagccagtctgtctgggtgaaatttttagctccccatatactaactatgtgatctcaggcaagacagcttatttatgccacaactgagaccacagtaaggataataatagtatctaccttgtggattatatgaggactgaatgaattaacacacataatgttcttagaatagcggctggcacatggtgaataaatgttagctcttattataatatgtggtaaactgaggaactatcactagttttacttggatgaagtactgcatgaaatttttgtatttttattgagtttcatcaatttttttactgaacctagtatgctttctcgtctgaacacacaaggaagaaaagaaggatggctcctgtacgtgaaagtgacccctgcatatagtgcctgaaatcagaggaagcttgtcagtgtgggcagacaccacgagcagaccaatttgacattgtgcttctcttttaacctcttgaaaattaatgaaagttatctgatgaagatccttacattaattgctcccgattaaggtttaaaaccttggtttactgtggggtaaatttatgtttttgatagtcatccaaaatctttgtacgctttcagtttcattacagaataaaaaacaaatttaccacaatggattattacattacatctggtatttattcctcccaagaagctatctgcttcggaaaagccaggggcgcccttcattaatatatctaactgatggtgtaatgacataaaattccttgttgacccctgctattcagtgttattgtcttggaacatagaacttgataatctcttttcactgcataactacaaatgttaggctgtaagagtattttactttgttcagtgcaggttccagacatttctcctgatcaccagaagttcttttgattaataaggctactggtcacgaaaactcagcttactaaaagagatccagtcttctggttctaactaaaacatcccaccggatgcaggtgtacttgcaaattaaagtttgcctcatgtgtcctgtgtctcaagtcatacagacggcccaggagggtggagcccctgcaacctgcctagcggggcgtttgcgtgtctgggggtgtcgggacacgcgcaggacacacacagtcccactttcctagtctcgcacttacctcaaggctgtcaacttttacgctcctccctgcgcgcacagcccccacctcacgctgccacccctcacgccccgccttcaaagtaggaggcaccattgtcattggacactgcttctctcactcctattccagaaccaatcactcgagttctagtggggagcgcctaagccaatggaaatgctcgctgcggcagctgccgggtcctgggcgctgggaggcggtgccgggggcggggtgcggctggggcgaattagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggcgggggtgtgcgttggggagggggagccccgagactcctcccccacagcgatacccccgcccctcccccttacacactcgcacgcactatcgcgccggctcccacacgctcgcgcgcctcccgccccgcgcctccgtgtcggccggcggcgtccagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtcccacgcgtccgcccgtcgccgctgccgccgcctcgctgggcagcctcccggggcccggcgcggcccgcggccccagcccgtccagcccgacgccgccggcggccgcagccccggccgagcaggcgccgcgggccaagggccgcccgagacggtccccagagagccaccggaggagcagctcacctgagagacggagccccggctcgcccgtgtgcagaggtagcgagcccaaccctcccgtcctcccgggctgcgtctccccgacggtgccctccgtggaaacttcagcctcttcgggcttctctttgctagtgcattatcgaaggtgtgaaagtggctttgggaatctcacccccctgcggtcgctgtggggcttggaggagcgaactgaaaagcgacttttatttgaccctcatgccgcccctcagagtctctcttccatcactcgcctgcttcgagaggtttttcagtttaagagctggctagctcattcgtgtgtttgccgtttgtagccggggaaggagaagctgggcgaaacacttaacacgcacacaaactcttcagcagcggataaggtggcggttgtaatctctaccgtctctttgtgcttttctgcaaagttcctaacgtgcctgtaactaccgggatagtattttattttttagagggttggtggcattagtttcgatgtaaggatatcggctggatgtaatgatatctgctagaggggacagttttgaatgtacaattgaagtgtatacggttttttccctcagtcctccctctctccctctcccccagccccccgccaccccgcctctctctctccctctctttctccccctcccctttatatattcatgcatcagagcactcctgcactggaaacagtttgtgctctaccggagattttcatggtaaatttctgaaaacttatttgtggaacgtgttcgtttttttccttccatttttaagtacacttaacagttcagttgagctgttcaaggatctcaagtttctttttttgttaggtgtcaaaggtaatggtgagctggtggatgctgtgggtttcccttagtgttttctgttttgctttggttttgtttatgtctagggacacagtgcatgatttagttgagccctgggggagaaaaggaagattagccaaaacagggacttaaagctcataagggagagtggaatagctaatattgttagataccgaactagagctacagatgctgctgctgcattgtggagggaacagatcatactgggtggaaaaatctctgcttggaagggaaacactgtcaaagtctgtacattgtttatgtggtatgtggaatttttttttttaatggagctttcttgatgaaggtgttagagttggagaaagtggttgtctgcattatgatacattgcagtcttggtgtttttgttttaatatttcagacccgtaattagcatgttgctaacgcacttgttttctgaccacttgatggtgaaccagtgtaggatgtagtgcagtgggatgagtacatgagcagcaagaaatacatcctgtaatctgtatgcattgggaggaatatgctcctgcactcctcccccaggtcaagccagctgctgcagaaactgacatcctccagcaaatcctgaatgaatgaatgaaaacaacgtgatcgccctaataatgaccacaactgaacacacatctttggctgtattttatagaaaaggccaccattttctaacagattaatgccatatgcaactcctttgcacattttctagaactgtatgaaatgagaagtaacagaacgaacagaaaacagttacataaattttttagtgatttcgcttcaacagtgcacaaattgagttttgggattttcttgtagggactaagaggcataaaataagcattgcagattgtgtacagagggtctggtgggtgtgagtaagagaagtttcggcaattgctgcaacaacataatggccatctagtacctcctccccttttgtatataaacactaacatcttacaacggataatagtacaacttgtttttctgcatccttcaaaaggcttaatggcctaggaattacatgctccatcatcaagcagttttaataaaatttgtgatctggcttaaactattctctttgttgtagtgtggcacatacgagtttaatgcgattttaatgcaatcatgatgaaaacacttttctgagtctggttgtgcagcagacagatttgcagtgtcagagagcttgtgttgggaatgcaagggctttctttgctaaagatgtttttctgctgttttaaacaccaggtggttttgtcagtttcttacattgcagtgatttttgaatgcgggcttctgtgcccccagttccgtgattatattactcctatgttacttctccatgtcccgccttttacccccactacccaaattaaaactgtcctactaaactgttctgtttccttagccatttaaaatccatgatctgaacagttgatttaatttttcgaatgattatcttctcaatttcttttgaatgctgtaaggttctgacttgagtggattttagcctccactggtcaaggttcctgccgctgccactgctgctgcagacactgacatcactatactgcatgaatgaaaaacaacaacgtgctccatttcttcctctgctctccacctcctcctttttctgcacacttcagtgtatgtgtgtgtgtgtgtgtgtgcgcgcaagagggtgttaaaactgcgtttgaaactacacttgaaagcattaagtagttgatggctcaaggggtaggtatatagtataaaggcatattgtttatgaaaagctgcaagggctatgggcatttcgactaaaggtgacataactgagcattcagtgtttcatgcatttcatctggagtgatgattataggagaaaatatggaagcttaaaaatgtttttatgattcttttaccaaaaaattatgaaaccactcaatttctaaataaattatatcattatctgcgtcttaagcattcttaatgtgaatatttgtagggctaaggctagagtaatagagaattgatattcagattgtttcacaaggctgaggaaaagctgaattctataaataggaatagtcaattttaatattattataatattaatttatacaacccaggaaaaaatgataatttcctttatttttgtagtatagttttaaataatttaaatggttaccataatagaaatacgtaaattgccaaataccttgctgtatatatagcagacatggagttttacaaattgaaactgttttgtttgtgctcatgcatcatcctctttttgcttgttttttttcttttgtatttttaaaacttcaaggtttgttatttacattcattcctgtacttctgccattagtaaaatgtcatcctccctcttgtttggttctgaagggtattgcagtggtgaatgacaggctgctgaatgaatcctcaggctccctgtgatgtgtttgtaatagacgtaaaatcataaagtattatgcaaatagttatttttttgtaatggtaatacataaagtctacctttgagataaatagagcaactcaaatgagaaaaagcaggatgttagtgttaaaattaatgatctttaagctaaaatcattagtaacaaccaaaagaaaatatagtaaagttgcttctttttgaaacctcacagaccagaacccatggatttaaacatagaacaaatacagttttactgtccaagatagtaagtaggaaatgcaaatctttgtgtgcgtgtgtgtgtgtgtgtgtgtgtgtgtgttttgtaaagatagatcattaggattaattataagttctaaaagatgtaaaaacagtcatatttagaatactctggatggagaatacagcttatttttaagtgtaccaaatctgataacaaaaacatggaagagcttgtaatttatatagctcctgttttgaaaaatagcatatgttagttcctgatttaacatatcaggtttatttaggcctaatactctaccagattgctaactctagagtgaaatttgattagactttttcatgagtatcttgagagcctcattgttttatacataaagaagttatgattctattctaaaagataatgcaaatataatgttaactccatgtaatatatgtttgcctgtgttcattcatttgctttcagtttttctcttttccttaaatttatctttttaagtcatttttatactgtgctcaatggaatacaaaaaattttaataactttttctcttttaaaagagatactcagatattctctttctataaagttttattctcaggctattcttgaaaattaagatcctccctttccattttaaaattaattaattttccttgagtgcttatagatacttgtttcaaagctttcttctacattaatgttttagctttttctaaagagacaggtttcacatactgacttttgggaaaggttttcattctcagaaaactatgctagagagcagcagtgttcattatttacagaactatttttttccatcagttatctcatggtgcctaaaatttctagatcaatcagtgaatagcaaaatagataaatgaatttatagttatttaatcaaaatctattgtcttatgttcaaagattatattcctctcaaataactgttattgtaagcgtattgaatattgaatacctagcatgtgtaaatcatcttaatcagtttttaactgtatgtaaagttctgtgtgtatatatcgaactggaaatcattttattaattacagtactttttacagaaggactgccgtgtacgtttctgtaaggacttaatgcaaattaggatttgtactttggggaaatgttgaaggataatggcgtccttgtgatttttgttttacttgtgataagtcagactacatgtgaataagaaaataagggagtaactgggctccacagcagtgagtggaatggaaataaatgacagtgttcaacaaatggctagtcggagagggttttccttagtctgaaattttaaaaaattctaaaagtctgttttattaaaatgttcacaggtagttaataatctgccaaagagtatagtctaatgacttagttcttcttaattttagtttggtcttttctccagaacttaacatttccagacaccactaagatagactttctggcagcccctgtcctagtctgtgtctggcactgctttttgtcttcagtatataatttattcttttattaagtgtctaagaagctaaatcactgacactctttttgtgctacatactgtttaattattttaacgagaggttgaaaatatctaacttctggtttctgccaaaagtaagtggaggaaagggaacacaagtactcatatattgatatagaaagcctagggaactgatggaaggcagatactacctgtatttccctctgctcttcatttggacccttgaaagtgaccataagttgactcatcatttggctattctggaagaatttttgtgcttattctgaaagacaaattataatggattagcagtaattctgaaaaatctaaggattttacttacgaacaaattgtggaaaagtatttcattgtagcatgaacaaacatggcagatacctttaagcagtgttgtttattccaagtgaatgttactaaggcacataccaagttcatgaatacctcagtgacttcccctatactatgctgtgtctctagttttaggtaggaaagaagaaaacatatatttgtgtgctaactatataccaagcaatgtatactttgattcagcaaggatttaggatgtggatcttctcattccagatccagtgttcattccataagactatgctgttgctcctaactcaaaaagactctaatgttgatgatcagctgtgatttctaagctaaaagaatgacaaaggaattggttttcttttgtttccatggcactattacgctgtgctggggtatggtctgacattttcagaatgtctaaaaatgtgagacctagtttgttgaatgtaactaaaataaaatatagatggattggccatttttctccatttctttcttgcatataaggagaaagagacagagagaatgtgtgtgtgagagagagaaatccttgtttctgagatagagagagaaattcttgtttctgaagataggaacatgattgtatctgggctttcttgtgtgtattcagaatcggtactgtcctcgaatcactttgtagtgaatataagtgcttttctccccttttctctcttcataaatgttaaaagttaattacatatggtgctaaactgatggaagcttcaggaatcactaaacagagactggtctcaagtgattgtcccagcaactggcactaggttgattcagccctcccaaaagacaacaggcttccaagaatctgcaatttgtgggttgaacagtgtacgtatataacttaatgaagtccaccatcgtataccttaatgatggctcaccaaaaagaatgatgatttaaagaagctagtgggctgggcgcagtggctcatgcctgtaatcccagcactttgggaggctgtggtgggcagattacttgagatcaggagtttgagaccagcttggccaacatggtgaaaccctgtctctactaaaaatacagaaattagccgggcatggtggtacacctctataatcccagttactcgggaggctgagacacgaaagttgcttgaacctgggaggtggaggttgcagtgagctgagatcatgccattgcactccagcttgggcaacaagagtgaaactccatctcaaaaaaaaaaaaaaaaaaaggaaaggaaaaaggaaaggagaaaggaaaaaggaaataaaagaaaggaaaggaaaactagtaacccacggttgtgtggcaaggtcagtgtccaaaattgtctaccaggttattagaattgttaagaaatcctgctgggcatggtggctcacacctgtaatcccagcactttgggaagctgaggcaggcagatggcttgagttcaggatttcaagaccaacctgagcaacatgacaagaccttgcctctgcgcaaaatataaaaattagcctgggcatggtgggacactcctgtagtccagctactcaggatcctcctgagtgatcctcaaggaggatcacttgagcccaggcggcagaggttacagtgagctgaaatcaccctactgcactccagcctgggtgctagagtggggtgttgtctcaaaaaaaaaaaaaaagttaagaaatccaccaaccatctagatgtgtttcgtaatgaaaaggtgaaaactgctacaacttcctgtctagtgttactgaagatcaaatacttattaactactgacagtaataattccttatttattctctgtagccataaagaaaacttttgtgaatagtccgtatagctaattttaacttttacattactaaaaaattagctttctgatgaaacattttctaacgtcattacacacttgattgttaagcacagtgaacaagacataaacgaactccttgtggcttgattagctttattaataacttattgataacatatacataaaattgattactatagatgatattgagaataagactgaatgagtattgactgactagacttgtgctataactgattctataaatttgcttttgggattatttcctgtttttctgatgaaggtggagcaaagcatgtttgactgaactggtccttgatagtataaccgggctgttttctctagaactaattatcaaatgaaaggccaaagcaattattttccaaatggttccatagacatgtcgtagaggcataaatgtatcctgggaaatactagatttggagtcaagaaacctgagttctcttttcagttttgacatttgtcttatgacaagccactaactctgcatcttatcttctgtgtctttaaaatgaaggggatagactttttaagattttggttgggtagggaaaagattgagctatttaaaggaaaagaaagtttattagactagatgattcttaaaatttttatttattgagcctttatgccaactaataatctttggtagaatccaatataaggtacttttattaacctcttttcacagatgaggaaatgaggtcctgggaagttaagtaatttgcccaaggtcaggcagcatgcacagggctcttgtaatgctctaagtcctgacttcaagatagctgaaagttgttgttggaacccagttagttatggggcaggaaagtatgcacaatgtattatcccactgcttatacagttaagtcatagaaaggctaaatatagctttggggcggtgagggaagaagagaaagctaaatgggactagacgctagggtgcatggaacttaaaatagctgtaagtatccccagtaattatgccatcattgggccttccctttggtccctaaaggacctatcactttgtttagacagaatttagcattttatttttaaaaacttcctttcacatgaaatttcaaaatctgggtagaataaggtctcttttttgtgtattcatatttggcaatgtaaactttaaaaaatctgcccatttgtaatgtattataaggctaccttcagccccataattatgattctctacatttatcatcctttgatattttagcaacatttaacatagtatctttttatacaacactgtcatggcaaagcaatgcacactaccttaaaaaaattatttatatgtacttggctctttcacttcttttaggtttgttgatgtaatatagaaaataaattttaatctctattttaataatttcttctggggtgttttggcattttttcaatgtcatttgtgcttactataagttctgcatagtagttaatgtggaaacgattttcttttataagtaacattagaaattgtgtttattgttaggagagcaaaagtattatatagagtctttgtgatggataaagtttctcataacatttcttctgtaattatatttacttttctagttaaatatatcagttgtacattgaattagtgaagtgtaatgctggtatcttagaagataataaaaacagtaggactcagtggctcagggttacatcaagtctagccatatggaaactttactattcctcatacaaacttgtgaagtgatctttctatgaaggtacaaaaatatcatagtaaaatatagattggtttatattagctaattataaacaaaatgtatttataatatctttcgaagttttgtaagtgtcattttatttcttctaaagtattcttggagttactctgacacattgaccttaaaagaatcaatcaacagtcctcttcctgctttatgtcagatcatttaagtgtctaggacttaactaaactggtgttggcaaacattgctaaatgcagtttcattagtattgcaaaagtgaggatttagactgtgctcagagattagatttttgaaaaaagctacagtattctgcaatatttcgatcatagagcttaaaaagtgtatttcaaaggtctattaatactttacatgccagagtgacctcttagtttgtaaaaaaaacgcattcagggaattgcatttgctcactttttatctttttaggtaacaaatagtgggtcaaattcttagcagattttaaatgagttatccttgttcagaaatatgctattgtcactgagttttagattttatatatgaattgtttatttctaagttagcttgagctttttctggtgttctgttttgaagttgccactctgtttatgtgtatttttctttcattagatgaagcttgaaatattaattggttcatcctatggtttctataacatacttacatctaacgtatcttgctgcctttacctattataatattatactatagtttagcctaggatgatgtcactggccctttctttctatgcatacatatacattagtgcagaagtctgaactgtattgttgaatgtggcttcttgtgtagtaatgtagtaatatgtagtaataatactgtgtagtaatcttgggcagtgatgccttgtgaggctgttgagataaggaggaattggctttgtctaaatatctgctattgctgagctagaatgggaagtgacaaacttttcatgtgttatgtcaccatttacctgaaactttggttgaatgcagtgacccatttttctttctcttcttttattttttctttatctttctgtctttctgtctttctttctggcagtgtctcgctgtgtcacccaggctgaagcacagtggcacaatcttggctcactgtaacctctgcctcctgcctcagcctcccaaatagctgggaccatgggagtgtgccagcacacctggctaattttttgtatttttagtagagatggggtttcgaactcctggcctcaagtgatccacctgccttggcctcccaaaatgctgggattataggtgtgagccactggacctggccctatttttctttcttataatcagactttacctattttcagtttctattgacttttagtttttgccttaaagaatattagtgacctcaccagggcttatagctgaggagaagtgggtgccatggcggttctactggagactactgtgggcaatgtggttgtcaatttgcacactgagcagcagccttgcaactgtgaactttttgagagcaggtaccacagtttaatggcatttgtgatggcagtgccaagcatctagaaggtactcgcctgctttaatttcttgagatattacaaaataaaatattacagttattgccttattcacagtatacaaaggtattttatcatacaaactgttgatcctacagggactggtcatggaggagagtctatttttggcctaggattgtatggtgatcaagcaagcttttttgagacagaaaacgtcccaagaattaagcacaagaagaagggcacaatgtccatggtgaataatgacagtgatcaacatggatctcagtttcttatcactacaggagaaaatctagattaccttgatggtaccatacagtatttggtgaggtgacagaaggcattgacataattaagaaaataaatgagacctttgttgacaaggactttgtaccatatcaggatatcaggataaattatatagtgattttagatggtccattttgatgacattcctgatttattaatccctgatcaatcaccagaacctacaagggaacaattaaagagtggtagagttgacacaaatgaagaaattgatcatttcaaacgaaggtcagccgaagaagtagaagaaataaaggcagaaaaagaagctaaaactcaggctttacttttagagatggtgggagacctacctgatgcagatattaaacctccggaaaaatctgtgtatgcaaattgaatccagtgaccacagatgaggatctggatataatactctctagatttgggccaataagaagttgtgaagttatctgggactggaagacaggagaaatcctctgttatttctttctttctttctttctctttttttctttctttctttctttctctctccctctttctctctttctttctgtctctctttctttctttctttttttgttgagatggagtctcactctgttgcttaagctggagtgcagtggcacgatctcggctcactgcagcctctgcctcctgggttcaagtgattctcctcccttagcctcccaagtagctgggactacaggcgtgtgccaccacacctggctaatttttgtatttttagtaaagacagggttttgccatattggccaggctggtctcgaattcctgacctcaggtgattcacttgccctggcctcccaaagtgctgggattacagatgtatgcttttattgaatttgaaaaggaagaagattatgagaaagccttcttcaaaatggacaatatacttatagatgacagaagaaaacatggattttagccagtctgttacaaaggttaaatggaaggaaaaagtgggaaatacaccaagagtgatttaaaggagtatacaaaggaacaggataaaccatctaatttggttctgaaagataaagtaagcccaaataggaggcaaaatataatgttgtactagatgagcaggcagaagactccaagtcaagtcactcacacacaagtaaaaatcacaagaagaaaacccatcactgctctgaagtaaaagaagatgaagactacataccaatcaaaaatattaatccagataagtatgagaaagtttggagtttggtcactacgaagaagaagaaagctgttgggagaaatgaaagagtaaaaagagagaccgaactcagaactgaagtcgtagctgatcgcaagagaggaatggccattatagtaatagtcacaaatccaaataccagacatctttatgaaagagaaaggagtaaaaagagactgaagcagaaatccaaagaaaaatccaaagataaagaaaaatctaagtacagatgaaagatgaagaggcagaattgagtggctaacatattcacccttgtctaacttagagtgccaggaaagcaggtgttcagattttgtgtcagagcttgttatttttttcatactaggattatcaccctttagattattaatactgattatatagggcactgaaagaactcaacattttctttgtatacttttttacactaatgttattgttatacataaatggtagtcttcatttttgaagtctttcacatttttactcttcttttaaaatgaagtatttatgctacaaaaatacataaacgtgtttataaaggcaaagggataataaatatgaatatctgtatactcatcagccagcttaagatctagaatattgcctatactttagaagtcccctaagaaccctctccctctcaagtaattatttggaaatttgtgtttgtcatttgctttgtacataggtatctctaaatgaaatgttaattttgtatgtttctcaattttgtataaatggcataatgtttgtttacttttgtgactttcatttttattgctgtattgtattatatgaatacttattcttctgttgatgtacatttgagttttatttagttttgtttttgctgctgaaactgctgctgtgaacattgtctgtctaggagttatagtgcttgatcatgtgctatgagtatcttcatttgtataaaataatgccaaattataaaaaatattagaattatagcctttaatattactattcagttatgttagctagtctttaggacacttgccccgttgtactttgtattaaacatgtggtcaaaaaataatgtctttatgcggatattcctgtttaatgaagtacgtgttgtagttaacttcttggtaaagcaaacaatgttaaatgaatcatattttgtggattttcttttttatgggcatatagaacactgaagaaaatcttacggcctctgactataaccatgtaagaaactgtataaaattgtatgtaggaattttaggaaatagggaggtataggaaaagtaatgaaatgaattataattaatatttgttttgttcattttaaaatattattctattattgaattaagtgcctcaaaatataaaataaatgtatagtgcagtagctgaatctttgattatttgacccactgtattattccatagttaatgtagtgattctagaggctttgatagtttagttatgatttttcatttatcttgatgtttttataactctgtattcaaggtaattttggtggatatctgtgcttcaccaaataatagcatgtcatttttagtattccagcatctactatggtttctggtgtttagaaagccagccttgcagtaaatattttttaaatccttacatagggtttatatagagatttctgtttagctatatatgttcaaatctgtgatttgaacccagctacatgaacaatgattgttagtgcatgcaagtcctgtgaatatctgacaaaggttaaaactaatagattatatttgtgttgcccattttgtaaaaatgcctaatagtttaggtaactgatggtttttatcttcatttaaggcctgttattcagtggtagtggtggaaaaacactgatttagactttcacacaaaataaaaggagctgggtgctcttgctggtagagataggtgggataaagatgggtgatgtcagcatagtccacatattaaaagatggaagatagatttccacagaatgagtttctaagttacatttaaagttctattaagtgaattttgatttagtgaggctccatggactcagcttctgaatttttgtttgttttttttgagacagggtctcactctgtcacccaggctgattgcagtggcgcaatcatggctcactgcagcctcagcttcctgggctccagcaatcctcccattttagcctctggagtatccaggaccacaggcatgtgccaccacacctggctaattttttaatttttatagagacgtggtctccctatgttacccagactggtcttgaactcctgggctcaaggaatcctctcaccttgggctcccaaactgctggtattacagagccaccagtgctgaccctgaatctgttatacttagagaaactaaaccatccatgcccaaaatttggtgggctcttcaagttaaaaattctgatgtttttatagtccctcctaaagactgtggtaatactgagctccaagtaaggagaatgtgaattatatattaatttgaacttcatcgtaatgtaaaaactttaaactgtaaagcagattttgaggtggttatttgctctacgcaatatctaacttatgtgcaggtaaaatgacccaatttacaaaatgttatttacgcaaactttttaggaagtcagttacacaaggttgaggttcatctgaggttgtaaaaacatattaactgaatagtgtaatttctcattgctgaataaaatgttctactgagatttagcaaaattaatatcctaagaaactattataaatgaacatgaatacatcttttccattccctttctgtctgagttttacaattctgaggaatgtggtattcaaataacccctaaaagggaaagaactcatatatgctaatgattttctcacatttctgtgaaaagatatgcttatattggataaatatcccaagactttttctggaatattttgtccttatttaaaaaagtattactttagttatagttccctaggaaattattcctaaccagcctcatatttctgtccttcttccaagaaaaactttcacaaaacattctactcttgtcactgtcagggggacagagcagtaagtaagcataattagactacaaatatggttagtgctgtagattatgattttgtgtatatttgtatatttctacaggctgattttaatttgttgttttcgtatatacttaaggacccagggaaatgtgtgtatgtatgtgtatgagagagggagggaaggaaggagggagagagagagggagaaagagaaagagagtaatagcatgcgcaccctaaagttcacattcctttttcagcaatcactggataatccctggctcctgacattttctccatacagagtagaggttcatgatcactttttcataatactttaggtaattttaatatactgagggatagtgacttaggatttgctcacttcgtataagataaaaccaatgatgggcacacatttacctgtgtaacaaacctgcacgtcctgcacatctatcctggaactttaagttaaaaaaaaaccagtgaacacccaactagacatattcctgaatgtcttccttgtgattcaggggaagtttactatttatagtgttatatttccttctcggaagcatttattcaatgctgaacaccttgactgaactgtttacctcagagttatttggtaaggtgtaagtttgttgtgtgtgggtttggagaaaaatcaatccgtttagatataaatcctttcttctgaatcatataatatagttttagaatggcaatcctgttatctgcagtttaattttcttaacaaatgtatcaattttctctgctggggttggctttataatttttgagtggaagattatgttggtatttaaattcaaacttgaaacaagcattgaaaagtataattactgcatttctattggctggaaatgagtatttttatagttggtacctgtgtatggcaagttaaaacagacatgatccttacacattctacaagtttacaaatctgaattttttaaagtatcattataactgtctttggatattttgctcatggtttttatcttcttcttgatcctgttactgtctgtataaaaagttttaaagtgtattcaatctctttttcacaaaatagaatatatcatactctcttagtacaggaattcgtattcaatttacatgctttgaaaaagtgacctagtgtggccaggcacagtggctcctgcctgtaatcccagcactctgggaggctgaggcaggcggatcatgaggtcaggagatgaagactatcctggctaacacggtgaaaccctgtctctactaaaaatacaaaaaattagccgggagcagggggaggggggggtggcaggcacctgtagtcccagctactcaggaggctgaggcaggagaatggcatgaacctgctaggcggcgcttgcagtgagccgagatcacaccactgcactccagcctgggcgacagagcgagactctgactcaaaaaagaaaaaaaagaaaaagtgacctagtgtatttttctgtgttactgagaataaaactaataaaattcaacaaattttactctatataattgcaagtttgagtcatgtgttttaaagattcatatgtaatatatgattagaagcatagttatgaaggtaagagtattgaatgatttaaatttacactcagagacttggtacagaaatggagttggtttcttcacttattggcatgatggttccagcctttatggttaagagatattcagacctagagtgtcattggattgagttcttacttcctactagcataatctttgactttttctcctcactcatttctcccatccttctggtcactatatcttgtcttaccttctcagaattatctactgaacatggtggggtttttttgcattctttccatgtcctaattattacttcttgcttggacttttggaattgtcacctcttaagtcttttcccatgccagttgtcttgcatctttaatgtaatcattatactgctataagtacagtctttctttaaaaacaaaacaaaaaaaccccacaaaaactgattttaatgaaagatttctgttggttccttggtgaattaggggtaaaagactcatctcactatcctccactgtgtaccttgtgttcctgccaaactgaactcactttctttgggtatatttttcctgtcaggaatacttgtgcctctaatatacatgatttttgcctgaaaaccctagccgttctttgcaaacagctttccaatatcatgcttctctgcaaaatattcctgacgtttccaggtaaagagaagtgtggctttctttgaatattcaaagcactgtatttacacctttacatcgtactgtcactatttaagacacttgtcatctcatctgaaatgtcagtttcttgagggcaggaattctggactgttcaggatctcattgcccaccaaatgtatttctctacttgaatgtttctatttcactctaacaaattgcctgacattttactacttagagatccttttgagttgacagtcatttattgattgatgattgacagagtctcgctctgttgcccagactggagtgtaatggcataatcatagttcactgtaaccccagactcctgggctcaagcgatccttccacttgagcctcccgagtagctaggactacaggtgcatgccgccatgtctggctaatttattttttattttttattttttttagaaatggggttccactgtgttgttcaggctgttctggcctcaagttatccttccgctttggcctttaaaagagctggggttgcaggagtgagccaccattttattttttaaaatgcgtatctctgaaaagatatccttgaaactcactatctttgtatgaattagttcaattagattattttcctcatgatattaaattgagaacaacagtaccaagataatgggagtcttcttggagatgagatgggagtgacggacataatgctttttggggagagtaagtagtagtctttcagtaagatgatgtttggaatatgagaatatagtctttcatctccatatggccccaaatcccaaaacctagaactaaggcagcactggagtctctgttgataagagtttacagtttacaataaggtttttgtggttaagtctatgttaaaaggatccagaaagttcaactagtgttacgtgttttaatgctgatgagcagagttttttgttttgttttgttttgttttgttttttactatcaggtgtattgttattagtagatacttagtatcatcagtgtgaaattacataccaccttgctttgacaaatcttaagaactttcgaataagttatgggagtcctgaccatcctttaaggaaaacagtgcactcctctaaaagcctattcaaagaggtcacattgaggaattatatatgttttctagtctttttgaagtacttttttttaatgtcttcggagaatttcatttagaatactcttggagtgaatctgtcttttaggggtagatacgacttttgaaaataaccaaatgtcattaagaacctaatgtggagagtaaggtaggtgattaagttagattatcttatttatggtgacagatgatgatgcttatgcaatgagagtcactttaaaatttggacagactgtctccaagagtaatttagacaaatagagttattaataatacaaaaagtcttctatagtagactcctatatgttcacctaatcctcttttctctccctcttgtgcctacttctaggctgtaatttctggccccctttgcagttctgtatttttttctttgctgacctctgctgcagttagataaggctaaatgataaagaacactttcatccttgttcaacttaaaaattcttatgtggtcctcctcattctttcttttccctcatctgccaactggatgcagagaatctagtaaaggactctgaccaaggtcctaatggaatggtagagccatgagatgaatgaagtctgaatccctaaatgatcaagtaaaaagcaatctgtcagtcagaaaatacatattgggcttttattgtgataaggcactaattttttataaaaataaagctataattttaaattgtagcggctagcattaccacccttactgtactttagagtttgaagaaggtagtccactagctgatgctattggagccaccttgaaaattaaccttgggagttcctctctttccttatctaatctgtcacattggcaagtatggttaatttgtgttggcagtgcatctgtcaatgcaagagacactccatcaacctgttctatttttgtgtttgtaaaatgtcagagcatagaaatcatggtcttttatataaatgaggaaaatagaatgacaattggacctgaattcaagttgtttttttcactgtcttgtactttattcacagtgattttagatgagcctcacataaagaatattaacgagaaatatggagctattctacttgaggctcttcccaaaagtctgctttggtaaagaggtctagaatacatgccaggcgattttaaatttttgaatatttatttcatagtaaaggctaaggagaccacttgtgatagccacaagtttaacaactgttttgtaagtagatatactaggtgtcagataaatgaaaatatgacaacattcttgccttttaggaacatacctcctggtagataagtcttgcattaatcatttaagtgcaaggtaaacatattttgattgttagtttttttcctctcctgtctcattctaaagtgaaagtaaaatagctgagatataggtgaaaagagagacagatacaagtgtgtgatctccatgagaaataagtgagctacattacttataatgctccgaacatgcgtagttcagttcttgtcacctgttaatactaaacacatagaaaggattttaaaaatgtaatcagaagtgaagggagagagaaaggagagaaaaaatccactggagctatctggcttggtgtggttttgttttcctcctactttgagatgagtccagtacatctggaggtattattcagttttgtattccaaatgccccagctattctaggtattgttaatgattcaggctgtatctaaaactatcatctgagattaattcactcatttcttgggcacttagggtgaacagtgctctttgtttgttgaggagaaaaaaattaaatacagtaaacactaaaactttgtgactgtagtctgtatcgcctggacagtgccattttgactgaagcacagttcaatcggtaatatcaattgactctttttgacaaagataataatgcccagttttgtggctattttagaaaataaagcataatgctatcctccaatatgttatgacactttgccctacacttgtttatgctgctggttgttttatttcttcagttgctctcaatccttggcaaaacttcctggcaatcttttatgcacaatatttgtagaattgttgaggtgaaaggtgttctgtgtatgcagacatagactggtgttttactgtgttgtgttttactcgtggcctctacaaaagtgtgatttctgtaagacattttccttcaggatattttctgctgcttttggcctttccgactttatgaagcactcaattttggataagctactgctttacagctacatatttgattctttggtgtcaatatatatgaaagtaaatgctagaattaacgtctgtgtttccgtatttctgaagccttcattctgttgagtctgtttattctgggtttactctagaaaagtgtagctagttgtgtttcctagtaaacaacatattcaccattgctggatttggggacacattgtgggggtggggagaatacagcttgtgagctatatttaatttactacattattttgcattgagcaaatcagtggtatccagacatatttcagtacagatttctatttatcatttgctttgcagcagtagattagcttggctggaaatcataccttactcaggttaaatagttactctttttcctaggcctttccccttcatctcttctacatttaaccatggatttaactcttcaccctattgctagacagttacgagctaatttgtagttattacataagcaaagtgtttaagtgtgtgaatcttttgtttataaattgtatgttaaaatatatttggattaggaattctacttttcagtttagatatcatgagaagggctattcacttgtctaggagactgttgtgttttctgtattatatttagctgttctttattcaaataggaaataagaatgcagataattttccaaggaaggatgttacttttcagaattagaggaattataggcatacacctatctaaatacattttacatggcataatttgattgtccttttgtagagattccataatattaatagccataatcagctttttcttggccttgaaaataattttagggatgctttgttctttactgacatgtccagtagttggtaaggtagtgtggaaggagcctggttattctctttgttctgtaagaggcccttctagatttaccccattgcaaggagaagatcttcctcaaggcttctatcttttctacatggctcttcttcaaccccctcagtccattatcccatcatttctcatggtaaatatctttctccataaaaggaactactatttcttaatgctttcctggttcttgctatagacttccataggatgcacttggaactttgtgagtgtcaggcttggagggagagaataggcaaaaacctattgatggttttagtgtgaatcctccaatttcagttactttctcctctagattgagcaggagctgatttctttactaggttacttagggagaaaacttacctctctaaggctagccaattcaatgacgttggaggaatattagaatttattttttctttctttctttctttctttctttctttctttctttctttctttctttctttctgtctgtttctctctctctctctctctctcatatatatatatatctggctctagaaggaatttaataactcacatttagttatcagacattctggaaatttatagtcttaaattcaaatgtgttgagagggaaacaatgtaattttactatccttctatggtcatttatttcatttagtggtggaagacttgcccatagagatactgaacatactgctgctctcttctccttcaaaggtgctggctcaatgactcacaccttccaccagttcttatgttaattcctttccaggcttttgattgaagagcattctctaatagattttcaggaaagactcataggaacaatattccgtaagttcttgctagttatgtagcaagaactcagatatagcttttttaatctgtagcctttatacttgaaggtcactttagctttatcagatatatttgatatgttgattattttccccagatataagtatgtcctttccgtatgtcctttcaagttatcttttattttaggagagttttaaaaattatagtttttagtattttttgttttgttcctttggtcatttcttgagggactcctgttacacacacatgttggaccttctttgcctatgttacatattactttctcttgaaatcttgtctcctcatttttttaattctgtagtttttttcttaccatttcctatttctgttaaggcattatccattgtgtttattcattcttgtgtttcttgtaacttagtcttcatccctaaaataagttttgatatcttttctaagtttttcctgagtttgatcacctctattttcatatcttccttgctgtcaaacacatcatttccgagtattttttaagtaatgaggtttttcatcactgttgtcatttaaaaaaggatttttagcttactttgaaatattaggtcacagttttcatcttatgtgagcatgtctttctggcatgctttcattattcatagggacatcttttattctttgtatgcttttattcccttacaataactttaggaagaatctgctattttctgttgttcattttttttaagtaaaatgattttttttgtacttttaaatagggtggatagttcatgataccatttctgtcttcaaggctctagtgctcccactcttcttgtttttgtaaaatgacttctaaaaaaattctcgattctgctctcttcctgactccgttgtccaactttttctcaaccttctcttttctttgcttctgtctgctcaattttgattagactctcagtaatttctctttactgttggattccatgttggaagcagttcttttttgttagatttgagcatagccatattgctctagtatctcagactttattgagttgatgtcctcttgctttcacttgcaaatcagattgtgtggaatcccctcccagtttggctactattctagattggccctttacatttacccattagtgaattgtgttctctggaccatcagaagcctgggtacattcctttgctgtctctcacacagatgctgataccactatggcccaatacttttttatgctttctcccaactcatttatatttggtgttttgtggagatattttgtgactttattatgttgtagatgccaatactccttgacttacaatgggggttacatcctgaaaaaaaaaaagaaaatattttaagtcaaatatgcatttaataccccagtaaacccattgtaaagtcaaaaaattgtgagtcaaactatcataagtccaaatgcttcttgacttaggtatgatgggtttatatcctgataaacacatcataaagtcaaaaaattctaagttgaaatatcataaatgtggaaccatctgtattgtccttgaatcttttgtttggctattgtcttaatctgtttcgtattgctataacagtgtcacagaccagcatggccaacatagtgaaaccctgtctctacaaaaaatacaaaaattagccagacatgttggttcatgcttgtaatcccagctacttgggaggctgagacatgagaatcacttgaatctgggaggcagaggttacagtgagctgagatcacaccactgcactccagcctgggtgacagagtgagactctgtctcaaataaataaataaagtagctatagaatattatagctagtttataaaattttcagactcagggttaaattatttaatgaatttaaactattaaaatctaaatttaacttacatattagagcagtctgatttaattttactttgccactttcacaaaaaagaaattcattgttcacaattctggagagtgggaagtacagtatcaaggtactagcatttggtgagggccttcatgctatgtcatcccatgacagaggtagaaaggcaagagagcaaaagagggttgacctagctctaataacaacctgctcttgtaatagcattaatgcattcatgaaggcagagccctcatggcctaattgcctcttattggtcccaactcttaataccatcagagtggcaattaaattccaagatgagttttggaggggacattcaagtgtagcacctttcttccttgctgtctgtctgtcgttaaaatctattctgccagcatcttcatattgttggaatacattgacaaaacttctatataaggaacagtcttgaatattgacttattactctatttaatggacagaaaatgctacatatattacatagatatacatagagatacacacaaacacacacacactcacacactctccatatttgtccaggtaatggtttcacttaatacactaacagtgtttgtgtttgtgtatcagtgtttgaagtgaaactgttacgtggacaaatagggagagcatgtgagtgtatgtgtttgtgttttgtgtatgtctgtgtatttctgtatgtatggacatcaatcccaagtaaaagcaagtgaaaaattttagtagtatcctctactagaagagtgaatatttttctatttgttgcctttatttcttattaaataaaaagcaaattttgagggaaaatgctttttcctatgtgtcattatattgaggaaattattccctactttaattatcaaggtgtttgaccagtaatattagttagcactttaggaggctgaggtaggcaaatcatttgagcccaggagttccagaccgtcctgggcaatatggcaaaaccccgtcctctacaaaaaatacaaaaattagctgggcgtggtagcatgtgcctgtagccccaaatactcgggaagctaaggcaggaggatcatctgagcctgggagatcaaggctgcagtgagccgagatcgtgccactgcactctagtctgggtgacagagcaacccaaatgtccatcaatgatagactggattaagaaaatgtggcacatatacaccatggaatactatgcagccataaaaaaggatgagttcatgtcctttgtaaggacatggatgaagctggaaaccatcattctcggcaaactattgcaaggacaaaaaaccaaacaccgcatgttctcactcataggtgggaattgaacagtgagaacacctggacacaggaaggggaacatcacacaccagggcctgtcgtggggtggggagagtggggagggatagcattaggagatataactaatgtaaatgacgagttaatgggtgcagcacaccaacatggcacatgtatacatatgtaacaaacctgcacgttgtgcacatataccctagaacttaaagtataataaaaaaaataaaataaattttaagttcaattaaaaaaaataaaaatgaaaaaaagagagcctattttataacctttgttgttgtgctcttgttaaaaacagtttttctttataaattgagatgtaatagtgagcctgtctcatttcataaaaaattttccaagctgtggtgctttaactggaagttaaattcacagaattttgtgaaatattgttttctgagtaggaatatttgtgttccttttgcttacaatatgactttccacctttggtcagttattttagttgtttttgtagttgctaatactttgtgattacttctttagtatatgaactcattagtcatagtggattttagatgtttggaatttcattaacagaattcatttgaaatttgtaaggctgatgaatctccttctactaattactactttgctaaagttcgttaaaggactatcattctgccacctcccaaaaaaacgaacttaaaaaaatcttttgccatatatgtaattaaaaaaaaaaagtattccaaatatcagagctccatcttaatttgttgtgtactttttcagtgcttgttaccaggcttcttgtagccatattagtgaagttttcttttcaaccttgatgcaaagatactcccttgagttttctttgaaaatagactgaaggcctccttctaaatgtcttatgtgtcatttgacataagtttattgggtgagctgtaacctagagaatcatgcccaaatagctgcctgactgcattttttggtttgtttgtttttcctgatggacctcaggttacagagttttgtcaggcctcatttggtcagaagcatgtttgtttctcttgtcagcttcttgattggtttctttccagattctgcagggcagccatatggtcatttctgcatgttttctagattgcttctgtggtagggttccaggtttggttgatgagtatttcagattctacccacactgagagagcttcagttttgctctttggttttatttcagatagcatattcacaacttgtgtccttcctgtcacttatctgaagttcatttgaatttggtgattttattttacgtggcctatgtatttggctaatgtttcatcattttatatgtcaaggaggaagactattaatggctgttgaagtgcttagattatgctaacttaggaaaactaaatctagtaataattctattggatgataaatattaatgtacattagattgggtagaaaaacataccagtcacctttccatatcttgtattctcagttattttgttacctttttttttaaatttattttgaaaatcattgtctataactgcaaggcaaggagaaaattacttaatgttagtagtgataatacattaaaaactatagctttcaaggtattctcattacagaattaatgaagtaaatttctactaataaaattgagctttaggaaatttatgcttagccttagtgaaccaatagcaggaaaattccacacctgtatttatttatggctatttttgatctcaggtagattaagaactatatcatttccagatattttgaagtttaagaaaagcaacttaatgtcttgtattcagtctgatcttgatgaatttggtattttgatttcaatgaagattgaattaatatgaataagtgaagttaaacatcatgaaaaactcactgactacctgttaaaataaaggttttataaagtagctatagaggctgggcatggtggctcacacctgtaatcccagcagtttgggaggccgaggcaggcagatcacctgaggtcaggaattcaagaccagcctggccaacatagtgaaaccctgtctctacaaaaaatacaaaaattagccagacatgttggttcatacttgtaatccagctactcgggagcctgagacatgagaattacttgaacctgggaggcagaggttacagtgagccgagatcataccactgtactccagcctgggtgacagagtgagactctgtctcaaataaataaataaataaataaataaataaataaataaataaataaataaagtagctgtagaatattatagctagtttataaaaattttcagacttagggttaaattatttaatgaaattaaattattaaaatctacatttaacatatattagagcagtctgatttaattttactctggcactttcattttgtaagagaacctactttgtttttttcagacttacatttttgaggaggtagttttttttgtttttttttttttttgttgttgttgttttttgttttgtttcgttttgttttgcttttgagacggagtctcgctcttgtcacccaggctggagtgcagtggcgtgatcttggctcactgaaacctccgcctttcgggtcaagcaattcacctgcctcagcctcctgagtagctgggattacaggcgccctccaccacgcccagctaatttttgtacttttagtagagacagggtttcgccattttggccaagctggtctcaatctcctgacctcaggtcatccacccacctcggcctcccagagtgctgggattacaggtgtgagccaccgtgcaggctcaggaggtagcttttattgtaactacttttaacttttatttgcatgcaaaatgccttgtttgcgtggttgggtctttttccaaagaagctatagtgtactttgtctttcttactttctagtgttcctaagcattctaccttagagtgttttgtatttaggttttaaggttcttattgccatggccagaacttaatttattaatagctactgaccttttgaaggagctgactacatgtttaaatttattagatctaaaagtttagctgctaattacagatttcaaagaattggttgacttttttgcagcaggatattttctagagtgtatagtcaagcttttaatgtctctaaataggttgttgaataggttgttgccccccaaaatttattttttgagatacagaaagaaaatataatttctgtatttttattttttattttctacatatacatttctatttttctgttttataatatataaaatattagcaatatcatagatatccagttcataaataagcagctacacattactgcatgcctatatatttaccaatagggacacttagtaaaaataatttgaagaccatagttctgacagagtagttatagaaagtgaacactaagtgtagagcatgtgatctttttaaagagatagataaagattcaatgattaaaaatataataaaagaaaaattaagtaaatatagagtaaataagtaaaagtatagattagaatattattatacagaccaagggactcatttatagattgtttatatatttaactcattataaaacattaaaatgggctgagtattgtgactcatgcctgtaatctcagtgctttgggagcctaaggggaaaggattgcttgaggccaggagtttgaaaccatcttgagcaacacagcgagaccccatccccataaaaaatttaaaaattagccagatgtggtggtgcacacctatagtcctaactactgtagagctgacgtgggaggatagcttgagcccaggagttccaggctgcagtgagctacgatcacgccggtacactccagcctgggcaggtgacagagcaataccctgtgtctaaaaagaacaaggctgggagtggtggcttatacctgtattcctagtattttgggaggccaaggtgggaggatcgcttgagcccaggagtttgagaccagcctggtcaacatagtgaggcctcatctctataaatttaaaaaattagctgggtgtggtgatgcacacctgtggtcccagctactcaagagactgaggcaggaggatcacttaagtctgggagtttgaggctgcagtgagctgtgatcatgccactgtcctctagccctgggtgacagaactagaccgtctgtagaaaacacaaataaaataaacaccaccccttcaaaaaaaccattaaaatggttcctattgtttatttactaaactaaaaggagttttaataattaaatggactacatacagcgtttcaaattgtttggagcaatttaagtagaggctcaagttattcacttagaatggcgtttccttatctggttatagctgacctttatataggccttttaaatttagaggtcaactgataaatgtcggctttgcctctcaacagtttgttgtcttgtgtttcttcgcagtggaaggaatttaaagtaaactttaaaattttaaacaaattactataaatcagataatgggagatgttaattttctgtttcccagtgttgctaaaattagtaggtattgcctttataaccaggaaaaatattcaaaaagttaatataaataacttctagtagtattaatagaactagaaacagtttatgtatcttcagagttacctatgatgtggggaggaggtaaagataaagggagaagaaacaaacaataaaacagaaagcaattagcaaggaacattccaaaataggaaaaaattacatgacaaattaaaccaaatttcttataacaataaatataagtgggataagctcaccttttacaaccagaaggctcgctacaatgtttttttcaaaaagtataaaaacatactttgttttatgatacacataaaaaaatcttttaggatgggcataccatgtaaattaacagaaagaaagcagaagggggtcataatattcagtatcataaaatttcaaaaataattaatgggacaaattataatatgatgcatataagctgtaatgttgatgtcaagaatctatatgtaccctttaccattatgtaatggccttctttgtctcttttgatctttgttggtttaaagtctgttttatcagagactaggattgcaatccctgcttttttttgctttccatttgcttggtatatcttcctccatccctttattttgagcctatgtgtgtctctgcatgtgagatgggtctcctgaatacagcacactaatgggtcttgaatcttaatccagtttgccagtctgtgtcttttaattggggcatttagcccatttacatttaaggttaatattgttatgtgtgaatttgatcctgacattatgatgatagctggttattttgcctgttatttgatgcagtttcttcctagcatcggtggtctttacaatttggcatatttttgcagtggctggtaccagttgttcctttccatgtttaatgcttccttcaggagctcttgtaaggcaggcctggtggtgacaacatctctcaacatttgcttatctgtaaagaattttatttctccttcacttatgaagcttagtttggctggatatgaaattctgggttgaaagttcttttctttaagaatgttgaatatcggcccccactctcttctggctgcaaatcaaaaccacaatgagatactatctcacaccagttagaatggcaatcattaaaaagtcagaaaacaacagatgctggagaggatgtggagaaacaagaatgcttttacactgttggtttgagtgtaaactagttcaactattgtggaagacagtggtgattcctcaaggatgtagaactaaaaataccatttgacccagcgatcccattactgggtgtatacccaaaggattataaatcatgctactataaagacacatgcacacgtatgtttattgcggcactattcacaatagcaaagacttggaaccaacccaaatgtccatcagtgatagactggattaagaaaatgtggcatatatacaccatggaatactatgcagccataaaaaagaatgagttcatgacctttgcaaggatgtggatgaagctggaaaccatcattctgagcaaattatcgcaaggaccaaacactgcatgtcctcactcataggtgggaattgaacaatgagaacacttggacacaggaaggggaacatcacacaccagggcctctcatagggtggggagctgggagagggatagcattaggagaaatccctaatgtaaatgacaagttaatgggtgcagcaaaccaacatggcacatgtatacctatgtaacaaatctgcacattgtgcacatgtaccctagaacttaaagtatacttttaaaaaaaggaaaaaaaaggaatctatatgtgctaaataatatagaactaaaatataaaggtcaaaaatgtgcaaaaaataaagagaatttttagaactcaatagtagtttaaagcttttagagtactcttctaagtctgtaacagataaaactgataattattcctatattctataatttaattcaattgatatataagacaaggaactatatattctgaaaacaaaatatcttctctgtaattcatgaaacgtttataaaaaatgaccatgcttttggtcacagggaaaatttcaggtaattccaatgagtagaaatgggttccattagattctctgccttcagtataatacaattagagctaaagtaatacagataaagaggaaatctggtaattttcagatcttttctatcaattcttgggtcaaaggaaaaaataaaaactgcagttctaagctattatctgcctaatatgataacatgcattttcttctgtttttctggtaaactatgtattctgatttcaggaaggtgaaggacagcattcaataataaatgtttcttcaccccctgtaaagaggaaggcattttgtttgatgtgagatatgactctgaaaagagttagccttgggaacctgtaaatctgttggattctatcacagaatgcacattagtagtaaattatttaggatagatatatggagaatcctctatagttatctgtgtagatttggtgttcagtgtgattaatttttaacagagattcttgtgatacccctatgggaaggagaagtatcatagtttgttatggcagattgattgaactgtgtataatgtctgtagattttgggttctttttacctctgtcccttgtttgcatctcttgttcagtattcctctaggactcaaattcttcgtctgtgaatgaggaagttgaattaaaatataaagttatttatacatgttatttttgtatagctctgaataaattcattaagtgagtattgaatgttggttcctatttagtctgtagggtttaaacttatgttgtgatgggagagagaaacaggcttagggtgccatgaaagcagagacaggcaagtatatcttagaaggaaggcgagaggaaagggcattagggaaactttcacagaggcagtgtgacatctgaactggtcttgaagataaatgagtttgtcaagtaaacaagaaagagagttctagctcaggaagtagaatgtacagaggcagaaagaatgtattttacctttggaaaaacacaggccattcatgtgacgcttagcatgggattatggagtagtaagatattaggcattgaggtatatggcacccaaatcgtgaaagcttattatgtcatactaaataatataggctttaaattaaagacaatgactaaccatggaaatgttttctatttgggtatgacactgtaaaatttagttgaaatggatacagggatagcagttagaaaactggcagttcaggtgagacatgaatgggagtcttaattaaaataatggcaatgagatgatatgcagatttatataaaatggataggcttcatagggtctgtgggagccctggaaatgtatgtgagatttaacatgaatgtattttccttgggacatggttcatacatttcatctgatcatacaacagggctattagtgtaaatatatatatcacaggaaaaattgacaggatgacattctacaaactatgaagttagataactttaaattttattttattcactaatgactaatcttttttttcactttctgtagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcaggtaaaatcaggaaatcaaaatcagcttattaccctgcacttcttctgttttgatcacagtaaagaaaatgtaatataatcaaatttccccaaatttgaaatacatccaaccaaggaagaaaggaaaaatccattgttttaaataaactttgcagtaattgttttttgtcatctggcttttagaagttttgaaattctttaatacttaaatagcacatcagtctatattacatggttgtagacacgttgtaattttaagaattgctttccaatacaaattaaaatgactggtaaccattttagaaaatataattttttaagaagagtttgcaccgttcttgaaaataatttataaagtagtaacaaatgcctaatgaaatctatgttggagaatttatttttttctgtttaaaaccaagactaaaagccttcagagggaaatagaaattaactgtctcattttccctgtttttggaaggatctccaagcttttgatttgaaaagcttttcctccacatcagaaaaaaaatctgaaaacatctttattcatgattatctgagttcttgaccatatcttcataacagtagtcaatcagcatttattggcataaagaagaatactaaaaatataagagatagtcattggttttaaaaaacctgcagcacagttaggtagatgagatacacatttataaaaattggtaaaagaagacagtgtataattcgacgttagatgaatggagtatgtaaatgtgagggcattcaaaggaaagagaacattttgggctttgtaggttagggaaatagaataattagagtttcatgtccgaagactgaggaaaagagagagagttttggacatgatctgtaaaactctgcttctcaggttttgtcattttctcaggcaagcttgcaactgtgaaattggcttcttctttatcatctgtctcatcagttctgtccttgtaatgttttatgctgctctactcttttgatttccattcttcatttagtgaggaagaggataagtttaatatggcaggcagtggaatttccaaatagaaataactagcaaaacttagaggtgtgggcctggacagttagagatctggacacagataattaattcagaaccatccttctagaggagttagattcacaaatatgataaaatgtaggtatagaaaataaaatttaaaaataattttaaaaagaaaaaaatttaaaaaaatgtacttatagagtatgaaagaagaaggtcaagtgatggaggacttagtttttggaagggtgcacacacacaagaaaaaaactaatatattcatctgaaagcagcaagaggaggagggagttaatatttattaactgtgtaccgtgtactgtttgttttataacctgtttcatttaattctcaaaagaccattgcaacattacacagatggaaaagcagtcactcagggaacttaaatgatttatttaggagcatagagctagaaagtgttggagccagatttctaacacaggctaatctgttaaccaatataagctccatttttattattactgaactgggattataggataatacaaacatacatatgtatgtatgtacctagtgctgtgacactgcactaaaaaatggtagctattctttttagattaccaaaccaacatatgaaatgaatgctatgtgctgacactatcgagagggaaacattatctagttttttttttgtttgtttgttttgttttttttgagacaggagtttctgtcttgttgcccaggctggagtgcaatggtgtgatctcagctcactgcaccctccgcctcccaggttcaagtgattctcctgcctcagcttcctgagtagctgggattacaggtgcctgccaccatgcccagccaagtttttgtatttagtagagatggggtttcaccatgttagtcaagctggtctcgaactcctgaccaaaggtgacccacctgtcttagcctcccaaagtgctgagattacaggcatgcgccaccactcctggcccagaaatattatcttattcgctcttcacaaaaattctgaaaaagaagagaagccagagaaagagcgaaaggctaagtgaaaaactggaatagtgaagccttagaagtcagaggagaaagctattctaagaaaggaaaaaattgttgacagtatcagatgctaaagagaggtcatggtgattaaggaccacatttagggatcagaggcacattgtcttggagagtgcagtattggagataatgccagagtaggagaccctactatttgagagttaagagagtgatgtggagatagaaggaaagaacgctggatatgtttcttacacatgtctgattttttatctgtgcagtggggttaataaaacctaacccataatattactgtgtgattaagtatgataatattgaaggtaaatttggcaaatactatatacacatttaagttagtagtagtatatgtagacatgcccgcttgtaacatttgcagggtctgcagcaaatataaagaccaatatactatatgtacgtaagttaaatgaacaaattattgagtaaaatacattttgtcctccccccactacccaatgacaaataatcttcatatggacctggaagatgaggtttaaactaagaattctcagattcttcagagttacatgccggtatatgtccacatggggcaggcccaccaggcccattaggcccacctcgtctgagcctaagtcccattctcttcctaccctacaatctattctgtactttaagctggctttacacatacacttggacccaccagttctcacattcaagtgccatcctcaaaaagcaagaaccagggaatgggtctgcagaccttagaagccaagcctactgctgtttgttcaggaaattcctggttttagattacctggagtatattctacagccaggcatgggctcataacgtccatgctctttgctcccaaggtctcttatcccatggggaggggcatggctgctagaaggccagaggaatttctcctgaattttgaggtccaggataagggcttgtctggcttgcatctatctggatgtaggtcatttatttgagaagtttgacattgaaaagaaggtaaaatatagggctcattttacagatgaggaacctgaggcttagagaagttaagtaatttgtacatcattacatagctgtacattaatatgtactacatacatattacatcgttatgtaatatgtactacgtacgtagtacatcgttatgtaatatgtacgtagtacgtattaagcgtgaggacagtgaacccagacctggctgattctaaagcgtttccttttttttcttcagctgtctattgccttttatggcaaccactaactactaacctacttcttgcctcacaagcataagaaatggtccttccctaaccatttattagtttaattgaagatacaagagatgaacatatgagatactttttatggcgacatccgtttctcctggattaactgttgaactcttagggtgggaagaacttgttttatttatgtagtggaattatgtagtggacattggtggaaggaaggtggtatactcagcttgctacagacattaaacacctgggctgtttggccttggtggagggtgtcttgagggtgttcttccttttatatttctgtttcaactaccttaattattgagagcttgacataaaaaaattaatattgtttagtatgtttacatattaaaaagaagtagcataatgttgtgaaaagattgtagactttggaaccagatcatgtattcaaatcaaggcccactgagggaactttctgggataatgaaaatgttaattaaaaaagtagttaattttaattaagtaaaaattatttatatattaatggtgtacagcatggtagacacacacacatttgaaatgattacatcaatctatttaacatatgcgttacctcatttttttatgtgtggtgagaacacttaaaatctactctcttagcaattttcaagtataccatatattttactgtagtcattatgatgtatagtagatcacttgaagttgtttcttgtaactgaaattttgtgtcctttgaccagcatctcccaaggactcctagcctctgataaccactattctactctctatttctgtaagttaaatgttgtatatcttttttttttttttttgagacagggtcttgttctgttgcccaggctggagtgcggtgatgtgatcttggctcacttcaacctctgcccctcagattcaagcaattctcatgcctcagcctcccaagtagctgggaattagctgggactacaggcccctgccatcacgtccagctaatttttgtatttttagtagaggtggagtttcaccagtagagaggctggtcttgaactccttgcctcaagtgatccactagacttgacctcccagagtgttgggattacaggcatgagccaccatgcctggccagtgttatatgtcttaatagaagtttgggttatgttggcgaattcatttatcggaacttacccaagtgtacacttgtgcattttgctgtataactttaactttaaaaatacagaatatgaacagaaaacaaatactgaactcagatgtttagagatgaagtatactgctgtctgcaactttgaaatgaataaaaaataagatgaattgatgggtggatacctagatagatagctggtggagtaaatagagcaaaatgttatttagagaagctcagtattggctttatgggccttcactgaacagttttttttttaactgttctgtttgaaatttttattagtaaaatgttaaaaaaaaattcatgacccactgacttaactgctttgtgacccagtcttaagctttcttttctgtaaattgaagttagtaatacccgatttgcacattcacacgtttattctgaggattataagatacagctttacatttttaaggcctctgaagaaatggatcactgctggttatttagagtcatctgtttagccttgtagaaagaaaaactaaaatccatttgtgaaatttaatattttattactgtagccttgcagatacaacctttttaaaacaaaaaatgtattaccaactcttaaaattgaacttgcaattaaggttactataataaaacagtaatgtttcctcagtcttcaccccatagtctgaggtgtagtctctggacaaattttaaattctgtgtttgaatgtgtttttaaatgcgaaagtaatatatattctttgtaaagtggtcaagtaataaaaataatatatacagcaataatcagaggtatttcctacaacttcccaggtatagtaatgattagagctattcataaatattggcattctctctcctgggcacatgataggattctacttctctgcccacttgaagttaagtgtggccatgagacttgatttgggaagatgctttaaagaactggtgcattctctctgacagggaagtaactgttcattcctactctgtccatctgggtcactgacagtgacaagcatagccttcttaatgacccatacatgtagtatgagcaagaaattaacttttgcagttttaagtcatttggatttggagattgtgtagttactatcctataatctagtctttactaatatgcaaagtataacccttttaaacaaatttttgtaggcctttcagagcatagtatgttatttttattaattaaaagcttttcaaaagattcagtgtggacgtaaaatcagtatcaaaatagaatgaaaaaaaaaaacctgagcactggaagtggtttttttttttcttagagttttgccatttgcttaattaacttgttttcttaatcttatttaaacatttaaaaattgtatctttaatggtttattttcctgttatacctttatttgagttttataggccttaaactttttctgatacagttagatgcgattttctttgtatgagtagtccatccaaaacagcccctggaacaggctacctcagtctcaaaatgtcacctcttttgaaatgtctattaaactagaagacatgatggtgttaatctacagagctaattttcattaacaagctttctgcaagtgaatgtattcagtcttaacaagagaaaccaccactgccttcttgcttctttcttctttttaaatgaggatttaaaatgcttttgattagatttatattctaataaaatgatggatttaatgctttttatatataacttgtaaaagaaaaaagtcacttgcctaaacatcgaatttccactttaggaatctgctccctgccaaggtcagcatcctgtcataatatcttataaaatctctgtgcttctcagttcttgcagggatgcttagtgatatatttatagacattctataattatcccagaatgtttttaattcagctaaattaaaagaagtaaatatttcaggttatgtatttttgggttttatctgattttgttttaaaaataatgctttttgatggtaaaataatccatcatatatttgatggcaaaataatccataatatagaaggacatgaatagtagccactaactccctaggcctactacttaaaaaaagtattattaacaggtttttgggggacacatattttgagaaattttctgtacctatagaaatatattgtttagacatatacacacagagatggaatcatactttatatcatattactgacttgctttttccatttgatggatcatgggcatctctccttataacatataaatccctacctcattttttttttctattttttaagttgtggtaaaatatatataacatgctagggaggcatggtagcctgtgcttgtaatctcagctactcaggaggctgaggcaagagaatcgcttgaacccgggaggtggaggttgcagtgagccgagatcatgtgactacattccagcctgggcaacagagtgagactctgtctcctcccacacaaaaaaaaataatgaaatttaccatgagtgaaaatgaattaaccattttttaaatgtacagttccatagcattaagtgcattcacattattgtacaaccattatctccatccatgtctaatacttttttactttttccagctgaaactctgtgtttattaaatactagctctccatcctccccaccacacgccagcctctggtagccatcattctattttctgtctctgtgaatatactctaggaacctcatataagaaaatcatacagtattttccttttttgtctggtttattttacttagtataatgatttcaggatttgacattgtagctgtgtgtcaaaatttccttcctttttaaagcagaataatattccattagatatacataccacattttctttatccattcgtctatgggtggacatttaggttgtttctgctttttgacagttgcaaataatgctgctagcaacattagtgtgtgggtatcttttcgagtctcggctttcagttcttttgtatatatttccagaagtagaactgctagatcatagggtaattctgtgtttaaatttttgatgaactgatgtactgtcttccactatggctgtagtattttatactcacattagcaacgcacaggggtccagttgttttttcttgttgttgttgttgttgttttttgtttttttgtttgttttttgagatggagtctcgctgtgtcgcccaggcaggaatgcagtggcactatcttggctcactgcaagctctgcctcccgggttcacgccattctcctgcctcagcctccccagcagctggcactgcaggcacacgccaccacgcccagctaattttttgtatttttagtagagacggggtttcactgtgttagccaggatggtctcaatctctcgaccttgtgatccgcttgcctcggccttccaaagtgctaggattacaggcatgagtcaccgtgcccagccaggggtccagtttttctacatctttgccaatattttcttttttccttttttaaaacataatagtcaacctggtatcttactttgattttcgatttgtatttcctaaatgattaatgatgctgagcatcacttcatctgctttttggccatctgtatttcttttttggagaaatgtctattcaagtcctttgtctatttttgaattgggttttttgttgttgagttttaggagttctttatatatactggatataaatctcttatcagatacatggtttgcaaatattttctcccattctgtgggttgcctttttattcttttttttttttttttttttttttttttttgagatggagtcttgctctgtcacccaggctggagtgcagtggtgtgatctcggctcactgcaagctccacctcctgggttcatgccattctcctgcctcagcctcccgagtagctgggactacaggcgcctgccaccatgcccggctaattttttgtattttttagtagagacggggtttcaccgtgttagccaggatggtcttgatctcctgaccttgtgatccacccgcctcagcctcccaaagtactgggattacaggcgtgagccaccacgcctggccaggttgcctttttattcttttgatagtgtactagtttttaattttgataaagtccagtttatctatttttccatttgttgactgtacttttgttggcatattcaagaaatccttgccaaatccagtgtcaggaagctttcttcttattttcttctaagaattttagcctttaagtttatgtctttgatccatttgagtccatttttgtataaggtaagagtccaacttcgttcttttggatgtgaatatccagttctcccagcaccagttgttgaaaaggctgtccttttcccattgaatggcctcgacacccttatcaaaaatcaatttaccgtatatgctagggtttatttctggctgctgtatttatcacagtggtctgtgccttgtggctttttgcattatgccataattgggaaagattttttccactccaagttaaaaaatttcatttaaactatattttcttttaatagttttatgtttctttttacatatttgtgtctttgatatttctggagtttattttgatggaaggcatgaggtgatatccagctttatttatttttcaaagtgactaacagttgataaagagtttatcttttccctgctgatttgagatattgttatatcataaatttccattcttatttggatctctttctggcttctctatgctatactatataccattaatatcttttttaatactgaatgattttaatttgtattgcttagtaattcattttaataatttgtatggctagtcttgcgtatttatttttctcagttaattttataatttgtacaattcctcaaaatgttttatattacaattaaatatgaattcaggggaattgttaccatattgaatcttatccaagaaaggggtatatctttttattcattcaagtattatgtttgcccttcagaatattttacaacttcttattggaacaacacatttcttgttaaacttatatctaaatattttgtcttttttggttgctgttgtaattaggatatttaatatctaatttacatacaggacatcttcaacttgacttttcttgtttctagtaatttttaggtaattttctttggtttttcggctgtacgatcatccaaatagtaattctacatccttttcgttatttatttcttggtatgtgtcctcttttggaattgcatttgttgccactccgagaaccatgtaaactaacagttatggtactgaaggccttgacttttttttttttttttgagacggagtcttgctctgtcgcccaggctggagtgcaatggcactgtcttggctcactgcagcctccaccttctaggttcaagtgattctcctgccttagcctcccgagtagctggaattacaggcgcccgccaccatgcccagctaattttttaattttttagtagagacggggtttcaccatgttggtcaggctggtctcaaattcctcaggtggacctcaggtgatccacccatctcggcctcccaaagtgctgagatgacagatgtgagccactgtacccggctgccttggcctctttcttgactctaatggtaatgtatctagtttactcactggacaaggtatactgacatttgctgtgaagcatgtgtgtttgttatacgtagagtacacatgcttattttactaatggtttttcttgttttaatcaggaataataatttatgtggaaaatgccatttcatcagtgaatatgtttgttaattctatatttgtttattattcagcaatgagttcttaattttttttcatgagccttagagtatttttacacttgcttcataaacaggttttgcaagatttccttcctctgtgctctagcataacacagtataaatatcatctgaattctgtcacttgggtctgaaaggattttacctaagtaacttacttactagcctagtatgtttttggattgtagcactttagaaaattttcttaatttcttccatggcacttggtctcttggttgatatcagggagagatttcaaaacttgtattctctgagaggtgagagatgggatggttagatcttaaataaaattacatatactgatacttccctttctccaggtgatggtattattatatttggtattttattgttttaaattaatttttaaaagttaaactgtgaaacatgagacatgccaaaagcacataaagcagtttctcttaatctcattagacttcagtctatggagttttatgatcctgcctctatgtcagcatctttccctagaaatctatttgtttttatttgtttttaagaaacagatccagactaagtagttagcatttggctttaggcaacattcaataaagttaactaactctgaactaaaacatatatattcttttctgttgacgtcatatttaaagtacctagccttttcctccattcctgaaaggagcttggttagggaggactttagtcaaaggaacagatgatgcacctcaaatacttactgatataaaaaataactttcagttttatcactctgatcagaaattcatttcctgaccaaaagtcacactttatacagctgtctgagtttcctgtgcccttgtcaaagggcttgcttttgaaatatatttaagaaacagcagttgctgaaacattttaggggctgggggacttcttcatgaaatggaagcaagactgaagatttgactgtttttgcctcttagattgcattctaggggtctaaattattttttatggagctggcccctgactggctgttgagatcacctttactttttctctcagccatcatctaattatgagacagaggattgtagaatcctagagttgaatagttcacaccaaattagtcatgttcctggtttagggagtaatttctttggttgctaaaggaatatactcagttatattaatgaaagattttaacccataactaaaatatttaacattttattcattagtttcaaataccatctctaaaattaccaaagtcaaaattctacttattaattttaatacgttatgtgttcatttgtttcaaaagtagaaagtatacagcgaaaggcctttcccatacccccgttaccctgatactcagttttcttccctttacgagaaacatttagctggaaacaaaattaacctgtttttcttcattgctttctcatgcctttgcccctaagcacactctaggtaaaattgtgaaataggttgtatttatttggaataacactcttactctggtcccctgacctgtgttggttttgtacattgacttatacattggttctcaacctgttatatcttgtatcaattttctatgaaaaattcctgtgataatattaaacagaatttactgagaaagacatttttacgttagagacattatgccttaacagttaagatcgcccgggcgcggtggcttacgcctgtaatcccagcactttgggagaccgaggtgggcagatcatgaggtcaggagatcaagatcatcctggctaacatggtgaaaccccgtctctactaaaaatacaaaaaattagccgggtgtggtggtgggcgcctgtagtcccaactactcgggaggctgaggcaggagaatggcgtgaacccgggaggtggagcttgcagcgagccgagatcgcaccactgcactccagcctggacgacagagcgagactccatctcaaaaacaaacaaaaaaaaccaattaagatcatagagttatagtttaaaattaggtcatagtttacggtatggtatgagaaagcagtatgcctcttaaggtatactgttttgtataaatgaatgaataaatgaatgattgatatgggagataccatattgttaggaaccagtataaactaagggaaaacttttccatgctattggaattctaacagcttttgggggacaactattattgtcaacatagcctattgcaatgaggattatatgaaacaatccatgttaagcttctagcacagtatctatgacataacagacactgatacttattagttgcctttgattagaatcaatagtattttactgttaccgggtttaaatataataatatggaattaagtggacaggaaaagtctttattactagtatcaactattgattatacaattatgaacattaggtctggactggtaggaaatggcatagaaatgacacaagtgaccccagagcatgtgagggctgtgaaattcaataaacaatttctggtaggtcaggattcattcagtcagaggtagttattgtgtgtttgctgtcttacaaataagaaatggtacttcaaatctataggttcatgtgcaggagagcgtatttacattcttaggaaagctactccctcctccattacttagttatcctattggtgatattcatgccatcatcttagcactatttttatgacttcagtgggtgttttttagaatggtgtgaaaaatatttttggccatatgtagtaatcacctgtgttgctgattttctgtcagatgtaagagattttaaaacaataacatgttcaaagctagcaagaaaaatgagtgggtatatggtcaacatgacaccttgagtgcagattccgtatcttattgatttcaattttttagtctaacactggttttcaaactttagaatccatcagaataatctgaaaaggttgcttaaaaaataagaagtatatttctgggccttatctaagagttccagatctagtagtctgaggttgagcctgagaatttgcttttctaacatgtgatgatgctgctgctcatttggggactgcactttgaaactggtctaacataatgagcacaaaacttagcatagagttggagcttgataaaaaatttgaatatgtaagtgctgctattgctgaattcctaaagcttaaaaaaaaaccttccgactttacataaaataaaaatgcagtcttaacttccacagtgttttgtttgagctgaattctgcctttttctacactctttgctaatcagagcagctatttactatatctggttaccactcttcccagaaaggcaaaggataattacactagaaccacaatcttttgtgctgctttgtaatacttcatcaggatagacttttcaaaataatatttaaagaagttttaaaagaagttaaaaattgttttattagtcaaaaacaaatttttgtaaacaaaaacaaatatttgtaaataatggtttgtcattacctattctaaacttttttataatttaagattagtctgtggtcataattaattcttaatataggtatcattgatttttcagctaattacatctcatttcttgctaggtttatcattgctataagtactataaaataattagcagtcagtactcatatttctataattgatttataaactacaataaattttaagaccagtgatgaaccacataaaatagattttttaatatttaaataagattaaagaattttgttatgtttttgttgatggattttttttaagtggctttagacttttgcacattgacaaagcatgttttttgctaggagttagtttgagctggtttgaagttgataaaactaaaaagcatattggccctttctagttagtgaataaagatatacataacaaaagcacccagtatttaagctttttggttgatctagccaaaaataatttttctaatggtattcattttgaagcctctttagtcctgtgcagtgggattattccctttgtattttacttagagaaaaagtggttctcacacaggttggagctgggaggatggccctagaggttggaaagaaatttcatagtctggactttggagacttccagggagtgagaatagaaaaggaccccttctacctataggtatcctttttacatagaggctttttttttccaactaccttttttgttaatagtcttacagataggttttagttctgcattgttcaagtgtacagaagtttcatttcttttaaatgatggtatgatattacagtttttcctaaatttatttaactgtggaaccctttttgtctactccttttaacaccaaaggcatggttatatgtagcactatttaaaaaattctagtctagattaatggacagaataacagaccagttggaaggggctgcttgctgatatgaaaggaaagaacttttgctactttgtgttattttcctgattgaaatggtaaaacatttctcaaatacacaggtttaataaattggattcaaattagtcacttctgtgacttcttaatcatcagctttaaatagatttgattttggtagccatcttttggttttgttttggctaaaataactcattaaaaatcagtgatcagtgtatagaacactgccctccaattgaactttctttagtattggaaatgttctatatttgtgttgtcctatatgacagccggtagccacatgtggttattgagcttttaaaatgtgctaagtgtgactaaggaagtttagttttattaggtcctcattaatttaaatctaaataggcacatgtggctagtagctgttgtattggacaattcaatctatagaatatatttgtagatgagaatttttttatactgtttattttaaattgatggaattaaaactactctttgggggatatttttggaaagttaatactatgatgaccttaaattatatgcattctatagttacatgattgagagaactctttcagtcgtttttcttttttttaaactacagtcactgtcacttcatgagggggatatgttttgagaaatgcatcgttaggcattcatcgctgtgcgaacatcatagagtgtacttacacaaacctagatggtgtagcctactacacactgaggctatgtggcatagcccgttgctcttaggctacaaaactgtacagcatgttaccgtaatgcagactgtaggcaactgtaacgtagtgatatttgtatatataaacatagaaaaggcacagtaaaaatataatacataaaggtagaaaatgatacacctgtatagggcatgtaccatggaatggagtttgcaggactggaacctgctccaattgggtcagtgagcggtgagtgaatgtgaaggcttagggtattaccgtaaactactgtagactttctaagcactgcacatttaggttacactaagtttataacaaatacttttctttcttcagtaatgttaaccttagcttaccataacatttttacttcataaacttaattttgtttagctttttgagcctttcataataacacttagcttaaaacacaaacatattttacaaccataacaaactattcttattctgtaagcttttatttatttatttgtttatttatttcctttttagacttttttttaaagctaagacaaacatacacattagcctaggcccacacaagatcaggatcatcaagacatcactaggtaataggaatttttcagcttcattataattttatgggaccactgttaggtataccatccatcattgaccaaaacattgttatgcagcacataactatacatatactactaacttgatttcttttgtaggtaattcttttgtgtaaataacacactctgaaataactgaataagttttcatattcatttttaagaaaaggataataggaagaaagaagataatctgtgagataagagaactcagatttagttccttttgctgttggcgtgcttgccagtgttgaagcagttgcagaatttttgtggctattaatttatctgtaagttggagatacagtatatgtaaatgtcctttgaaaaagggctgtacaaaatgaatgtaattcatattataaatgttgattttgaataattgtggaaaatgctaaaaatttgactcattttctgtgaatatactttgagttataaagattatgattcttaatcttttcattttgataagagtaatgctcagttgctagacaggtaaaaccattaagttatataaattatcaaaataaaagtgactaaacaattgaataattttggaataaattcattattaaggatacaatgatttggagggttgaattattttcagagtacgtcatcttatctaggacggaacataggaaattctaataagtaatagttttttataagcaacttatttaatatattgatacctcttatccgtggtcttgctgattgaataaagtattttactctgtcaattgacttaaaaacttctttttactagtgaactgctcaagcagtttatttttgtgtttattcagctagcattcagttgttaacggtttttttgaatatcattgcttttaagacgtggtgattattttaaaagttttccacaagcattttgaactgtaaaatagaactgatgacttcttcataagaacttacatattatgtagtcacaagtatggccttaatataaatgatacctttttcagcatgtattgaaaaataatttttaaagctgtatatagttactgtgacaatcattgccctttaagtagtggttttgaccctttctgatttacattacgcaagtcttctcatgtattaaagatgatattttaatattgtttaattattattttttttttgagacagagtttcactctcgtcgcccaggctggagtgcaatgacacaatcttggctcactgcagcctctgcctcccgggttcaagtgattctcctgtctcagcctcctgagtagctgagattacaggtgctcgccaccaggcccagctaattttttagaggcggggtttcaccatgttggtcaggctggtctcggactcctgacctcaggtgatccacccgccttggcctcccaaagtgctgggattacaggtgtgagccaccatgctcagcctattgtttaattttttaatacaactattaaatggtcttaaccactgtatggcattatttcggatttagtgatttgtgttacatttgaggatagtatctattaatggctaaataactgaaaatgatattttagataaaaatgattctgttttctgacatatggttcaggttttttagaagatgtattactttagtttatattctgtttatttagcttatattttactgtttttaatctttttcacttttataataactttatgtgttttatataaagatgcctgatatttttcaaaaaagatactaatacttactcttccccaagcacagaaaaagtagtacaatcagccctctagctaaatatttgaaatgtaggtcattcttaatactattgcttttgagatacttttgttcattttacctctattgaatttagtggaaataccatttcatatttagtttggctattctctttaaaaacaccaatacacatatctttactattccctttgaattttataattaagttatttatgttattgatgtgaagatatcaaatttttaagtaaggtgactcagagacatctttgagcatatataattcagaatatggcagaatattttaaacatttcacggggtcacaaaactcttagcgtttaaaggattttagtatagctctctaactggtaagtgctaagaattttaaatatgtttcagttgcttgagattaggaagtagagataaaatttcttattttatttatatatatattttttaaagacacctagctgttgggcagaagagggtgcagaaaagaggtcacatcagcgttctgcgtcatgggggagtgctgatcaactaaaagaggtaagttatttctgttttccgtctgtaacctgttttggtcctagtagattaccttagtatttcctgaatgtaatgacacttttaaaatttatcctaaccttacctctttcagtaaggttaggacaaattctagggtaaggttagaataaattctaggcaggtttttgtaaggttaggacagattctagtttggtaggctgcattctacattttggtgaacaagtctaaatttaccctatttgtgtattttgcgtcttttataaatatttgttatgcactcagtcagctttaacctttccagagtgaagtctaattttatgtaatactctctatcttgttcattttagttatcttttgttctctcttcagcttgcttgtttttaagttgtagcaaccagagctataggttatagctttgtacaatggtaggatagtgttttctgtttctaatagcttttttatttgagacggagtctcgctctgttgcccaggctggaatgcggtggcgcaatcttggcttactgcaagctccacctcccaggttcacgccattctcctgcctcagcctcccgagtagctgggagtacaggcacccaccaccacacctggctaattttttgtatttttagtagatacacggtttcactgtgttagccaggatggtctcaatctcctgacctcgtgatccgcccgccttggcctcccaaagtgctggaattacaggcgtgatctaatagctttttaatgatatccagcatattgttgccctttggaacccaacagtaatccatgcttctcagaaacttagtttctatgacccgtttccttatttattatgaataacctgaggtgtcatatctttatgtatattttggattatttttcctgatacttttatccatctaaattcttttctatttctttttacaaattacagaaactttagaattgaaaggtcatccagccaatctcctaaataaatactccttaaaaagatggtcatctaatctctgttattcttttttttttttttttttttttttttttgaggtggaatctcactctgtcacccaggctggaggacagtggcacagtcttggctcactgcagcttccacctcccaggttcaagcgattctcctgcctcagccacccgagtagctgggattacagatatgtgccaccatgtccagctaatttttgtatttttagtagagatggggttttgccatattggccaggctagtctcgaactcctgaccttaagcgatctgcccacctcggcctcccaaagtgctgagattacaggcatgaaccaccacaccaggccatgatcattcttagtgatggaaactcactactttacaaaaagagccagtttaattggtttaattgtttcaagtttttaaatctgttctcttatgtattgaacttagaattagataacttagttttgactttgccctctggatcaatattgagtaagtctaagtcttttaaaggctagcagtaagtcatttttttcctccagagtaaacatctacatttctctcaaattttttttcatataccagtttccaggcctctttgtataatttttatgtactataggttatcagtgtccctcatatactgtggtgtctggactgcatagatatagtttattagcatgattttacttatgattgtattacattttagcagcttctttatagtatggatgtagagacctactcagctccttctgcctaccatacatgtatgcaaaaaaaatcagttttctccagcaacaacaaaaaataaatgaagctaagtctaatatctctggcttactataactacatgtctatgtatagcatatgaataacaaaaaagtgaacttgtatttttatctcagagttgaatacagtcttagagttatcaacgagatttaggctgaaaggaagtaacgccagatattaatttgaatccgtaggaagaattgaagagtgctgggaatagtaaatatgtggataaatatgaaagagtttttaatactgttgtgttggatttataatttaactataactggatttcagtaatatatgacatacactcttaaaaaggaatgactgattcagtgagaacatttgattgttttccacagaaggcaaccattaaagctggacaaaactgtcaaaacaactgtttgagtactttaccaaacaaactgagaagctttattcatgaaaactaatgaacatagggtaagaatagcacaaattcgtgatctggtgctactccttttctccttttccttgtccctagctctgtcgcatagcatttcagtcaggatgaaaaccagcagctttgcttccacttttgcagagaaatcacttgctatggagaattgtaggttaaaatagtgatctttgtggcaagtaaacagagagggccaacagctttattagtctaagactgtagtccaatttggggccagcag

SEQ ID NO: 36 - DNA, 1315 bp, Homo sapiens
aaagacatataaacgtgtatgcctaaaactctgaaatactatcacaatgtgacttggtgcttaaacaagtggagttctaaatcatttgcagggcaataaagaaaacattgctcctggataggacagtcatcaaagacgtcttggtcaatctcatttaagtgccatagttgggtgaagatctcagtgcagaagggagaaaaaaacagaactttaccttcccttgctgtaggtgagctttgggcatgctgatttagcattctcctctgcttctttcatacttctttctgagaacatgcctttaacttttgaatctctctcctgccttaataataacaatagttggagtggaatggctgagattgtagctgaccaactgacaaaatggagcaggtgagggtcatgctagccttccacccatggacagtatcttagatgaaaatactccactttggaattgcaaattgacctgcatggtctctgccctggttgccctttttagagtggaaatatttaacttgtttttccaatatctgcaaatggttctaactcactaaaccactaccatcctggttaatagctattgcatgcagttggttttcttaaccagaatactttttttttttccatttcagcattccagaacttaaccaaaagtattttcaatatgattacatggacttcttcccaatatgcttctcaaaagaatttgctgttaataaaaggtcactatgtatatcataggtaagcatgctgtttttggatgcagctatgctagtgttcactgctagttgaataatctgccagtggacacacgcttcactgacattgaatgttaaggattctcagtaatctaaacgtcaaacccgccaatattagtaacttgaagaatggatcaagacagcttatttgttgttatttcacatttataaaacgtcttaacattactatcttatacttaaatacagtttgtaaattgataacaaaatgagttaaaaattactgggaaagtccttttaagtaccaaaatgaaataaatattcttccatgcttaaatttttatgaggaatttttatttccagcaactgtaaggctgggcagcaatgtttgaagaagtttcaataaatgtaaattgaataatttttttttttggttttatagattgtcaggtgatcaaccaagtgagaagcttttataaatgtgttggttcttctctgagacatgagtgtttgggagaaagtcctcccttaccccctgccaagaatcctggtaaaacagaaaatgaaaaaaaaaaagtgttgttttagaatttcattta

SEQ ID NO: 37 - DNA, 5185 bp, Homo sapiens
ccaactctcactcctaatgagaactatttctcatacctaaaagcaagttttactgcctctatggtgaaaatagtctagtttaataatgttttctcttgggacaatgatgctttgtaaatggaaataacacagattctgtactttgccccatcttgtttttctttctttctttctttctttttaggcagtgagacagactttattcagggggactacagcaatgaggttttgcggcagggaaagaggttgcagcttttgggtttgcttcatgccttggacacacagtaacttggaattcttgcacttacaattttttgaattatgaaagtaatacatgttagtggctaaacaagaaaggaaggcacggccgggcgcggtggctcacgcctgtcatcccagcactttgggaggccgaggcgggcggatcacgaggtcaggagattgagaccacggcgaaaccccgtctctactaaaaatacaaaaaaattaggtgggcgtggtggcgggcgcctgcaatcccagctactctggaggctgaggcaggagaatcgcgtgaacccaggaggcggagcttgcagtgagccgagatggccccactgcacaccagcctgggcgacagagcaagactccgtctcaaaaaaaaaaaaaaaaaaaaaaaaaaaaagaaaagaaaagaaaagaaagaaaagaaaagaaaagaaaagaaaagaaaagaaaagaaaggaaagcacgaaggaaaatagcaaagggtcccggtgttgcacacacacaaagcagcagcagccgctggaggtcttccgtgtttggtaaaggtggctacggactcccgcatggagacgcggcctggagggtgtcactgctctaggctgtctgcagggcctctccgcagacctggacggatttcagtgggagactagagcgtcacttaagatgtttgaatgtaaaagcatcctgaatgatcatcttttagcttgagattttggctacctttcaaacagacatagtttgacctttgcagtcctaggtaatgcaggaatggcaaatgctcctgaaggcggggaggcggcccggcccgcactgagcttctcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctgggggacagtttggggggaagcagcagctgcctcagtttacagtggcagccggaggaggacctgggcagtggcgagtgtggctgtttgcatggcggggagaaagaggtggtccctcctgcctgctgctgatgcccacggcctcctgtccccaggaaaggggtctgcgcccctcccccaccggaacagcgacagaagaggcgaccctctcaaaggcccttctgctgctcaccgcggggtgagtgatggtgtggagcaggatctgggtccaaggtcttcttccacgttcagggttcccgtggtaactgaagaattatccatccagagaggcaggggagggcctgggacagggatatatcttattattgataagtacaattttaaattttaaattatcagcaggaccgtaggagatgacataaagaggaaaaataacctgtgtggcgctctcagcataaagcgcccaggttcagggatgcgtgtgcgtcctgctgtctgctcattcgaagagcaaaggaagcagggatgatttagggcctccgaggtgacacggaatcgggaggaatggcgccacgagaaagacgtctttctcattttgtgagcagagagcccatcgttcaggaagagcatctgagccacaaagctaatcacagatcaccgagccagcgccggctcctgatttgtctgtgtggctccaggtggcaggtgctccacggcactcagtaaaaggtgcatatggtgaggggtgcaggcagtggccaaacaagggcttccctggatcctggagtggctccttccagccacagccaaggctgctggagggaagaccaggccgagggcacgtcttgcgtgctctcactcacaagcacacacctgtatttaccatgttatgtacacccacagaatcatctttaagatcttgttaatattaatatataaattgaaggtcggaggcagtggctcaagtctgtaatcccagcagtctgggaggccaaggctggtggatcacttgaggtcaggagttcaagaccagcctggccaacatggtgaaaccctgtctgtactaaaaacacaaaaattagccgggtgcactggcacatgcctgtaatcccagcttctcaggaggctgaggcaggagaatcgcttgaacctgggagtggaggttgcagtgagccaagattgcaccactgcactctagcctgagtgacagagcgagactccatctcaaaaaaaaattaatatataaattaatatgagtaacatatacacatacattaataaaaatatacaaaataatacatatagtatataataatatatgctaagtataggaaatatgaataatataaataaaaagattatgaattatgcattaaatattaaataatattaatatgaatataaatatttattatatctatctatctgtatgtacctatatagacacagacagatatctatctctatagctagatatttctatctctgtacacactcatctatatccacatgcatgtatatgtaaaaagagagagagagcagagacatagagagatttatttcaaaggattatcccgtgctattgtagaggttggcaactccaaaactcacagggcaggcaggaggctggtcattcccacaggaactgctgttgcagtctacagcctgaagggagaattccttccttcttgtgggaactcagtcttttccttttaagaccttcacctgattgggtgaggcccacctgccttcctctgactggatgaggcccacccacattgtcagagggacatctgtttcactcaaagcctactgatctaaaatgactttgattaaatgaccttcacagcaacattcagactggcgtttggccaaacagcctggcactgtggcccaacctaggtgacgtgaagctcatgacctccctgtgcctgcagggcgctgtggcactccatccctcttctgtgtcaaagagctgtctgaactgctccagcaactctgacacatggggacgtcctgtcctgaagggatgggggcatgctaggactggtttgcgaatctctccataaatggccttgctgtctccagcatgagagaaggttggagcgtaaagagcagatttctgcggtgtcccttgtgcttcctgaaaggagtcccacactcaagctcacccccacggtggatgtgctggaccaggaccctggggtgctcggggcccgagggtgccaggattagaacctccacacccagaggttcctgcctggggcctgcatcacccgtggcgtctcctgcctgccccggattcctcctctttcttccctttgccgttttttctggctcctttagctgcaggtccacagctggcttttctccagctctcctgcatactggctgagaagggcacctatgtcattgttgctggctgtttgcgctgctgtaatgcaatccctgagactgggggatgtatacaggacaacactgatttctcatagtcgtggaggctgggaagtccaagatcgaggcactggtaggttcgtgtctggtgagggccccagtctgcttcatagctggtgcccttggctgtgaccttcagaggaggtgaacgctgtgtcctcaagtgggaggcagcagaagggcacatccagcagtgaggctgttgctataacaaatacctacaactgtggaagcagctttggaactgggtaatgtagaggctggaggatttggaaggtgcatgctagaagcagcctagattctcatgaccacagagaatcaccactaagggtgattctggcaggtcctcggaagagggtgctgcggaaaagcccagttctcctcacacttaaatggttgtgaacagaaagttagtagaaatatggagagtgaagactattctgatggggtcttagaagtgaggatttttttttctttgagacagggtctggctctgtcacccaggctggagtgcagtggcgagatctcagctcactgcagcctcagcctcctgggctcaaatgattctttcacctcagcctcctaaatagctgggactgcaggctgccctaccccgccctgccacctcacatggcagctgttctttattcataatccccactgtctgtctctgcttctcttctccctttctcttctctctctgtcttttggggtttcgtcatgttgcccacactggtctgaaatcctgggctcaagtgatcctcccacctcagcctcccaaagtcctgggattacaggcgtgagccaccccacccagccagaagtgaggaatatcttactggacgctagaggaaagaccgaccttgttgcaaaatggcaaagatcttggctgaattatgtccatgttcaagtgctctgtgtaaggagaagtttaggagccagaagctgggacattgctaatgctgcatggagcctttttcagaggagtcttaatcccattcgcatgagaggaggccttcctcaccgcctactcccctcccaaaggcccggcctgttacatttcattgcaggaatttcggatgggatgcattcacaccaaagcgtcaccctcctgagtacctctctgaagccaccttggagcctgggctcccccaggcatgggacagcacaccccgtccactggagccgaccctgatgaatgcaggctcactggctttgccaccgcatgcccccggaggcatcagacgctgcttgtctctgctgcctttgaaaggtgtgcgtggagtcgcaggcctgaactacatgagatcgagacggaaaccccgccaggcaccaactaacggatgcccaggctggagtgaccctcctcctcaccctggcagcagagacccacgttggccatcgagaaagaaccgacgcctagcgagaagtgacagggaacattcaggatcccccgcctgcccccgtctggacc

SEQ ID NO: 38 - DNA, 5357 bp, Homo sapiens
cgttagagtgggagacttagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaacaacaacaaaaactgctaaccatctttttcttggggttgcactactgtccaatgagcacatagtgagggcagtactgctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttcttagaaaggtacaaatgattatgattttgtataacaactgaagttaggtgtgtgtgaagttttataattgctggtcttcattagataaattaaattataattaaatgatctgttttatttttgctttttatttggtctcttattaataggcacaatactggcattagctataacacaaaccaatggcactaaaaatcttcagaacctttttggatttgagtttttgaaagatattttgtggagactacagatttaattttaaagtataaatatgctcttattttaaataaatggggtttatactttgtgttctaatgattgagataacttttttttttgagaacttaaattaaaattcccagtcttctctagttctgtcagatttctttgttccccctcccagtggttgagttcttatgggatttgtggcttatttttaaaatccaatgattaaaatgaagttttctggcaatattaatatttgtgtgaatctggatatcctcctcacttaacttctaaggctttttcttcatctgaaaatgacaattttgtatacttggctggattattttaagtaacaagtaacaaacactgtggtagactaacatttgagtttgaagtttcatataattttaaatcattgtcatcgactgactttggaaagtaacttctgagatttttggtctgaagtgaccctgaaagtttatgacctaattatcattttattaggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctatgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtgatccacctgcctcagcctcccaaagtgctgggattacagacatgagccactgcgcccaacctagtttaaattttctagtagccacatttaaaaaaaaacaggtggaattaatttcatgaatatgtttcatataacccaatatatatccaaacatagtttctttttttttttctgagacagggtcttgccctgtcacccaggctggagtgcagtgagtggtgcacgattatggctcactgcagcttcgaactcctgggcttaagcgatcctccagccttagctttccaagtagctgggactacaagcacgtgccaccacaccctgctaatgtttaaatttttttgtagagacgggggtagggtgggtctcactatgttacccacactggtctcgaactcctggcctcaagtgaacctcctgcctcagcctcccaaagtgctgagattataagtgtgagccaccatcctggcctaaatatctttcagcatataatcagtataaaaattataaagatagtatatattcttttctattacatcttcaaaatctgctgtgtgttttacacttaacatatctcggttcacaccagcaacatttcagtgaagtactcaataaccatacttggggctgggcgtggtgacacatacatgcctgaatcccagcactttgggaggctgaggtgggaggattgcttgagcccaggagtttgagaccaggctaggcaacaaaccaagatgctgtctccaccaaaaaaaaaacaaaacaaaaattatccaggcacagtggcatgtgcctgtagtcccagctacctcggaggctgaggtgggaggattgcttgagcccaggagtttgagaccaggctaggcaacaaaccaagatgctgtctccaccaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaattatccaggcacagcggcatgtgcctgtagtcccagctacctgggaggctgaggtgggaggattgcttgagcccaggagtttgagaccaggctaggcaacaaaccaagatgctgtctccaccaaaaaaaaaaaaaaaaaaaaaaaaaaattatccaggcacagcggcatgtgcctgtagtcccagctactggggaggctgaggtgggaggattgcttgagcccaggagtttgagaccaggctaggcaacaaaccaagatgctgtctccaccaaaaaaaaaaaaaagtatccaggcacagtggcatgtgcctgtagtcccagctacctgggaggctgaggtgggaggattgcttgagcccaggagttttgagaccacagtgagccatgattgtgcccctgtgctccaacctgggtatcagagcaagactcccatctctaaagaaattgtattttatttattttatttttacaacccagatgtgtgaatcttgaaggaatttttttttaattggctaatggctactattactggacagctcaatttctgaatgccaagtacctcttgttaaactgttcaacagcctttccctaccatctcaagaagttggtgataaaaattatcaataatgaattacagttttttaatttttgcctttgatgtgattgtcttattttataatatgttagcatttaatatgaatatttttgttgacatttattttttatttttaaaaatagcattattgaagtatagttgacataataaaatgtacatatttaaaaggtacaaatttaataagttgtccacatccatgaaaccatcaccacagtcaagatatttattactattttcctgaagtcttccctcctagctgtgcaaatctcctgtcactacattaaaacttttagatattcttcttttttggagataacctctcttaaacttctaaacttcaccatttgtactggttgcattctaggttgatgcttaggttggggatcttcattcattctcattttggagattcttcttatatctagctggtttttgatcctgcttccagaatcccatttctttctctttcttggtctcctcatttgtgaaagaataacttcataactctttgagaaaggtcatttgggagataaatgtatttttgagaacttacatgtctgaaaatattttccttcatcttcctttccctttcctctttaataggtagttcggataacaaattctagattggaaataatttatttcagaattttaaagacatttattctattttcttctagcttccagtattgctgttaaagtctgaggctagtaggattctctgttccctgtaacctattgtttttttcctctggaagttttcaggttttttgtcttgtcctcagcgttttgaaatttcagcaatgtgccttggtatgggtctcttttttccattgtggctttttgtctggaaactcactggccatcaattctgaaaatttaccttctactcatttcatttcttgccctctgttttttatgttgccccttccagaactcctgttacatatatgttggttctcctagaccaatggtctaacgtccatatcattttctcccccccccccaccccctcgaagtggagtcttgctctgtcacccagagctggagtgcaatggtgtgatcttggctcactgcagcctccacctcccaggttcaagcagttctgcctcagcctcccgagtagctgggattacaggcacccgccaccacgcccagctaattttttgtatttttagtagagacggggtttcaccgtgttcgccagggtgatctggatctcctgacctcgtgatccacccgcctcagcctcccaaagtgctgggattacaagcgtgagccaccacatgaccctgccttttccaggttcctttttttggttgttgttatttgttactgattttagttgctctttaattttatttatttatttttttgcttcccatgtagattggatgctctttaaagacttttttcaagtaatcccatgagccttggttgtcgcatttgagttgggcactgaaaactgataaataaatgcggtttgctgattgtgggccccagtataatctgactgtactgttctggcatcttatgaaatgcagatgttgggatctttagagctgttcatttatgctactcagatccctagttttatatgccaaagtataacttatgctttatgtgatttccactttagagattttattaaaactttttatttatagtctaat

SEQ ID NO: 39 - DNA, 1598 bp, Homo sapiens
gcaaatgagaaactagaaaagatacaggcagtaagtataaggcaaagactaacattcagcagaaaaaaataatttaaaaaaatttaaaatattgtatgtaaatgggtaagacataagaaaatactcagacttattagtaatcaagtaagtgcaaattttaaaaaacaaaatcctggctgggcatggtggttcatgtctataatcttagcactttggaaggccaagaggcaggaggagtgcttgaggcctggagttcaagacgagcctgggcaccatagtgagaccctgtctatttaaaaacaaaaaagttagccaggcgtgatggtgtatgcctatagtcccagctactctggaggtgagacaggagggactacttgagcccagatggaagaggctacagtgagctgtgatagtgccactgcactccagcctgggcaacaggctgtctcaaaaaataaaataaaataattttatttactatcaaattggcaaccattaaaaaaaaaatactcagtgtgggccgagttgaggaaacaggcctatttagacttaagtgcaaaagccctaaaagtacatatactgaacagccctgcttttagaaaaacattctaaacaagcaagtattgctcacagatttaactacaatgtggtgtttaggagcaagaattacaatctaattgaccaatacaacatactagattgaaaaattatggtctatatcatggagtatcaggtagccattaaaaatagactggagaagaatatttgtttatctgaaataatgttcatgatgctttgcttagttataaaacagtacataaaatataaaaataggctaggcactgtggctcatgcctgtaatcccagcacttggggaagctgaagtggatggatcacatgaggccaggagtttgagtccagcccggccaacatggtgaaacctcatctctactaaaaatacaaaaaaaatcagccaggcgttgtggtgcacacctgtaatcccagctactcaagaggctgaggcatgagaatcccttgaaccctgaaaactaaggttgcagtgagccaagattgtgccactccaacctgggtgacagagggagactgtgtctcaaaaataaataaattaaataaaaatactatttctgaaaagaaaaatggtttacatatatttgcaaaaaaaatgatagaaaggtgtacacccaaatattaacagtggaattactgatgaattttctatattgaatgcgtatttgttggcaaccgaggaaaaatcccagataacgattaaatttataaagaaaactgcaggttgaaagataatcaaacttaaaatttagaactcatttgattagaaaaagcatctcctatttgtaatttttcaaatataattttagtagtttaagcctcaataaaatttttagattttaagttctataaatttccttcaaaatatgtagaattgcatattaaatcatcttataacaaacaattgaacaaaattcttacttgaaaaatgcaataagaagattaaccataatgatatactgtacaaagaggtagactgcttgaagaaatggagtcaaccacgtcccagg

SEQ ID NO: 40 - DNA, 45246 bp, Homo sapiens
atatctaggaagcagtaactgaacatctgctggttgattttctttcagaatctccatgtttgacttggctagggaaacattttctttctgaagttgaaggatgcagaaggttgcccaggttgaaattagactctgggtggtaaaactgccttgagctcacctggagagttgtagggcatccacctgctcagttgtgttgggggcttgttcttattctttcaaagccaatctggaaaataaaagcctctatgagattccatgtcatgtgggctaatctgaccaaagggacttagagcagccatgaaggccaaggaattcctgaatgttctctggtcagatttccttgtaactcacaaggggtctgtaaggaaaacagattgtctaactaattgctgatcttgtctcctcggggttccttcccaattcccagtcacttcatgacaaagctgcaatatatttgcctcttctccaaacctatacagaaagcttttaagaaacaaaggaaagagcatgaaacttgggattgcacaaatatgggactttaggtccaggctgcccctgaatgaagctgattaaattccttaacttctcatagacttgcttcttaatcagtgtagtgtgtatcattataataatgtacatttactgtttgaatttatgagtagacctagctagcattaagcaaaaagttacttatctcttggaatctcaccttgaccacctgtaaaacagagatgtaaatagcctcaccttctagagtcatagtgaggagtaaaggggacataagcacttttcacagtgcttgcgtgtaagaggtacttagtaggtaattgttgaatgaatgactgactaggaggacaaggttccttttcagtaccttggcttctgttcttgttgattgaaattcactgagaagaaactcatctccattgcctccagattctaagttctcctaccaccctgtacttgcccttacagcactcatcacaactttgcctaaataattatgtatttaaatcctgactctctctcaagagtggaaatgccatgtctgaggccatatctgtgctgttcacccaccatgtagctcaatgtttattagtatactgttatcactaaaaatgtttgttggatgaataaataacaaatggctaccggttaggtagcggtacctcttttatttctacttttgagatgttttgtgactgtctttgcagatccacttggtcttcatatggtttttacacttgcttactataggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaaggtatgggcaaaactggtgttctctccttgttcatattcctacctgctgagtgtcgtgtgtcaatctggtgccgtaaacaatgttggggtaactttagatgcagaggtaagcaagacataggccttgcccttcaggagctcacagtctactggcagagactgataaacagctaatatatggtaagagctgggatcaaagtaactatagctggagctggggaaagagctaaccggagggggctcagggaagacaggacagcttgaggtgtgaccacatgtggaagaattcactgatcaccttattaacatttaccacgcctttaatgtgtgccaaaggctgtgtaaaatgtgttaacttgcactgtgtagttgcatcttcacatgaccctataaaggtaatactgtcactacccctattttattgagggagaaatgtaggcacagaaaagttaggtaacttactcaagttcacacagtaagtagcagaggcaggactagaacaaagcagtctgactccagaggtgcgctcttttttttttttttttttaattaaaaaaagttcaatgggtttttggggaacaggtggtgtttggttacgtaagttctttagtggtgatttctgagattttggtgcactcatcacccaagcagtgtacactgtacccaatgtgtagtcttttattcctcaccaccccccagcgctttcctccgagttcccaaagtccaattgtatcattcctatacctttgcctccgaggtgcactcttaaccattggactctgctgccttccaagtggacaaatgaggatgagaggaactgcattttgggcagagggaatagcatatgcaaaggcatggtggcacgaaaacatggtgtgttctgataaagcaaaggagtcagattagagtgtctcccatatatgccaggcatatgttcaccctgagtggccttggattggatgcagcctgctggcttgggaaggaaagcaatgcttcacaattcttgtttgtttttaaagtttcacttgactgtttgattttatgtcttggtgatcagtaatgacagaggtccttttgtctttttttccatggggaaaaataaagtcctggattccttcttttccctgttcctagtttagttccttaaatattcatgaggtgcttggtaatttgcagatggacaattcaccattctgtccctattgatcagtctgtttaaactttaatgaattctgggctgctgttagtgcccccggagaagaaggcagagagaggagggagtgggtaggcagtaccagagcattatacaggaataaaagagggatgcatcttctcttttgcccatttaattttcctctcctctcccctcctttcagcccccaatctggtaagaatcttctactctttgcacttgggccttctttcttcttttaacatacagccttgcttgccgttaaggaaattatcaagaagaaaatataatcccctgatgaaaagctactttaaaaaaggtctactctaagtacagctggtttaatggtagatttttaatcatctcccagtggtggccaacttatcatctgtttgagccctgttagctgcataagtaccatggacatctgtcgatagcaatgctattgcactatagcaaacctaaatgaagcccttgggtcttaggcgattctcctcagatggagtatggatatgtgggcatgtgccagaagccacaggataagcatgttacatctatatggaacatcattgctggtgtgaggcttagggagggaagcatttttatgttagagagataataacaccataggaatgagagaggtaggtgacctgttatagagcacagattctgcagccagactgcctagattgacatcccacttacaacgtttattaggttgtgatcttggacaagttacctaatgtttcttgcttcagtttccttatctgtaaaatggaaatgacattagtacctacttccataggattgttgtgaggattaaatgaattaatgcacataggatgtcataacattgcctagaaatgtgtatgggttgtttcctatggtggtgctgatggtgacagaaaatgagcagattatagaagatagtgaatttctaagacaaaatactgaaaagtcaaagtctacggcgggggaggcgcttcttgggaatattcattcactctcctggttagggttcttactgtgtaacactttgagaaacactggtctagggcaaagggtggcatcagatatgtcctggtctgtcttttcttcctcatggactccaggaagttgagagcttcagagcagttgttctaattccttttccctaagtcattcacattgcctgagatgactttcctcttagttaaagcaacagtaaggataatgtggtgtcaatgatgatgacaaagacagctaacagttcttgggcacactggtccaggtactatactgaagagcttttacccatcacttcattttatccttataataactacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaataactactttttaaggtagttttgattgttctctctgttttgaagatagaaaaacaatgagctttgaagaggttcagtaagcagcctaaggtctcctgaataagaagaaggggacgctgtccctgccactgctactgctctcatgctctgtcccttgtctctctccagccatatctccctccacatgaccctacctggaactgataagaagtagcctgaaatttttagattttctacacatggggcatcatgaggttacccaggattacgagtgcctttacctggttgcctgctcatctgggaagtgtgtgccccctcagcaggggttatatctagtttatctgtatttctctagaattctttgcttgtagtgtgttcaattaatgtttgttgagtacataaatgaatgatatatctctgttgtttacattgtctggaatactcttctcttaacttcctcacctgcccaactcccaccttataaagtaagcttaggcggggcgtgttggctcacgcctgtaatcccagcactttgggaggccaaggcgggcggatcacgaggtcaggagattgagaccatcctggttaacatggtgaaaccctgtctctactaaaaatacaaaaaaaaaattaaccaggtgtggtggcgggcgcctgtagtcccagctacttgggaggctgaggcaggagaatggcgtgaacctgggaggcggagcttgcagtgagccgagattgcgccattgcactccagcctgggagacagagtgggactccgtgtccaacaacagcaacaacaacaacaacaacaaaaacagtaagcttaaacattcctgtctcctgagtgtcttccttggtgacttctgacagtctatgcccttttttaccaacctcagcagaaagagagggtgagaagcccctctctactgtccagagcccaccatcttcacccagatcactttctactccttatctttgcattttacttgttggcttgtttacccccttttaaactatgagctgagctcttagagagattcatctttatgtctccagtatctaacacattgcctggcacaaattaggtgctcaattaatggctgttgaatgaatgttacttagagctaaaaacaaagagacaaaatccaatctagcattccttatcttgtttcagtgtcactgtggggcaggaaggacaactattcttcctatttgaaatatgaggaaattgaggctctggaactaacaagtattggagacaagaccagaaccctggtgagatggctccaaatcttcctctctgtcttcctccctacattccctaaatttggcaggttttattgggctggtaagccgcacacctaagaggttttatggaaactcacaagtcatagaggttatatgcagtccacgattttaaaggttcctttatggagccacaaatcttaatcattccaaaaaggtgagaacatttcaaattagtgcatgattcatactaaacttctcttaggaagaaggagaagataagctggaggaatcatttagccaacaggtgtttgttgagtatcattctttcatttagtctgcaaacatttattgagcacttaactatgtgctatgctctttgctaagcattggagcatatagaggagacgtatacaagaagtctgctgcttttaaagatgaaacagcttaattgtatgagaaaaataaacaacacatatgaagccagtaaagtaccattttgttctgtcttggtgctatctatatgagtagtggttgtggggagggggacagaagaaagagtagccacatgtcgggttgagcaataatgttaaccttatattcatagaaccattatagtttacagtgcatcttcattttcatttgattgctattgcagggtgaagtagggaagaagttgttattcccatttacatttgaaaaactgagggccagagagttaagtgattttcctaaggtcacccaggtggtatgtgataaggcagaactcagatgggtcaaacctatgcattctctctatctctagcaccatatacctttatattttgcatggaatattattccaagaacctaactgatgtcttgatattcatttttcttttctctattcttgcatttgaagtgttttttttttcctctagtgctaactgatcatgtcactcttttgctacagcccttcaacatctatcactctactacaggcataatgataaattcagttccagaacaccataatgaggtgaatattgcaacaaagctcacatgaatttttgagtttctcagtgcatatgaaagttatgtttacattatattgcagtctattaaatgtgtaatagcattagtctaaaaaaagtatataacttaatttttaaaaattgccaaaaaatgtgttaatgatcatcgaagcctgcagtgagttgtagtctttttcctggtggagggttttaccttgatgttgatagctgcttactaattagggtggtggttgctgaaggttaggtggctgtggtaatttttttaagtaaggcaattttttaagtaaggtttgctgcactgattgactctttctttcacaaaagatttctctgtagcatgcaatgttgtttgatagcatcttatccatggcaggacttctttcaaaactggagttagttctttcagaccttagccttatcagttaagtttatgtactattctaaattgtttgttgtcatttcaacattgttcatatcatctttatcagaagtagattccatctcaagaaatcatttcctttgttcatccataagaagcagcccctcatcggttcatattctatcatgagattacagcaattcaatttcatcttcagggtccacttctaattctagttcgtttggtatttccactacctctgcagtaacttcctccacttaagtcttgagccactcaaagtcattcatgagggttggaattaacctcttccaaattcctgttaatgttgatattttgacctcccatgaatcatgaatgttcttaatggcatctagagtggtaaatcctttccagaatgttttcaatttactttatctagatcaattagaggaatcactatctatggcagctatatccttacaaaatgtaattcttaaataataatacttgaaagctgaaatttctctttgatccatgggctgcagaatggatgttgtgttagcaggtatgagaacaacattcatctccttgtacatcttcatcagaactctttggtgactcggtgcattgtcaatgaggagtaacactttgaaaggaatctcttttctttgagcagtaagtctcaacagcagggttaaaatattcagtaaaccatgctgtaaatagatgtgctgtcatccaggctttgttgttccatttctagagcacaggcagagtagatttagcataattcttaagggccctaggatttttggaatagtaaatgagcattggcttcaacttaagtcaccagctgcatttgcccctaacaagagagccagcttgtcctttgaagctttgaggccaggcattggctttttgtctctagctgtgaaagtcctagatggtatcttcttccaatataaggctgttttgcctaccttaaaaatatgttgtttagtgtagacaccttcattgattgtcttacccaaatcatctgtataacttgctggagtttctacatcagcacttgctgcttcaccttgtgtttttatattatggaaatggcttgtttacttaaacctcctgaaccaacttctggtagcttcaaacttttcattctgtagcttcctcacctgtctcagcctttacagaattgaagagttaggactgtgctctggattaagctttgacttaaagaatgttgtggctggtttgatcttctatctagaccactcaaattttctccatatcagcaataagactgtttcactttcttattcaggtgttcactggagtagcgcttttagttttccttacgaactttcttttgcattcacagcttgactatttggtgcaagaggcctatctttttgccagtcttggctttccctatgcctacttgactaagcttaatcatttctagctttacatttaaagtgagagactatgactccttctttcacttgaacatttggagaccattgtagggttattaattggcctaatttcaaagttgtgtctcgggggtagggatccctaaggagagggagagagatgaggaatagctagtctgtggagcagtgagaacacacaccacatttatctattaagtttgcccgtcttatatgggtgcagtttgtggtgccccaaaacaaatgcaatagtaacatcaaatattatcatagcagatataatattaatgaaagtttgaaatattattaagaattaccagaatgtgacacagacatgaggtgacatgagctattggaaaaatgacactgatagacttgctctttgcagagctgctacacaccttcaatttgtaaaaaacacaatctgcaagatgcggtaaagcaaagcacaatgataccagatatgcctgaggcatacctcaaactgcggttttagttccagaccactgccacaaagcaaatatctcaataaagcaagtcacatgaattttttgattccccagcatacataaatgttttgtttgtgctgtaccgtagtctattaagtgtgcaatagcactgtatctaaaaaaaaggtaccttaattaaaaaatactttattgctaaaaatgctaatgaagtgagcacatgctgttggaaaaatggcagcaatggacttgcttactgcagggttgccacagacgttcaatttgtaaaaaatgtaatatctgcaaagtgcaataaagtgaagcacgataaaatgaggtatgcctgtatttgggtagaactcaatccttaacatggccttcagggccctacatggcctgtctcgacttgcattcctggctcatctcatgatgcttctcctggctctctgcattccagccacaccttccttctgtcatgtcctcaaacatgcaatgctccctttagcgtaagaattgttacccagattctttcttctggctgcatatccttcctaccttccaccagcatatctaactcctgttcatccttagacctaagctatccaatccaatagttgctgaacccacaatgccatttaaatttatagtaattacaattaaatataattaaacattcacttcctcttttgctccagccaaatttcaagtgctcaatagccacatggtggctattatactgaacagcacagatatagcacattttcattattgtagaaagttccattggatagtgctgccccaaaccttaattcaaaagttagttcttcaaggaaggagcattttctctaccaataccacctccaactaagtcttatttcacttattaaatgttttcacagtgccttgtacgtctctttcatagaactccatgtggttcgtgaatcattcattttttgttatcaaataataaaatcattctataaatcaagaataaaataccataaaatgaaacaaaataataagatatttcactttttggattaatgtatgtcttccctactagattttatgtttcaggagggcaggagctatgttttgcttacccagagcctgggttatattagacccaggaagtgtaaaaaaaatgaagggtcaaaagaaattgagagcactttgggaggcccaggtgggcagatcatgaggtcaggagtttgagacccgcctggtcaacatggcaaaaccttgtttttactaaaaatacaaaaattagctgggcgtggtggtgtgcgcctgtaatcccaactactgaggaggctgaggcaggagaatcacttgaacccgggaggcggaggttgcaataagccgagatcgcagcactgccctccagcctgggcgacaaagcaagactccatctcaaaaaaaaaaaaaagaaaagaaaagaaatggagacctccctacttctacccactggagaaaacttgagaaaggatgtagggcaaaaagtgactcttgaactcttaagagaagacaattggaactggaggaatagaatggtcagaagcgctgagatgggaacatcaaggatcgaatcctagctgtaataggtggtttctaataggaagaaggaaagggaggctagaattgacgatacaggggtaggtgagacagctggctcagaccaatggggagctcctctagaatcatcctgagtttgagattgaccagtcttgcaacagattcagaatggctggcagagaagaaactaaatttaaggatgtcaggaggcagacatcctgatgagtttcagaggctgagatttttttttttttaaactataaactttgggaagactgggaccacgtctctcttgaccaggatatgttctctgtgtctggcacatataggtgcttaatatttttaataataaatggctagattagactattggcagaggaataaataggagggctgagactgagaggctttaggaaggcaggcgtaactggacttggcaacaatggagaggaaggaggtagaggctatttgagtttcagttcttggcagaatgttggggtcactgatataaatgagagtatttggcctttatttcatcatcttatcatcaaatggcaataccatacctaagctgggatgctacgtaggtaaaggattaggactgggtttatttacttcactggtcactagagtagcttttacaaaattgactgccttcaagggccttccaggtaatgcacgccccaacacaagctgtatttgtcttcttgctgttccccctcccaggacctctgcgctcgctgttcccctgcctggaacactcttcccccagatttccatgaggtccactcctcatgtctttcaggtgtatcctcaaatttcacttgcatcttgcataggaaccacctcctccttgcattcctaatccccctgagtaatcacttgctagtatactatatctacactatgtaatttatttgatttattgggtattgtctatccctactaaaatgtaatctccaaaagagcaaggattaaaaaaaaaagtttttctctccattgtttttccaatacctagaagagaaaattctgcacagcctgaccctagaaggggcttgattattttcgctaaggacttatggctaagtgagtgattgaactgtgtaaccaacaggtagtgatggagcctgagggaactggtgattgcataactcctcgcacgcccccaaagctgacaaaggcattcaaatcaagatttaaaagaatacagtacctgccactcagaactctactgcaagctggattatgtctatgaagccccaggctttgacccttgctctaaatagagctaaggataaaaccaggtatgcatctgaccctccagttctcagtttggagggtttctaagaaacaccatctccccacccaatatggcagatcttgctgatttaaaacacatgcagaattgaaccatttcccacaataagaagaaagtgatacacaatcccttccccaaatatttgtttgctgccccatagctacgagttgacagttgttagacatggaacaggttaccaaatgaggttgcagaaatctctttctctggaaattctttagaagagcaatgtgctttctctctagctagggaaattctcttgattccaagctgttacaatgagattactgggctgctttcttcttccattaataagaatataaaaaagaattcttaggtcaccaggtcaagccccagaggccttctgggtagtgtgactctgacagtcatctttctgggatggtttagatggtgtggggtgaggggttgggaatggcgatgttcctcagctgtggatgagcatgatcataaggcatttccttgtaaggctggggaaatagtagtggctacctagctagatcaggtttaaatgcatgccacagttactcttccagtttcttgtgagaggtctctgtttgaaagatagagacgctgagtctttgtgactgaaggccatgattgtaatattgagcactctgtaggtctgttgaggggattcataacatacattgaagaaaatattttccttgctcctactaggttactcccgccatgattcttagaaagatttgagtctatccaattttttctattcctactctttttgcttgtcatttttatatgtgcttacgtgacacagagagcaagcatgctgtgctttgtacataaaaacattccatgaacacaataaggcattgagtgcatttcctatcctattttctataaaggtttactggtttcaaagtaatttcagactccactgatcccattcaaagcctttgattcttacttgggaggtatctctcactcaggaaactgaggctcagaaagttgatggagttagtgcaggattacctgacctagaagtggtggagttggcaccagaaggaagttctttggacaccacatcctgtgtttgtttctactcccaaactgccttgtggtatggagtttgagtcatctatattttctcacccaagtcctcttttgactaactgcagacctgtgtgagatgggcttacccaagtcagacatgcactttctgggcacagaagccaattgggccacatagcaagtagaagttagggctgggtgattgattgattggtatcccacatggaaagatttgaagcaactaatttgctctaatataaactgctacttactgtgcactgatgccagatgttgagctcatcacaccttattttgctgaattctcatatcattgggagatgcaggtttaggtaatagttttgtactgccaaggaagctgcttatctgacttcacaaagttatataactcggaaatagtagaaccagatttcagactcaggtcttctgcccccaaagtcgctgatttaactactatccagtgatttccaagccaagttgtaaggacattccaggcagaaatagccatacctgtaaatgctatagaaacatgaaccagcaaagcaagagaggagttgcaatggctagaattgtgtaacttgccttcagccacgtagccatggtggcagagctaggatttgaattcaagtctttgtgactcattgtcatgaggccatactgcctgtcaggaaatgggtttggtcctcacactgtaagtctagatagatcagtgtggtgaaggcatctgggtattcacttggtactgtgggtcaaggtactaccagcagtcacagatgggtcagcagcaagtgttctctagatcacatgtcctttccacaggatgagtctcttgggcaacaggaaattatctgatgacagaggtgagcagtatggtataatggaaagaaaatagacactgagtttgaattctggctctgcaatctactggctgtgtgacaagtgcaagttccttaacctctctgtgcctgctgttcaccctttccctcgccaatcatccacttcttttattttgttttattttttttgagatggagtctcattctgtcgcccaggctggagtacagttgcatggtcttgggtcactgcaacctttgcctcctgggttgaagcagttctcctgcctcagcctccctagtatttgggactacaggcacatggcaccacacctggctagtttttgtattttttagtagagatggggtttcatcgtgttggccaggctggtctcaaactcctgacctcaagtgatcttcccgtcttggcctcccaaagtgttgggattacaggcgtgagccattgcacccggcccccacttgtttttcatgaaaaactaatattaaatgtttcttttggagggctttgtaaggattaaataatatgtatgtcaaacatatggcacatagtagatgttcaatatatggcaatgctttattaatatgacttgaaaaaaattactgcttttcttttttggacatttctcataattatgtgaagctcttgtttgaggaacatgttaaatagtaagaaatggaattctaaattataaatctggtatttccaaacaggaaaaaaataattatatattttaaggtgaatttcactaaatgaggatggacatttttgagttgacttttatgggatttaaaaggttgtagtcatgttttaagttaatagaaactggtcgctcatgctttttctataaaggaaaccatagaaacaaaaataaaaaatagaattaatcgataaatctattattctacaactttaaaaattatacaaacaagtgtaaaatctatatcctcctcctgcagttccaccctcaggagcaaccactattaacaatttgttgcatattcttttttttaaaaccttactaatatatcatggatgtctttccattttatctttcatagctcaactcgttttaaaagtatttaacagcttgatgtatgatttatatatcataaaatccagccattgtaaatgtataatgctgttattttgtaaatttatacagtggtgcaatcatcacctactccagttttagaacacttattactccaaaagtttccttacacctgtttgcagtcaaccccaagccccagtcagaggcgctttctgtctttataggtgttctttttagaaattttatataaatagaatcacatagcgtgctttcttttatatctggctcttttcacttagcataatgtttttaaggatcatccatgttgttacatatatcagtagttcctttttcttgctgagtagtattctgttatatggatatacaatactttatttaacagttggttaaactatgatggatatttggttggttttcagcttgggaatatcaataatgctgctatgaatattcacatacaattctttgtgttgatgtatgtttttattttattttatttggtttgttaatattttgtattgaagttgccgggttgtgtggtaagatgtggctgtattttacatttccatcagcaatgtataagggcatcactttctccacaattctctaacacttggtattgtcagtctttgtgataatattctagtaagtgtgcagtagtatcttattgtgattttaatttgcatttccttagtgactaatgatttgagcactttttcatgtgtacattggccatttgtatattttctttgcagaagtgtccacatcttttgccaatgttatcattgggttgtttttcctcttattatttgagttttaaaatatattttatatgcaagtatattatcagatgtgttgtttgcaaatattttcttccagtctgtagcttgtcttttcgttttctaattgtttcttttgaagaaaaagatttttaaattttgatgaagtcaaaattttttcttttgtgggtcttgcttgctttttataaaatcttcatctaatgcaaggttgcaacaatgttctcctgttttcttctacacattttatatttttagtcttacatttagggatgtgatatgttttgagttaagttttgtgtatggtgtgaggtaagagtctaagttcttttttgcatatagtcatatagttctagcatcactgtcaaatagtctgtcctttcccccattaaattatataggcacatttaccaaagccaattgccataaatgggtttacttcttatatctctgttctattgatttataaatttatccttataccaataccacataaacttaggaatgctagttttatagtaagttttgaagtcagatagcatatattttccaagttctttctattcaattttgtcagtttctacaaataagtagataaataaataaataaaacctgctagttttttttttttttcactttaagttttgggatacatgtgcagaaagtgcaggtttgttacataggtatacatgtgccatggtggtttgttgcacccatcaacccatcatctaggttttaagccccacatgcattaggtatttgtccaatgctctccctccccttgccccgcaccccctgacaggccccagtgtgtgatgttgccctccctgtgtccatgtgttctcattgttcaactcccacttatgagtgagaacatgcggtgttagaaaacctgctaggattttaatggagttgtggagaatctgtaggttaatttgaagagattaccatctgaacaatgttgaattttccattttacgagtgtgacatatttctccaatttttagctcttcatagcaatgtttggtagttgtcagagtataggtcttgaacttcttgtgatatgttaattcctgaatgtatttgtcaggtttctccagagggacaaggccagtaggaaatatatatgtatatgtacatgtatgtatatgtatatattcatatatatatatttatatgtatatagtcatatatatatatatatatatgaaagaaagtttgttagggagaattggatcacatgattaaaaatgtgaagttccacaataggtcatccgtaagctagggaatgccagtagtgtggctcagttcaagtccaaaagccttgaaaccagggaagccgacaatgcagtcctgaataagtctgagggtgaaggcctgagagccccaggcaggctgctagtgcaagacctagagtccaaaggaagatgaacctggagtctgatgtctaagggcaggaggagaaaaggtgcctcactgcaaaagggagagagggaggaaggtaagcaatctgagtatcccccttgttccacctgctttgttctaatcacacccattactgattagatggtgcccactcacatcaagggtggctcttcctctcccagtccactgactccacatgtcaatctcctctggaaacaccctcacagacacacccagaaacagtgcttcactaaccagctaggcatccctcaatccagtccagttgatatctaatattgagcatcacactgagtatttcactttttgatgctattgtgaatgggattattttcttaattttattttttatcttttagttgctattaagtagaaatccagttgatatttatatgttagtcttgcatcctctcatcttactaaaattgcttattagttctagtaatttttttagcttgtagattctttaggattttctgcatatgagatcatgtcatctgcaaagaaagacactttaacttcttttctaatctgtatgcttttaatttacttttctcactttattgcaatggctagaagctcaagtataaggttgaatagaagtggtaaaagtgaacatccttgcttcatttctgatgggggaaagcattcatgttaccattaagtatgatgttagctgtaggtttttgtagatgctccttatcaggttgtagaagttctcttctatgtctggtttattgaatgttatatttggagggtaggggttcttttttctgcatctgttgagatgatcatttggtgtttgtactttgttctgttaatgtgcgtattccattaattaatttatggatattaaaccactcttgcattcctgggatgactccacatagtcatggtatataaaggaaagttttacatgctggaagatttcgtttgttaatattttgttaaggatttttactatgttcatgataaatattagtctgtagtgtccttttcttatgtatttgcttgactttggtatcagggtaatactggctatgtaatatttgttggaaagtgttcccttcttcactgtattttagacaagtttgtgtagcattggtaccatctcttccttaaatgtttgataaaatttcccagtgaagcatttggacctgtagtttttttattttttgtgggaatgttttaagcacaaatttgatttttcaaaaaaaaagtgcttctcaatttttcacatggctttggccaatttccataaccccaaaatggtggtttttgatagttttgtccagtttattagttttattttgctaagaggattttttgacttcacaccgccacacccagcagttgcctctctacctctttttaaaaaaaatctgtatagtatttcattttacaaacatgccataatttatttaataaaaatagttttttcacttttaaaatatagtctgagcagtgctgaagctaaccttcttctatatataactttacttacttttgctaataagatacgtgcatttttaattttaataaatgtcaaattattctccaaagtttgttgtcattaattatattgttagaataatctccaagaaggtccacttctgcatatattgccactaccatatacaggttaagcaaccctactctgaaactaaaatgcaccataattcaaaactttttgagtggcattgtgacgccacacatggatgtctaagatagtaacatttttgttttctgatgattcagtgtacataaactttgtttcatgcacaaaatcattaaaaatattgtataaaattaccttcaggctatgtgtgtaaggtatatatgaaacatatatgaattttgtgtttagacttgggtttcatcctcaagatatctcattatgttatatacaaatattccaaaatctgaaaaattctgaaatctgaaatgcttttgatcacaagcatttcaggtaagtaataacagcctgtagtattaatcttttatatttttgccaatatgaaaagcaaacagtttgatatctttttgtttgtacttatctaattggaggtgggaatcttctcatatgctctttgaccatttctttttattttatgaggtgactttttattcctttgcttaatttccaattatttttaattattattattatttttttttgagatggagtttcgctcttgttgcccaggctggagtacaatggcgtgatctcggctcactgtaacctccgtctcccaggttcaagcaattctcctgcctcagcctcctgagtagctgggattacaggcacacaccaccatgcctggctaattttcgtatttttagtagagacagggtttcactgtgttggccaggctggtcttgaactcctgaccttgtgatctacccacttcggcctcccaaagtgctgggattacaggtgtgagctgccatgcctggccttaatttccagttagtttggttctttttttcttatttataggatcttttgggattatagtgatactaaatttttatctgttttatgttgtaaagatttttttctattctgtcattccttccttctagttgtaactgttttcaatctttaaagaccctggtgttgtaatttatgtttttatttgtttttaaaacagaaagttgtacaagggattgatttaaaccaaattcgaggacttgggtttgatgccacgtgttctctggttgttttggataagcagtttcacccattaccagtcaaccaggaaggtaagaccatgtctcttccttttcccagtggtgggatacttggctgattaatccaatgggcccaggtggaacaggagggcaggcgtctcttgctgctgatagtaaaatttagaggtagagtgaagtgacacagatcatgttgcagaagtcaagagcttggagagcagttggtatgagtggggtggtgttgacgctggattagggggactaggctttctaaaactcaggagccacagtgcagagcttggtaaaggaaggatatgagattgttagctaggagtgattaaccttgaaacacacaggtggttttgatgttttctgagaagagagtgtcagtgcttgcagtttctttgtatacgatattcctattccgtgcttatctgagtggatgagccaagtcctttgaaaggaaatggaacatggtagacagggccatgtgacagatagaaggtagaagcagatggcctctctattttcagtagccagaccaaaagacattcacattaaatggtgttgtcctaatagacacttgtgagtacagaaatgagctgtttgaaatgtaaagtgctacttgggtccaccatcagagatttttcacagcagataaggttgtcccttttggggaattttagccaataacgtttgtactggggttacaaacccgaaagtctattaatatattaatgtaataattaatacattagtcagatgggtaatgtaaatgagtaataggccaggtttgagaaaaaccactgcacctgtgtgaagataaatttcaactgatatttaaccttgtaatgagcagatgacattagggagcagtggaggctgcattgcactggaaattgcatgctccatctgaagggaagggccagctctaggcattgtcagtcagctgttgccaagatagccattgcaaacatatttggggctagattctgttagagaacccttgattctgcacactgttgcagcagcatctttcttaactgttggctatgaggtagtagggtacattgatacacagtggaattagagttaggcggggactctgattgtagctctgctgttgctgagctgtgacaccttgggcaagccacttaactctgtgtttctcagttttcttctctgaaagaatttgaatgaatcagtagctttgctgtgagaatttagtgagagactgatacttaaaatgctcagaaaagtttcttccatcagatgatgaattttttaagttaagagaatattccggtcactactgtggacctaatgtatgaaatagtgattattataattataaggactataaatgatcatctatttgcatcccttttcactataagtgatcactataaataatcataatcactatgtgctgaaaatggatgcaaatagatgaatgattagagcacagtggtaatgatgaccattttctgcacagacacacacacttttttccctcttcttgcgacatttattaacacctcctgtgttccaagccctgtcttagcaaatgctggggcttcaaagataaatcaggacggttctttttcttggtggctgttcattggctcagttggcactgttctggcccaggacagggcagccttgttctgagccatttcagaaagcagagaccaaacctgggtagagcaaacctcagctctgcagcagcaagcattcactaattacaagatgtggccagccacagacctggccgttttgggaggctgtcagtatatcttttatgggctttatttaagtaaaggtcaggtgattgtttgggatgccatagatcagatgtctcttactgttgatagtgagatttagaggcagagtgtggaggctagaaatcaccgtcccagaagttaaaagcctggagagcaattggcacgagtggggtggtgttgggggcagagttagagggaacttggttccataaagcacaagagccatgttagagagcctgattttgggtggaactttagatactaagagtcctgtttcaaggattttgtatcatctgatctgctaaaatacatgtttacttatttatttttattctggctgtgcattagtatcaactggagatctttttaaaaattgccaattcatgagccctaccctcaggatttgtattcacttgacttgaggtggagctagggtgtcaactttttaaaaaagttttctcagtaagtctagtatgtagagaatcactggggacagattaacggagaattaaaatattaggaacagaacacttgaagtggaagaagacagttccttgttaaatttgcttaaatatgtaccctctttggatgctatttttctttcattgtaggtagaatggcttcctgttaacaaatcctctattaaaaaggtaactaggttatcactctaattataagtgttgaaataactttattccacctaaaaggttaaagtgtacccattcatcaaatgcatccagctgcaggtgccctcatcagtttcttgcctttcaacagattgtattaaggttagatcttttatctgaaatgaattatcctgtgcaagaaaatgaaattagaattataaaggtggtttgaaggttctttagagactcctacctgcatggcagcgaccaactcttgattggctaatgggagtaattgtgaggagcagagagtggggtcaggaagattccagataaccctaatcatgcagataacctaaaaccaaacccataagaccagcaaaagtattgccgtctttagatgttaaccaaaaaattataaacgaataaattaagtacaatagtttaagaaaattcagcattagtctatgataaaatagtctcatttgcctttccttgtttgactcttcttccttaaagatcagaacaacccctgggctggacagcagcacagttgctgaatgcttcctacccctgccactgaccaaactcagagccttaccctgattgtgtcatctcagccataggagctcttgggagggagaggaacaaagggtgataattggggctgggagagggagttatgacctagtctcctctgtgcaacagatacctaatgtttagatttttttgctgattcataatattttttcccctcaagtatgcctgcaacacattctgtgaacataaacatgtattttagcaaggtattaattaagtgaatatatggatgaataatctacccttaggtaaagtgaggtagctcaaatgtaactttacctccaattctcttaaacgacaacatttttgtgggtctgtgttctgtttcccatgctgccttattgtatagaacctctttctcactctttcctcacctgcctagccattggctagtcatttgaagaattaaataaacactttcctgccttttgaaagctttctgtgcagctccaggctcagctaactagagcctgctctttgctcctcctccacattcccatgtctggtactcttgttctggcagtcaacacacagtatagactctttctcctgcagacatatgttgcttaagggcagaactgtggcacattcttcttgatatcctagcatccaacactgtgcttggcatgtagtagatgctcaataaaagattaaatgaactttcagttttccataagagctgaaaaaaattaacttctcagtttttatctaaaacgaaaattattaattctaatacagtaatgattctgtacaattttcattgtattgttctgactgcattttgagagcatctttatgtagaggcagtagtagctgattggtctgtctttactataggcagaagtttagcaacaggtatttttaccttaaagtagctgtagatttgttctgtacagtacttaagaaacaatactgatattgtccccttcaacactcacccacccacacatacacccacatcctgattcattgatggttgtggaataggagctggacatcagtatttttaaaagttatcaaggcgacgctaatgtgcaactaggtttgagaactagagctttgagcacttctgttagatagaggaacaattctgtttacaaaaaattctttgacattcctgtggaaggtcccatgtactctgtattattttcaaagtattagtataatggtttgtggagcttttgtgggaggtgatatctttccagttaggcaactgagcccctgccttgttatgcccatgaccttatttaggtatcttcttacattggctttttttgttgtttttttttttggttttaattttaaacattcttttcaaagatgtggaagggtaaagaaagcaacatcttcctattcgcctaccactgaggataaacatgaaattttgccatatttgcctcagctccttttattttaaaaaaagatatttgtaacttcagcttttcacctcctgcaggtaaccattctgctgtagttgctgttcttaaacacattgtttttgtgcttttactacatatgtgtatacccacaacaacaaacagtatacaatccttcctctgtatctgaggggtacttgttccaggacctccttaagaccataacccacagatactcaagtccctgatgtaaaatggcatcgtatttgcgtataacctatgtacgtcttcccatgtacttcagataatctctaggttacttataatacctaatgttaggtaaatacttgttatactatattgtttagggaataatggcaagtaaaaaagtctgtacacattcagtacagatgcaaccatccatttaaaaaaatatattttcaatccacggttggttgaatccacagatgcagaactcacagacatggagggctgactctgtgttttaaagtatctcagctggtgtccttgttcatgttactatgtctaactctagtttattcatttaagaattgatttatctgttctctatgcagatctagttccaaaatacactttgtgcatttcccagctgtgagacattgggtacgtcttcactttcaagagtctgtcattgaaaaacaggggttaaaaacctgtatcagagggttgttttgaggattaaatgtgatgatatgtgtaaaatgtttagcacagggcttgggagacaaacacacattacaaacatttactattagcaagatatgtagtgctgcggttactttgccattaaataaaataatgtgtgaaaatataatacctggtttggtaactgctgggtttcttttctctttgccctaataatctctcgggtatattaattgctgttctgcaacttttgccatcagaggcatcagagggctgttaaaggatttctggcttgcccattggtacaggatgaattaacagaggctggggagagagataaggagttactgtgtggactacagggtggtaaggcaggatatgaggggcagtgctccttttccagctggttttaaattctcctccttatgattttctcctcctgagggcctactttctgagaagtacttgccatatcctttatgtgcattatcttttgtttaaaaacttcctgaattatacatcttcatctgtaactgtatcttcatctgtaactagcattccctgttagatctgcctaattccaaaacccatgagcttcccacgccagcaaacaagccaaccaaatgaggaaaaaaaaaaacacctacataaactaattttaattaaagtgaccagaaaaagtgggaatataagcagttaaatgccattgtttagctattagatgtattataccgtcaaagtatttatccatatttaaaggagacagatcttagaaagtattgtcttagtcttatttcatagacacctttcctgaatgtatgcccagaaaagtttttctagaacagaagggataagaaaggaagggaagaatttgagagagaatacttgataatataattaattggtagatgttttctgcttttaatgtagacatttattctaaggtcatggtcagagaacacatgactggacgggaaattccaggcctggggacagtgctttcctcagccttgctggtgtcctttcattttgcacactcttgatacataaaattatagaaagtacatagcattttgatcttgggaatccataattgttcccttgaattagaaggaagagaatgtgtgtccatctgcatctccctctcgtttctgctaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagaggtgagtgcatagggtctaagagaagataccaacaatagtagaggattcctgttactgtggacctgtaggtaccaggcaccctgctaaaatcggttatgtttgatttttcccagcaactaggaggaaggttgatcccattttattgattacagtgtagttaaatcacacctgtttttatgtgcctaactcatactaggcactgtgacaagtattgtacacattatctctttgaaggccaacgaccctatgaagtgtttgtgtgtggtgtttattttagggtgtctgttttgtagacaagaaaacgaatgttcatagagataaaacaactcactcaaagtgacaaagtaaatatgtgacagaaccagaatttgaacctaagactggctgactccaaaatcatttttttttaattttaaaatgtttcttttgtagagacttggtctcactattttggccaggctgatttcgaactcctggccttatgtgatcctgcaaaagtgatatgattataggtgtgaaccactgtgcccggccatccaaaatcaattctttttttttttttttttttttaagtatcaatttctcttttaatcttagacgtcgtggtggaaggaaaaatcagttagcaaagaagcaatctcagaaaaagtgtatctttttgatgcctttatgccttttttttcctctttttttttcggttattctttattattatactttaagttttagggtacatgtgcacaacgtgcaggttagttacatatgtatacgtgtgccatgttggtgtgctgcacccattaactcgtcatttaacattaggtatatcttctaatgctatccctcccccctccccccaccccacaacaggccccggtgtgtgatgttccccttcctgtgtccatgtgttctcattgttctattcccacctatgagtgagaacatgtggtgtttggttttttgtccttgtgatagtttgctgagaatgatggtttccagcttcatgcatgtccctacaaaggacgtgtgaactcatcattttttatggctgcatattattccatggtgtatatgtgccacattttcttaatccagtctatcattgttggacatttgggttggttccaagtctttgctgttgtgaatagtgccacaataaacatacatgtgcatgtgtctttatagtagcatggtactggtaccaaaacagatatatagaccagtggaacagaacagagccctcagaaataatgccacatatctacaactatctgatctttgacaaacctgagaaaaacaagaaatggggaaaggattccctatttaataaatggtgctgggaaaactggctagccatatggagaaaactgaaactggatcccttccttacaccttatacaaaaattaattcaagatggattaaagacttaaatgttagacctaaaaccataaaaaccctagaagaaaacctaggcagtaccattcaggacataggtatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaacaactgggcaaaggatgtgaacaaaatcaattcttttaatacccagtattctattggagttcagagaggttaattaccgttccaatgagaaagcagccgaggtgggatttaagtccatatcttctgaccagagctttgctgttctgtacacttttagccccaacttattaatatttggccttgttgacatcttaggctttccctttctcatcccacctgcactcgagtttctcatccttaaatgatatggcaatctctggtcaaagcacttgcaggtggctcccatttccagatgttaggacttctttctgaagtgtggagaatggtgatgtcagcttaatggttcccattagagatggatgtgtgagaaagttcaagtcctttgggaatctcaaggacttgaaaacctctaggtggtctggagaagtagagaatccatctaatgagcatgacctgctgtgattcatttactggctctgagatttcaggtgggctgagtcttctattactcagattgtaaatggagatggggagagcttaggttgctgagagggtgcctaaggattgccatcacggggcaggagagtggtaggaaagaagggcttcagcaatcaaagcaggcttggctttttagctattttatatattgagctgttttgtaagttttaatctacataaaggcttctgtggttgctaagagtttgaaaacagagtttcttaggagtcaggagttttcaagaatctaattctgactctactgtcaacaattgtatgctttggtcaaagcacttcttatttcaggcctcactttcttcatgtataaagtgggagagttgtattaaccagtttgaaaacctgactcgggtatatactgaaacacaaaattggaatatagaactgttctgcgctgcccggtaccctgctttgagttgtataagcattagttgattttaatcctaatggtctgtgcctggtagatagcacaggaaactgatcctaaggaggttttcccaaacaggtgatagagccagaatttaaatccatgtctgctgggctccaaatctcagcttattccatcatgtcatgcagtagtaaaatccctctgtgaagcatggctcttggcgtaggaccaggaatgatggcagtggtcttcttcaatttggcctaaacttgttgctatatcaacaagtttggattggatatatcaccttttttggcaacacagaaagaaaagttatactgagttaagcaaagaggattgggcggagggtcattggttcagtgtcagggccttctagagcacttgccatgtggccagctccagcctatatcccaggagatctaaatgcatatctggcacgaacctctcaggattcttaccatctcgcacttgagataaaactgcactaaataaatcccataggaaatagttaaagtctagattacatggcagtgtttgtgaccctctgagaacatcttatattaatttattttaaaaaatcaattttctttcagaattttctgagtaagcctctagtgtggggtgtgttttggtaagcatgtacaggaattcttgctgagaattcctttggctttaacatgattgcaaaatcaaaattaaagagatttctaaagtcagttttagcatcttcttaaagcctgaccaggagggctatagtgcttctcagacttcaatgtgtaaatgaatcacctggagatcttaggttctgattcagtagctttgggatagggactgaaaatttgagattttgtatttctaactcaagttcacgggtgatgctaatattagtggcctgggaacttgtgaaaccacttttaattccaaaagctctgctcccctaccctgaaaagcatccacttttggggaatcagggaatggtacctttgtttttaatgctatgatgggagacacaggaaagtttgatagcttcagtagagctgctcaagtgcccgttcagtataaaagcatgagattctgtgttctaagttcatcaagctgtcatgtgtttactccttcttcattctttaattcttggaagtctgtactgagctcaactatgaaccagcaactgtgataggcactggggaactggggacaataaggactcaaccttaccattgagcagcacacagtccactagggatagtggtaggggagcataaggaatggggtggatgcaggagtgacatgaaaacagagccatcaaatgtactatgcactgtgatatagcaatatacaaagtgctttgggaaaaaggatttgcttcccagaggcaatagtttgacaggagcctcaagatatgagtagaggttttgcctagcagagaagataggaaagacattctgaagagagactgtggttcatctgtgttatggtaggtgagtcccagggcatgagctggggtgcttcagcaagcatagcaggagatgaggccaggtaaatagtctgagttcggcttattaagggcttatttggtgatagggattggttgatggttgttaagcaagggaggggctggcttaggtaactggcagacatgtggagattggattagggtgagaaaatgtgtgtgggggagtaagaactagagttttctcattcccctgatgatagcactctgatggctttgcattgctctgttagataaattccagaaactgaaacatggactagaaaatggtgcatgatgtcatttttacctcttcctctctcgtcactgtttgtcttttacatcctagctcactatatcccatctacaggaatccacttagagttttttgttacatgagtcttggctagaggttggcagactatggcacccaggccaaatctggcctactgcctgttattggatggcttgagaaaatgtaaatggttttacattttcaagtggttaagaaagaatcaaaaggatgatattttgtgacttatgaaaataatatgaaattaaaattttagtggccgtaagtaaagtttgattggaacacagccacactcatccatttatgtgttgtttatgtctgttttcacactacagtgacagctgagtagttgagacagagactatgtcgcctacagggcagaatatatatgtaccatctggaccaacagatgaaaagtttgccgacccctggtcttgacaatgctgagtctttcacctacagtgttcttccctctactcactgctggttcttcctcatcatttaggtttcagttttatttttgctctcttgaaaagcctttcctgatcctcaaatacatcagagtctcttgttattacactcttaattttacttcattatatctttcgtaaattgtaatgctacgtcaatttttgtggtgatttatataatgcttgctccaaccattgtaatctgcaggaggatagagatcatatccacctcgttctttgctatgtcttggtccttaaccaaatggctggtgcacagtaggtgctcagtacatattttctgaataatttgaatgactcaataactcaataaggggctgttacagtactccatgggagaactaatgagacctgaatgaggcactgtgagatggcaggagatgggtcctagaaatttttagaggataatatcaatagaacattgacactgattggctgtgaggagtgagtcagatggaggagccagagctgaccactcacttcgttattgctgtcatttatcttctccttgtccttagcctagagtcagatgtcagaggaagttgggcagaatttggggttttatctgtcttgagatgttctaggaccaccatagctcttgaacaaagtcacctggatcctagtcctgcaaatatggaatttaatcatgtccttttcatttaaagtttatgtgtttcaggttgacatttgtctccttaataagaattgtcagatgaaaggaaaaatgccatttgaatttttcataacccccagcagtctggcttttccatttggtctcaatgattctgactctcatcttaatgaaggccaaatgtaaattaagttctgtcaggcttgagcagctggggtctcctatctttataaacatgaaacattgtagggttaacaaggtgcagactgaggaaggtcaagagagttgctgagctgatgtggatcctgacagctcaatgttaatgggaggtaattaacgtggcttgtaggggctacatggagatcttccaagctgtcttttaactcatttcctcttttgccattgtcagcagagcagaaagctaatcattttatagtttgagatttttcttgcttattccaaagttctggaaccaactgtctggaatgtcacaggattttgttgatggattcaggaaatatacctgctgcttctctctcccctgtctgtgcccctgtgcttctgtcctcctgataacatactgggaaaatgaggaaatgattctccaattggtagattctttggggggaacctgggggtttggatggctagagaggtggtttgataacttcctgctagctgtggaagctgtcacttgagtgctttgcagtaggaactgctgaaaagaaaaccctgctgcaggtcagggaagcttggttcttctagttctttctgtaacttgagaggctggacgaagctaatttttaaaaccttatttggccttattttgtcactcttgttgatgacataataacaccttttctctatcttaaaccttagtctaatcttgaaacttcatgaaagatagacaatataagtttctttccttgaaatgccatcatttaaatagatggcagtatggtggaaactagtctttcttagttagttactgtctaattactattcaactgtgttcatcaggtcttaatagtagcactaatacaagatattgaggaactttgggagatataacacaaatctatacagaaaagtacaggatttggagccaaacttgcatttaaatttttctgtaccacttaccaattgtgggatcttggacaagctaaaatcaacttctctgagtctcagtgtgctgagctataaaatgaggacaatagtatcagtcttgtagagttatgagttagtgaggtatttgtaaagtggcttatatagtagatactcaaatggtactttattttcattatcattgtgtttaaaagtgcttgtttctactgatgggcatttcagtaacatcctatcactaactgagataattttaaagactaaaatatcctatttcatggggctggccataatgagtgatatgttttttcctgttttattaaggaaaattctagaaaccatcatcaaagtttctagagacaatcatagaaaatagagaatagaagagcacagaacatattttcagtcattcatttatttgaatcacccacatcctatgtgtaataccaattccaaaggcagccaacttcgagctgtaaagctgattaacttacttgagtaccttctacttgtttcccttgacatttaccagtgccgccagtctcagaatgtttttacttcacaagagttattttatttaatctttacagcagtctgtgggacagatattatctctttttatattaccagatgaggaaactgaagctcaaaaaagttaaataacttactcgtggtctcatactatgtaagcaaacccatgtcaagagccacaccattagctctgttccctcatctgctaccttatgggaacctgtgcactttcagtgtgggaatccagaagtggtctctgccaccaagaaattacagtctagttaaagaataaagatacagagcaaccaagcagtaagagcagaacaagaaaatagatgaaaataagagctaaagcgtatgtagtgcttgttaatacatctggtacttttctaagcattttacccatgataattcatttatttctcacagctaccctataattattgtatttttcttttcttttcttttttttgagagggtcttgctctgtcacccaggttggagtacagtagcacagtcttggctcattggaacctttgcctcccaggcttgagcggctctcccaccccagcctcctgagtaactgggactacaggcacacaccaccatgcccagataatttgtgtatttttttgtagagatgaggttttaccatgttgcccaggctggtctcaaactcctgagttcaagtgatccacccacctcggcctcccagagtgctgggattacaggtgtgagccactgtgcccagcctaattattgtcttttacagatgaggaaacaggcacagagactttaagcaacttgcccaaggtcactcagctaataagtggcaaggctgggatttgaactttggcatttcacatccagagtacgggcttatcaccattttgctctactgcctctttcagcgtttgctttgcaggctttgcataaactagtttagggaagaaatttgtgggtgatggcttcgggaggatctgaggctgtgaacaatggtcagtagcttcattgtttcatttaagaaatactgagtgtctcctgtgtgagaggcactttgctgggcgctggagatgccaaggtgaatgagtgggataagggccctggggtaggcttctgggaacttagagtctagtgtagagaggcagaaaatagacacacacaaagtaattttgttttctggaaaatgctacgaaggaaaaacacagatgaacagatttggcatagcgagtgtgggcctctcttgggagtttttgtttgacctgaatgatgagataggaaggaggagcaacagattcactgtgggggaggaaagcacctcatgagatcagcaaaggaggtcagctgggccaggagggtatgagcaaggcacagaggcgtaggagggggtttggcgaagtgggcaaaggctgctgcatgcagccttgaggccaggggcaggagtttgagttttattccaagatcagtgggaaatggttgatgggctttaaacatgggtgtgacacagtatgttttatgaccttaaaaaaatcattctggcatatgtgctaggtagatagtaaatatttgtatagcaacaacaaacttcatactgttttttttttattattatactttaagttttagggtacatgtgcacaacgtgcaggtttgttacatactgtaatgttaaagggaagaaaagttagaagactaatgaacagtcttataaatacatttgtttaaagaaactatcagtatggaaaaaaagactggccatatacacacaagaaaacattaatactggtacactgttcatggttggaagagtttgctactgttttagcacaatgctcatgcttttattacttagtaattttccattcaaagcttgtagtcatagctaacctttctggttgacaacacttcattattgagcaagggattttttttttttctttttgggcttattttcctaaaaagcaacatgctagggacttcacaggcagaattttatctctgccctttagtgacacagtgtaacagcatgctgttttactgtatctgtgtggcagtatgaggaaaccaagactcagaggacttaagtagcatccccaaagctacacaatagtaggttgtagagcccagattctcacctagtccagtctgcctccagctcctgggatctaactattgcctctcactgcctgcttttaaagggcactcatttcttcccacttgccagggctacaggctggcagaccactggctgaatctggtccccaatcaggtttagtttgacctaccatgtgcttggaaaaaaaaaataaacaattttaaattagtttccaatatttaaaaattgagaaattttatctgaaaattcagattatttattttcctgaataaataatgaaagaacttggcaatacagggtccacacttccatgcagaagggaacggctggagctgaataggggctgccttctttagaaggggtcggcattcttcattttgcagcagtcctcacccagcctgctacactcatttcctttttcagccctacccctctgagcacttgaatttgagacttaggctgtgggaatttgttcaaggaatctgtcattacttttcctctagcaagcgcttagagaaatggaaaggcattccagatggcgaatttcttggtccagggctctcatgattccatgcctgtattctctcacacctctgggtctttgctcaggtttttccttctgcctggcaaacttatagtaatttcttccttcaccaggaaaacttataataatagttcaaaacccagccttcactgcctccaggaagccttccttgacttagggtcctacactctgtcccctgtggcattctatgcttatctctaccctagaatttattgcattacattgtgctgtatttatctcagtgtccctagcctccagagcaatgtttaaattctaacattaataacttattatatattttgatgggtggatgaatgagcggatgaacttattaaatcatctcatgccatttttgatggctaggtgcatttgtccaatcatttcattccaaactaaaggttcactgtatgcccaacataagttaattttctcttcctcattgtggaaaatgagatttgagcattactgttcctttccatcctagagccaccccttggctgcagtcctgttaccggagtcacagcttattttgtatgcaaagtgaaggctctagactgagacagtaactcctctgggcctctccactgtgtctttggactcctgtgatggataccactttaagttgctcccttcaccccccaggagaatccaagactcatcttctcaatcagaaagactttctttagaatgtttataccagggccctgtatattggaccagattcctcccagcctttgaggaatgaagacagtattgtcagctgctgttagggcatgtgttgtggattttctctccagggtgggtactggacttgtaactaaatacacagaatgttgaggctgatggcttgccttcatctacctggacagtgaatcctttccttattatcctgtatttgcatatttgatttataccaaatatgtgttgcattcttttagttttatagtccagcaaagtaatttttaaaaggcagacaaaagaaaaaaagttgttggccagataccttgtaacatttaataaatgtcagctattattataatactttaaaaaattttactttatggctatggcagactttcataaatatttcctttatatgatctatgacatgaccttgtgggataaatattactacttctcacattttacagatgaatacaagcctcaaagaaatgaaatgacttctctacaggtatcaaatcttggtgaaggtcctttgggcttaaactggagccaaatgaagtcccttggatcttaatgaaggtccttttggctttaaattctggtatatgtgtgtgtgtgtgttattctgctgtaccatgtttcttcctcatttgggttggtggattttcagctccataaaagcagggaccaaatctatcttttcataccttactgttttatatccccagagccaaacacagtgtttggcattgaaaaaatactcaataaacatttactaaatgaattcatgtcccctggccagccaggagctagccatgtgactgtagtgctgaagaccacatgcctggcttacctgttgccagtcttcctgacggctgtgcagggatgttggccacctctaggagtcattagtgtaaccagagaggtacgaggaaggattgtgaagttaggcttgctttatgtacacatggtatgattctgtgtcgatcaaaaattgaacaaaattcttttctcatagtggctaaaatggaagtcacacttactggaggaaaatacgatctttatagaaacaacactgaaaaggacaatgcatttaatgtgtgttgtgatacagtaactcatagcgtgtaaactgtcaacttggaaatctagaggctcagggtcaatggatgtccactgatgcaaggaaggtggcaggctagaagtccaaaaaggtgcaaaatggtattcttttggaggagtaagtaaatctcatttctctgaacacctgggctgttttactttcttttttcctattatccaaagtgaccataattgttctgttattgtagggatatattcatttaatcagtgaaagaaacttttgtctggtaactactaggtacaaagtactgtgcttggtgatggggaggaaaggaggaagccaagctcaccctttatctcaaggaattcccatatctagtaccaagagcgagaggctgtgaaagccattacccgccctgccacccccccgccatgttttattatcaaaatttcaaacatataaaaaagttgaaaaacttttacagtgaatactcagagccatcacctagagcctgccatggacatttactgtccttgctttatgacttatgttgtttccatctgtctgttcctctactcagcttacatttttggaataagttgggagattgttacacttgggaaggcagtttgaaatattaaaagttgtttacatttctgaaatattaaataagttttagttaagatattgactttgttttattgctatctacatacatggccaacacctgtactagactttattaaatatccactgtgtgctttcaaatcttctatcccatttattcttatgaaaatcctgtgaggtagatgttatcacttgctttgcagatgaagaaattgaggatggagggagttaagtagattgccacttatcaactttattacctctggcaacgttggaatgcaaacccaggtttctgactctaagaaatgaatttgaaaaattattgtaaaggttagctggtcaaacaccagcctttatcacacaggtacccctgtctacagataagacatcattggagcttacctaagtaaagcaaagcaagcaattagaaaatgagagctctcttattttgctgattaattattcattattttcttaataatgactttatttttctatcatttttagtattattacttcactttgattagagaaagcaacttctgatggtttaagttaaaaatcccagataacacatttgtttggcataaatttttaaggtaaatatgaactctagaataaaacgttatcaaagttattaaaagtttagctgttcaaagttagactcaaaatgaaagaatcatacttgagactgggtgagatctgtttcccaccactatgcaaactctgacccagggcctcttttgtttgtattccagcacattatagttacctctccaagagctgactttgtcctcttctttgcattcccctgaggtatttgtagtgagaaagaatgactaaatgatggaatgagttcattacctcttctgaacccaggggtcttggaagtgctgacacagctaagacctccctggaggcttgtctgttcatccagaatggccactctggattcctataaaggctcctgtctctctgaatcctccctgtatggagaggctatggattagataaacttcagagtgtttagtaataaaaacaagcttgatctcaactctgtggccctgtcaatacccatacctgcaccctcttgaaaagctacatcagtgtagcttctaggcttgtaatctgaatgatcagtgtcttttggctcaaaaatgcaaagtgaaggaatattcagaggaaattagagagctgcctaagtggctctatcctacctggcctccgtttctcattatggctttgctaaagggtctgaaccgtggcatggacgtacattttttctcagtaacgccacatgtgtagagtattgatgcttacccaagcaaagcaaaacaagcaattaggaaatacagtctctctctcattttaccgattaattattcataattttattgataataagaactttatttttctatcattgttattattattattattattattattatttcaccactgattagtgaaaattattggtcctggactatcaccagtccctgttctggcatttgggaacaactggtgcgtgtaagccctgaaactctccttcgtgctggcattctgtgaacctgagagagatgagaagagaaccagggactagagtgaagcctactgcagttgtcttggcatgaggctgtgtggcttggctttggctgggagtcacagacaagcccacggacctgagaaagagagtgaatcactgtacaagtatttatcgagcacctcccatgtcctgggaagcagtagctggagagtggtgaaggagtactgagttttggggttcaagtggccagggctttcccccaggctttttacctattatctgcattatctgggcaattcagttcacttatgggccttagttttctgtctaaaaaattgtgttgatatactattatgtatcagaaggtatttgataaattgcagaatgctggtggtattgatagattttcagatgatagtgacagaaaaagttgattgttggaaagaaaattagtgaggtctatttttcatatacttacctttagaggcaggtaagaaatctaagagtgaagggaaatggaattcacattgtttgaagggtaggaaattttaaaaatagtgctttttaatcgtccggaagacttggggagagggtattattcctgtttgagtgggtgggaacagtctgagagacacttacctcatgcagctactgagtgggtagagctggggcccagctcagatctaactccagcctgtgctgtttctacagcagctcagaaaccaaagttcaggggagcagaggagctggagacagtgaatccatcctgaggcccccctgagtaaatgcttccagggcaattccacttgcactattattaataccttacagggtgtccttcacaaatttctcagaatgatggctgtaaaaatgggtgtgtgttttagaaataaaaatattgtggtgctaacaagttcctgccggagttgttcaaggacgttcattcattcagcaaatatttattgaaaatttgttttgttccagacactttgttaaatattgggaatatagcagtaaggaaaacagagtcactattcccaggatgctcatattctagaaaggagataagagataaagtcacagtacagcattagtgcagtgggaacttgggttactctagaaatacagcccagttaggatcgaggggctcggggaggtaatatgtaggttgtgggccagtggatgaattggaattgggtaataagcagttgaggtgaggcagtttgtaaaagctagtctggtggcagtctgaggaaatgagacctccgtggggctgcaaatgcagtatagtgagagcttagactgcaagaagctctgtgaatccgtcaaaagttcctttaagtcccttttatatattccatgctattaattacaggattctttgcaggggtgaagggggacctcatgggatggagccagttcaccctagccacaatcagagaaaggtcagaagctatttgtgacatttttcccgactcttctatctcaaagacctggacctgagaactccggagaagatgagctttgagcactcacgtcctcactgggcagacagagcagctctcctcatttcagttgtctcaagactagacagtgtgcctgagaataaagcagtgaattaaccccacttgtccaagagggtgggactgaatactagacagggccctttccgcctctcttgggtggtggggggtggcgtgtgactcagaggcagtgacatcagccatgacttcattcatccacaggaaagacagtgtgcagaccgcgaacacggctgatttctgccctcccttctcgatgctttgtcttgctggggacattgtcatggtcctgctgttatttcccacacattttattcacgtctcatgtttaagctgttctttttcttcaccccattctttttggtctctttgttcatcttttgcttttgtctttattttcttctttctcctatttaatttttcttgtttcattttctttcctgtacttcttctcttttgtctccattttccattctttccatttgctctgtcctttctcttccctctgtgtcagaaatgtatacaggaacacatcctcctgcctcctatttcttctctcctctgggcttcccactaggttattgctgtcctaacattcctaaaactgtgttcacaaaacactctccacacaaggactgatggtggctcccattcttttctgactcaagtatctaatacaagtccagatttacctcttactgcatctcaacacaggtctctcagactgagcttctcatagttccttctccatggccatggatgctgctgatgcttctgcctgcacttttactcaggccattgcctcagtgtggactgacctccatcccatcttcctcagtctttgccttccctctagacacatatctgacattgcctcctaagtaacccccttacttacctccttcccacagcactgtctccttcatgatcatacagaatccatagtttataaattatgtattttagaacttgaattattctgtactatttatacattcttcctgcatgtttcatatgcatagattctttgttccacctagccagtaactaacctgaggataggaagtatattcctgcctttcatcttctatgagcatacctagcacatagttggccacaaaccaggactgacagaccatttttttgcaaagtcaagaaatattttacttgaaaaatagttatttgatgctaattctggggagatagatgaatgaattatagttctttcctaaaaaaagagctaagggtctagtagaagagacagacccacacgtaatttgagaagaacaaggattgtggaggaaactaatgtttactaggagtgtacaagaatgggcacatgaacatgtataatctcactgaattgaattcggctaacaatcctatgagttaaatgttgctaccaatgaacaaagtgagactcatagacattaggtgactactagtcagaaataacaccactaataagtaggagaaccaacatttggactaaggtttgtccgactctaaagcccctactctttcctgaagagggaaggatgtagtgaaagtgacattctaagtaataataagaacaatcgtaggtaaaaagtgcttactatgtgccaggtgctgtaaacagattacctatatttgttcatttgatcccccatcaaccctatggcataggcactattattgtcctcagtaatttttataggatgaggaaattgagatgaagagtagttgagtagattgctcaaggccacatagctacagagtactagagccaggatattcactcttgcattctggctctggagaagaggcagcagaatgtagtgaggccctctacatagagtagcatattgcatgatcagaactgctgttggaccagtctgtttggagaatcagggactgtggagatgctgacaggtgaaggtgttgagaggtgaggctaaagaggcagccaggaatcatcacaaaggaccagtgccctcctcaaggacccgtgacaaaacatgcaattttcctagaaatattttctgtgaggttggaccgttagggatccatcataaggaagagtttaagttgtggtcttattctactacttgagttgtgaaggaacttttgagttgtggcctttgtccatgcccagcgggaaatcacagtggaactctgcaacagtggtgtaaatgaacaagtaaggatgcacatacccaaatagactccaaagaaatgccagttgaaacagtaaagtacgcctgtcctttacgggttggagatgattaagtttgggttgaaggacatttgggaagaaagaagaagggacatctgtgtgagccagcttggaacagatgccaggttatcctcaggtgtcccagagcgctcaacatttgatggagcactctccccactgcagcccccctctccattggtacttggcagcaattcagtggtgctgcactgacctgggagtccaagccaggaagtgaatgaatccattttccaattaaaatgaaacttctccaaaggacctgctaaccctgagagaagaaatttatcttcctggcagtctggcttgcctagaatatgtctctgctcctgaaacagactgagaaaagccattagcttgaatgaaaaaagagaaactgggacagttcttattcacaacctcattcatttatccattcattccttttatttctgcagactttaatttggcttccacatgtctgctcattcattcatttattcattcattagctaacatgactcatcatctatagatcagacaaactgctgtgtcctaggagtagagatatttaataaaaaacatagctcttgcctttgaggagctttcagtctagtgagagagacagacaaatgaacagatgatgggaaatgcagtgatagggatattcatagagtactataggggcatagcataagagcatctgactcagcatagggatgtcatgggtgatttcatggagtaggaaacaccagagttgagtcctaaatgtgtacacacatagacatatacatgctattgcttctgtttctctgaagaactctaatacagggtgatgaggtgggcacctcttcatgaattaattgggagttgaaattagaatggtggttgaatgtaaggaatgagagaagaggtagaagatgactcctttggtagaggtagaagatgactcctttggtaactggatcaactggcactggaaatcaaggaggaggaacacacttgggggaagatagcagattctgtcttggacgtgttgagttggaggtacagtgggacatccaggagacatgtctcagaggagagtttgaattggagtttcagatttggcacgttattcagcgtgtagttggttggaatcacaggagtgattgatatttctcagagagcatgggaacagtgaaaagaacatttggatgaggtaagatccctggggagcagctaaagaaaagagcagctaaagaaaaggagcccatgaaggagacagaaaagcactgatgagaagggcgtgagaaggtcccggagagtgagaggttgaggaagacttcctcatttctcccctggtcccagtctttgactttctttcatgtctgctccaagacctgttcaccctttccaaagccttctcttcctattaggactgtctccctctctcccatagatggtaccacccacaaggcatggcttgatccaggtcactgtggcatctctctcatc

SEQ ID NO: 41 - DNA, 54699 bp, Homo sapiens
agccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaa

SEQ ID NO: 42 - DNA, 199992 bp, Homo sapiens
aaacaagagacactgtaagtaagtttggtttactggttaaatgttagaatttctgagacatttctgtggcatatgcgaaaacggttgaatttctataattttaggtttattatttcttatatttctttatattaaatttacatattctacttactcattttacttttcctctcccctccattataatgtataattctgtatgggttattagtaaatattctaccttttcctttaaagagatgaattcatggcttttagaaactgaagtctctttaaaataattattacgtttctgatgtgtgtggttctctgtgttttgggtttataagggatattattgtattgttattcatcttgtgggtttttaccagtctgtcaggagatgattatgttgggttattgatctgtagtcattttctaaatacaattcataggatctcaaatacaaaaccattatttagactcttattctactgatttttcttttgttaaaaaattggaaatatgctttgtacaacttatttttttacttaatatgttgtatttttcatattaatgtataaaaatatttttgacatctgtatagtatcctatcctatgtcagtatcaattttgtcaagggtttgggcttgaaatgggatcttattttaatttgcatttttgattattgaatgcaattaatttttcttatatttatcaaccacttatttatgtatgtcattgtcaattactaattatgacaattagtgttatatatttcaatgatgtttatgtcaattgctaatatttgtattgggagttcagtgttttcttcaattttggtgagaatttaaaaaaaaatttttttgcagtataatttccagaaaaatttaaacctacagaaaacttgagagaatggcatattgaacacccttataccttttacctacgttaatcagttgctaacattttattacttttgtgctctttagtgcacaccttacctacctctgacacacagacctgtaattattttgctgaaccatttgtaaataaattgcagacctcacagtattctccacctgatcagccaatactaacaacattttcctttataaccacaacatcattatcacacttaaggcaattaaaattaatcctcatactcccttacaggtatccctgctgttaaggattcagagggccactcactctttcttgctattggagttctgactgatagagactacattaaaacatattagctaaatgaggagtgaaaagttgtcttattatctcagaaaatactctttagcctctagtgtatagaacttctaatatactagatggataatacagctcagaagtgcagttaaaccccgtctgcatgttcaggtatgtgtacatacataggagttggggcaggaaggaagacccgatttgccaaccctatctcaagtctagcagcttagcaatatgaatccagacctgcttgggtatgattaccacatggcagtgggaagccatgctggtcacacttgggcataggaggtgaaagtgtgagctcattattatcaccttttctttaacacagtgacccttaaaatgtggcttaatctattccagtctcttaatgattacatgaatttcccttaccgtcttggagaaaattgagtaagaggatggggtgcaaagtcaactctgtgtctctggtgcttctctgagtggagagaggaggtcgggtggaagtctcattctccccagagagcagaggcagcagcaggagaagaagggagaaacttgcaccttaatacgtgcctgcctgtggtgactacagtccacatcccttccttggtacttggcctcttcatctcctgtctcattagtatatctgagataagagttgatttttttagaaaacatctttagatgtatatagtatacataattacatataattcacatactatatgattcactaatttaaagtatactattcaatgatttttgcagattacattacttatttttattaattttaataatacatatagcataaaatttgccattttaattatttttaggtatataattcagtgtcatgaattacattcctcatggtgtgcagtcattaccactatctatttctaaaacttatttatcaccccaaacggaagctgctactattaaataataactccccatttccctctttacctatcccctcttttttttagacagggtcttgctctgtcgcccaggccggagtgcagtgtcgtaattttggctcactgcaacctctgcctccagggttcaagcgattctcctgccttagcctactgagtagctgggactacaggtgtgtgccaccacacctgactaatttttgtatttttagtagagacagggtttcaccatattggttaggcaggtcttgaactcctgaccttgtgatccgcccacggctgagtgaacagataaaaactttactatttttatccctccctctcccctcttaaactctaatctactttatgtctgctatgaatttgcctattccagataccccatttaagtagacttatatagtatttatccttttgcgtctggcatatttcacttaacataatgttttcaaggtgtgtctatgctggagcatgtgtcagcctttcttttttatgactgaataatcacatcctattgtgtgcatatactacattttgcttgtccattcatcttgtccaaatggacctgttggtggacatttgcatcgtttctaccttttggctattgtcaatgatgctgtggcgaacattggtatataagtatctttgggtctctgcttttagttctttttggtgtatatctaaggagtgaaattactggttccatagggtcattctaagtttagcttggtgaggaaccaccagatgtttccactatggctgctccattttacattcccaccagaaatatatgaaagttctaattcctccacatcctccccagctcttatttccctctcctttaaaaaaattatacccattgtagtagatataaagtagtctcttattgtggtttaagaattgattttttaaaatactagaaatctgtgggatgaaagtaaaattgattgaatttatatcatcctagaagtaactttttttggcaaggataccccagggagtgtcataaaattaaaaattaaaggtgtctgagagtaaggggagaagcacagttacttctgatgtgcttgatgctaaagctccttgatttgcattgttttatggttgtgttgaaggatgatttctcagaacagtggtatttaaagcagctcttctaagttctaggaaggattcagtcatcctctctcaccagcttattttttagtatatttaatagtgctgagaaataaccagtaaatattagatattctttacccttatttttgagaaagaagagtgttttcactctctacagaagaaatatccttatctcttcactaatgatagtagaaataataggcatttcaaaataacagttacttaaacacataagggctcattctttcctgtgaataaatatagatatatggagtcttgggctactgtgatttccccataaagtcatcaaggacactagcttttttgatgttttttagtcctgagttctattttcaagatcacctcatggtccaagatggcggttgaagtttccattatcaagtccacagtccatgtagcaggaagaaggaagtgggtgtggtgcatacaaaggatgtgcctcacattggagtgagccttctttaaacaatcttcttagaagatctacgtcatacttgtgcttgtatattattgaccagcagctaggtttataatcaaactgaggtgaaggggaatcggggcagtgtaggcttttatctgggtgtcttcctatccaaatattggggttttcttactaaataaaaagggagaattgatatggggtgggtaaaaagacactcaaaatcataatttctcagcaatttacattgaccagtatcacagacaccaatttatagtccaatgatagtcacaaggtaaagggagaaggtggtgatcatgagggagatagtatataatctgagcaatgtaactcacaagtttcattattcattaatacattcattcattcacttattccttacatatatattagtaaagcatctgtgaggcattctctccctaatccagtaattgataggtacacatgtatttgactattcaaacccgtataagagccaaataatccttagttcaaagttttgctctgccacttttaagataaatccgaactcagttaaatagcttgtggatggggtgaggaagagggaccatttagaaacctagtaaacctgtggttcgatgacctttttctccacctcctccctggcttgggatttgattttggctacctgtggagagagtcatccactgaggggtctcagagacattgtgggggtgaagaaatgggtaggtgcccaggagatttcaggccagcccaacctgagttcagaggcttaaagtccagggagggcgagagaggatgaagcatgctgggtcagtcgggctggaggcagtgggggagtcggagggagtaggaggaagtaggaggtgctaacatcatgagaagcatgagttaaggcacaggttctcagggactgtgccttgcacttgtactcacttgttacatcactgactgtccctctctgctacattgaggcaaagtctgaggaaggttgaggttgcttctttctcttttcattagtaaagcaaatctggatagaaaagggtgagaagccccatctttgtcctttggaggaaagggtaaaactgtgtgacctcgacgattatgatgtgcactcttcactgagaaccactagtctgaatctgttccatttctataaagctttttccccagttctctgctgtgtacgtctagatgtggattttatgtggctgaaagatgatctctagcatgactgtcattttccaactgagcagcagtatagcttttcctttactgaacaattttctctgagaccttgaatcacttttggaatttaatttcatttgctttttcaatatgataaagtagaactctctctgaatttgattcctcacttacaaatagatatgatactatattctctgttgaaaatgttttggaactgtgaagatgctagagagttagatctcgtgtttcagggaacagaactgaaactcagaagggtttcattctgagggtgaagccagtgtgtggaataagagttaaattttaaggggtacattcctggatcatgccttgttcaggagtctttttcctgacccaagaaggcctccctcaggatacagtgggcatctcagtctttgtgaactcttaaattcatttcttacccagggtggctaactctgtcagtggactattttgtgaacttcatactttcggaatatgttatacttatgtgattcttggtagtctcaagaaccttggtagaggttcaaatcagtcaatctggttaaaggtatcagtattcagtcttggaatcaagtggcactagagctcttaaggcttggcggttttcaggacctacatcacaagatacagaagtggtgtggcttggagctcgtaagactcgtgtctggtccaaccaggtaacttggggcccctggcacccatatcagacttttctcatctgcaaaatgtgctgcttggagtgggtgatttatttagtacttcccaggcccaaagttctgagtctgtaagatgtagtggggttgaccagcatctccttttggattctcctttaaaactcattcctttgaaaggagattgctaaagtcaaaccttagaatccaaccctttgggctatgatttaatgttaaaatgctgtaccctttcctttcctcctttttctcctttactacttctattttgtttctttttcgaaaaaatataccttcttttaaaatttttcttcatttttccttcttctctgtaaattatcaagggcctttgaagagaattcttacatgttattaagaaattgcagtcagggagccctctgttcccagatcatttagaagattgcttttccttttgttaaatacaaaaaattgtcaacctgtattgttaaaatgtgccaaaaactgcattcaccaataaaaaatgtcagctctcattattgcccagatattattcttttcaaaagcggagcactcttgccaggctttctaaacaatcttcagctcattcatcttcctggttttgttacattttgaacctctctgggtctatataaggtggcagcctgtcttttaaaaattaatggattccaaatgccattcaaacctatttccgcccttaacctcctcctcttctccccaaccctgcctgttaggagtcttatgttctgtataaatattgagctggagatagtttctaaagaggtgtttggacctttaattaacattgacagcctgtctgcttaggattttgctctgctgtctccatggaaaagtcaggtaggtcagtatgtgggggagggacctctgcagtggatgtgttcctggcggctggccctagagacactgcactctgagccaaccgtgaagtcattttgaatttaaggagtcttgctaatccaaggcaatgtgtcttaatttgacaaagtaaaggctgcccgataagcaagcctcactacaagttctgtgaaacagggggtgtttgtaagtttagattgtgctagagaaatgtggtgatgtggaagaacgggctcattttctcctgtttactccctttcccaccccatccccctcctctctcccttctctcttacttactttggcccaaatcagccctgcagtctggcctctgcagtggcttgatgtgaaatttgagaaacatatgtagttttctatttcaggaaaatgatctcagggattgaatgtgtttttttgttggctgttaagctctgatcttgcccagtgtggttttttgatgatgggaaagaggcttcgaagtgctttttatcagaatttcatgtaataaaacttaaggtttggtttctttattttggcccccaaccccctcccaggctcaggacacaatgtcgtctattctgtcagaagtgggaagaagtacacattgttcatattacaatcacttctttgctgcttgcacacacatatataagaatggccactgtgtctatccttcacaaaagctattttaaatgtagttcagtggaggaccaaaggtctgcgtagtgtctcttacaaaggaaaagggatctgttgggggaaaagtctgcctttgttttgccttggaagggccagtatttttctttgttctagaggtgagtgccaataatgggcctagtgccctatcaagcaaacttcattaatccagccctgcaaagggtacactgatcagataaaagggacctacatcctcaaagctcaaggtatttgtttttaaacttttttcttactgtaaataaatatcactattgtacttaatctcatattcataattgtattccttttcttaaagagcctttacataaaagcttcaggccctacaaaatccgagagcatccttcatggaggaaggatagtagactcgagggtgagtggttgaactttggctctggtgtaaaatgcccaccctgggacttattgtgtgaccttgagcacgttacataccatttctgcacttcattgtcttatttatatttcatgggcttgttgcgggattgaacaggttcaagtgtataaagctcatagtacaacctgctaaggactcaacattagctattcctgctgctgtttttattatttgttgctggcgtataagacctaggcaaatggagctaaatactattgtctaccattaaaatattcaccttctggagggaatagtgcaagggtaacttcagatttgcattgaaaaacccatggactatcactttacatatttatttccttaccatcttcaacccttatccagacagctccaaatgcacattattcagaaaattggtgatattttcacagcactgagactaagctcatctcctgctggtccttatcactcaccagcctttcagccacatcagacatctcctcaatctctgggcaaaccaggccttttcatgtcttcttgactttgcacgtactgtttcctccccgcagagtatcatttgcccttttttctgcttgtcaactgctattcacccttcgagacccaacttaaatattatttgtgaattttgggcagttacacagactcttttgggcagttacacactactgtttcatttttcctatagttcttcaagaacttctctcattgtagtgtaattatttcttgacatacatttttcttctaacagcctaggaggtctttggatgaagatactacagtctattcacttttataaccccggtacagagtgcatgacacgtgttaggtgttgagaaatctgagaaatcgactgggaagagttttttttcataccattatattttaaaagctgcaatagtttgttccagaaaagttatatttttcccttggtgtatattctaatttaaaaggtgtttttaatgcctgattgatctccaatctgtaatgactttgtagcattttctttgtttccctgcattcagccttctgatttaagcagataatgcttggaaacacctgtttaagttgtatcttctttgctagttgtaacttcatgagtacagggaccatatatgttctgttcacagctctatccccaagtcctaatacagtggttggcagttctagaggtagaagaaattataataataatagtgcttgtattttatgcttaacagagcacttaacatgctggccactattgtgagtattttagatacattaaccccttcagtcctcccaatattcttatgttatatgtattataattatcatctgttttctacagataaagaaacagactcaaaagaggctaaggaacttgccggtggtcacacaatgattggcagagttgggattttaacctgggcagtctggctccagaattcaggctgtttgccataatggttccttgcctctgattagtactaattagcttagtacttgtttgttaactaattattaaaggaatccaacagagacctatttctctaatgtaaagagttcattcattaggcaaataatcaccctaagccagttgttctggaagtatggccttcagaccagcagcatgagcagcgtcacttggaaatacattggaaatgcaaattctgtggcctcactcccaccctactcaatcagaaactcttgggagtgggaccaaataatttgtgttttaaaaaaatcctccagaagaatctgatggatgctaaagtttgagaaccactggccaagactcagccattttctctggaattttacccctgatttttgcttttcttaagaagtcataattttgggtgtctcacttttgcatactcctgatttttgtgacattaatgtggggactaagctctaacctcagtgaatgtttttgctaaagtttctgagaaattttgaaggtttcaggtgtgtctgtagcttgacagtgtttgtttcttttgatttttttttcctgtgatagcttttaggatcaggaaatttaaaaaatatagtacctcctccattcagccctgctgtctcagactcccctaactggtgagtgaagaaggagcccagaggtgcagggataacagagaaaggggaagtagcagaatcagtgagtggggaatcaaagtttgatgttatcgcacttcctagaagtggcctcaggtcctttggactgttggtttacaaatggtagaaaaaagggacactggacttcaaactggacttggaatcccagttcagtctctctatctatgtgattctaggaaagtaatttttctgagcaacagttccctcatctttaaaatggggataatattactaatgttttaatgatgtgagaatttatggagatgcatgatgagcactcaattcatgcttgttgtatctatactgaaggaagctgtaagagatagagttagtcactagcatatttaccagtgagtgttctaagaaatggattatagattttgcagagcaacaaggaatccacagcattccacaatggctggtattccaaggatcgaaattctgggaggttcagttgcagagaaaactaggcaccagtttgaatgcattatgtcttgagtctgctttttttttttttttaaaagaaaggtatctaaaagtgatttaacaatgtcaggatttagacttaagtttttttctgttaaagaggccattgctgaaagtcaagacccaaggactgtacaaatattgatgcaactgtcagagatacatggtatttgaccttctattaataaagacaaattattgcatttctgtgatatttgagtctgcaggaacttcccttaattccactggtattccattccacggctaccagggctgctgggacaagggacgtggcgttgtgtttctgatttacgaggtggaatattagtctgatttactaaactgaaagagcaggttcagataacaaacaacatagtgaaacttcctgaataacagccacagaaacaactcatgtatttggtggtatcacaacaagtttggctagatttatccacagactagaatacaaaccatggaggaaagaaagcaggtaagcacaagtaaatagagggcaaggcagatactagtggactatactggatgtaggaagactttgaggaaggcttttttttgcagacatctgcagggtgtaggcagtgaagtgtttgttgtgactatttgccagcaccatcccacttcacaggtgggtgggtggttccttttcaccaagattttaatggcaggttgtgccccataaaagggcggggcagtataccctgtattagtttaaaaaaggtctcagcttacacgggacagcatttttactttttacccttgcctttgctcattcacagggagtacttcggaatcagcccatctaagcctcagacttcaaagggagctcattcctatttgacaacagtcatatccattttgccaactctttgacctttgaaatagcatctactcagtcaggtctgacctgtcaactgtctgtaaaaacccatccagatcaagaacttgatattttcaagaacacatctaaaggatgggggcccttctaattttgtttctccaggacttgttttgggagaagccagctgcttcttctggtcttaatgggatgggattatagatgggttgagtctgtgaggcctcaacttacatgatgatcctgtgtccttttattataggttgcacatgttttagccactcatggcagcatttttctccagctacagtcaattttgtctaattattgttgatcatgattttactgtaaaaaaaaatttttttttttgagacatggtttcactcagtcagtctggattgtgcagtggcacagtctcagtgcactgcaacctctgcttcccaggctcaatcgattttcctgcctcagtctcctgagtagctgggactacaggtgcacgccaccacgcctggctaatttttgtatttttagtagagatggtgtttcaccatattggccaggctggtcttgaactcctaacctcaaatgatccacctgcctcagccttccaaagttctggtattacaggcatgagccaccatgcccaggttgtaaaagtatttttaaaaagtgttttcagaggccatttgccatgggaaaatgggatatgttgaccttcctgtttacctccatttgtgggcttttggttgtgagcatcagttcatatccagttttggggaccactcttgggtatactttaaataattcagatgttgaaatttttcagaatgagaaaatctagagagaagtccagtttgattatactagaacctcatttgctgattaaattgtaaaattcctaattgcaacttggtcatgtctttgcaaaatagtaataataatattaacttctatttatatagtgactgtcttctcaaagaactcaaaacagtgtccttttctgtatccctgctattcccaaaacatgtttgtggcaatgtatgtggcttcaaaatgtggatgtatcattatgaaatataaatgcatgtggtgatggtatttattagaatcatatgttattggaagtacctaacattgggtgtaaaggaagcctggtcaagtttccaatagagatttacaattgggcctctttgtatctcagtttcttcatctgtatagtgggcataatagttcctattttatagagttattgtgatgattgtgttaatacatttaaagcattgacacagtaatgctgggatagtcctcaaatgctattgtttgcatcggttttagaatcagtctaataaatatgagtttaaatacccctttgtcccttgcttgttgtgtcgtcttgggcaataacagtaacagtcaacacagatgctatttattgaataatacttatatgtcaggcattatattaggcccaggatataagtgattatttatcacttattcctttaactttcttaaataggtatgattatactcattttatagatgagttaggtaaggtttagagaagttaagaaactttcccatagtaacagagttagattactggcaaagcggactctctgaattcttgtttttggttacctacttaggttcccctgaaccacagtttcatcatttgtaatagggatgacaatagctctttgtaaggattaaatattgtacataaagtatctagcacttactgtgcattcttgacatgatatacaatgatattatcctctccaattagagctttccatataatataatttttttctttgtgttccttatgccatgcatatatctttagagattaaaagacacttcttaagaatggattcttgcatttctgagaacttcagaatcacacttgtgatctgacacagtatatatacactcaggtattgatgtgtgtatgtgtactttccattctgttcagtctagaagtgtatagatgctcaatctgggtgctttgtaaggaacatcacaaatgttcaaaatcgtggatggacttgaacatgaaaatgccttggcctcaaagttttgcttttctgttctcaaagttgttgaggaaactggcttagttaaagctaagtgtttagaaaccaagtgtgttttggatggtaaggtggagtcagcattatatatattaatacatttttggtaccagaaacagcaacaatcccttagtctggtgtgtgcagatgtaatatgtttcatgatatttcagcctgtattttctgtcttaataagtgaaagcactgcagaattgggctgcaggccactgccccatttctctccttttgtagtcagatctcccttgtgaatgataaacacccactcctttcatttattcacccattcactcaacctcctacaatctaagctgcatgcttaccacctaccttaaagaacaccagtgattgcttattgtgacttacgtcataaatatgtattctagacatgacttctcacctgaatatcagtgtcacatccttcatagcctcaaaactttgaggaaatatcctcttatggcatactttaaaatttgtaattttaaagtaagcacaaagtacgttttgagaccttcatttttttctctaacaattctgttttgttttttttttttgtattctgtattttttgttaagtttatatcaggatgatttgtcattagtgttcttgtaacatattttggagttttccttgtgcaatgtggaaatagtaaggttgacattctgcttttaactcttctttataaactatgaggaattcccaaatagaatgttaccttgaaagactcttgacataagtagaactaaaccaaatattttatataattatttttattttttatttttgagatagggtcttgctctgtcacccaggctcaagtgcagtggcgtgatcatggctcactgcagccttgacctcccaggctcgagcaatctgccctcctcagcctctcagagtgcttgggattaaaggcatgagccaccatgcttggcctctgtaattcttaattattattttatatatgttatgagtatgagaactaagcagttccataaagatgagaattataatatctcattttagtagtattttgctttgtattatttgacattttataaaaattcatagtctcaaaaaatatacaatgttcttcgtcaagtagctaatactctctttcttagtgttcggtttaactattaatcttatcctgttaaattatttaaaatttcctaataattggcacataataacagtttttaatgtcagcattgataacatttttctgtcataatattcaactaagggatgcatcttcaatgtataaagcccataagtaggttttttcaccctagattagatctaaattgcttacctgtttttggaagtgaatattatgttattaacaataaattccaaactgctttgtattactgacattgtaacaatgtcttgatatgatggagacccttgctatcacattgtcattgatcatgcacattgatcatgcccgtgttgaaataggcaatgccagagacagaccaaagacgaaactggtagtgattttggtgaacattgttgccatgttaaacttgagtatatttcttgttgaacaaccccattttagagatacggaaaatgttgtgaggcagagatattaagtaaccctgcccagagtcgaatggttaataagtccttgccaggatttaagtgataaaacaaaactcatgcttttaactactatagtcttgtaagccactcaacaagtattggccagttaaactaatgaattccctcaaggaattgattctagtaatagagataaataatcaagtcataagtcatgactcaatgtgaaaagtcttgtgactaaggaatgaacagtacaataaaggaaacatgaggaacagtgaatcgtggtaggattatggagaggaggaggaaggaatgggggagagtggggcctcagagaggtgcaccaagactggggcccaggccttgcttccaaggtaccatggcgttctgtgtttttccttgtcttgggcatactattcagtgtttcgatttatttacttgtccttacctcccactaggctataagctttctgactgcagaggtaaattgtgtgtcttcatcacttagtgcaggaagtggtagctaatgagttggatatgtaggggcgagtacagtggacaggtgaagtcaggacatgatggacaaaagcatgaacatgaaagaagatgtgaacattcgttgcctctttaggaaatggtcgacagtgtggagtggacagagcacggacatgtagcttggggtattgtgaagggatgggtcagccgtgtatacttatctaccatggtaaaaagtgatattattagatttctgagtgcttgcctttccctaatgcatcttcatgtctttaaggacaaagatgtaggaccaagagtgggctacatcacaggagatgaaaagatctgtttgcatatttgacctctgctaattatcagcagtgtgatagtaggcgtgtcatctgacatcatcttgcctgttgcatagtagacatttggtaaagatttgttgaatggattaattaatataattatatgtttttgcggactctgaagaatttgagatacagctatataaaagagttactatttattggtacatattgcttagtatttggaataagcttggtaattattcactaagcaggaaacagggtttagggatttccaggcattagggacactgagccttgagacagggtagcagctctgtggttcagagtgactggtccaccaggaacagaaacaagctagtattgggaggtgagggagtaacattccttgggaggattatttggcaaaacgaagtaagaatcataggggcatagggtcatggaaaaggcttcattcttagtagagctctggagtacccatcaagtctgggtgaagatgcttacctccctgagagggcaagcatcaggaaagcctgggtatgggggtcccgggctcctgaggcccaggactcattgctaggatacagattgcactgtcaagtccagactgtcacgtgtgagtctaagcctattgttttggggcttgccatggtctggatggggcccctcttaaaggttatagagttgtggaagaaagggactgacacattttgatagtcaaagagtaaaagaagctatgagttaccagtgtgctggatgcttctgaaagcgtttgacaagtgctttttgagtttttaaattaaattacttttttatttttgtcttcctctctataaatcataccagagaaggtaacatttttctctatactgactttgacaagcctagactatgctttgtctatgtccagtgtacaaatgtagagaacccattcatttctttactcctcacatatttagtaaagtccggctgtgtgccctgcctttaggggacactgagcagaaagcagactcctccagacgattgcattgcagtataattagcaccataacaagagtctggcagattctagtctgtagtagcaaaatgaagagcaatcaggtctatccagggaatgaggaaatacctcacaagataggaagtgactgaactcggacttgaaggatgatcaagaatctgccaggtgggtatgggggccacctggcaaaaggacagcatatgggaaagcagaggcatgaaagaccttggtgcatccacaaagcgttgggcacgtgagtctagccagatcacaggttgtgtgttggggagcatttagagaagagaacacaaagtcctcacgtgctttactcaggctttgggcttaaggagtgtttctgatgtgggctctggagccagactgcatggctgtaagccccggcctctctgcttcacacctctgtgatcttggacaagtaccttaactttctgtttctcagtttcctcatctcagatgataataggacatgcctcacagggtggttgtgagaacctgaataacatcgtaaagcacttcaaacagtgtctggcacatcagttgttattaataataattatataagataaaattatataattcataatgatgatgtttaatttgtaacctgtagtcaaaaagtagaaccaaatacaacttgcaagggaactggatgcttctggaagagtttgataagtgttgtttgagtttataaagtaaattaccttttttactttccaggtaaaaaaatatacctttgggaggggaacaacacacactggagcctgtcggggggcggggccacaggagggagagcatcaggataaatagctaatgcatgtggtgcttaatacctcagtgatgggttgatggatgcagcaatccaccacgcacacatttccctgtgtaacaaacctgcacggcatgcacatgtatcccggaacttaagaaaaaaaaatacattttttctttccaggacagcgtcagtccttaagaggctagctcaaagactagaggaaaaatagactactaaataaatcaaaattatttagtagggtatagagttatccataaagtgctgggggtcactaattattaaagcagatagagcacaggtagttgttgagcgtagaacagcccaatcagaatgatgcctcagaaaggcagtagttggcctcccagagtggagcatggattgcagcagggggctgaggctggagggggagaagtgttgaactaattcaagggatgttggagggctaaaccagtgtctcttctgctaaatctgagcagaagagacagatctggaagcttctggtaaggtaggcttgattgagtttggtgagaagttagatgaggagggtgagaacctagcatctgggtgtctgctagatagatgctgctgcaccacaccaatgtccgtgtgtctgggtaccgaggtggtgttcaggacaggtcttctccacgtactgccgctgagctcacatccacgctgtgcatgctgggctgagttctcttcaggctgttttcagctgacttaaatgcaacacgtgatgatgagcatatttacataatgtatgcctggtgaaatcacgaaagattggaatttcccattttaattccattttaaagatgcttgttaagcaaaaggatataattcatttttcaaactgctgaaatgttatttggcctcttgaatcaaaggcattccgcaagtgttttctttattacatgccttaaactttaattagaatttaattataagatcctgaaggcatgagcaagaggagcagatgggatagtaaaagcagcttagtgagggaggattaaagattaaaagttgcttgttaatggcataagaaatgaacagagagctaaattactatgcttttgtgctatcctgatgctttttcgattctgtaacttattcctggttgcaggtttttcaattctgcaacttattcctggttggaagttgaagaatctcacaaattagatttttaattttttgagttgctagagtagatttgtacatagaaaacaggtaaaacctgacaaaaaggtgttttatggctagtagcaccttgtacaataatttctgcattgtaggggcttagtggtatttactgaattgaactaaaacttacatcatctcactagtaaacatcgaatgagcataaaataagatttttttttagagatggatggggaaggtgtgagtctataagtccaggctaacctgtcccatggaatgttagatacctactcaggaaggtaacttgtatgaacctcccacctttagcctaccccccagtcgaccttagtcatttgccccacttggttggttggctagaggagtggtagaaatttggtgtgggaaacactttgagactgctcctcatgtcacacagtgaggatgacctgctctgctctctggtgctatgttacgatgatctcccgttaggctaaattattctacttcttagtgctttttcccctagcttttttttttttctttttgaaatctgatatttagagtcctcttccccacttaattgcaagctcaatgaagaaaaactagagaacaataagatagaaaagaagacaaaaatgtagtgaaacaaaaagcattctatctcctattttccaggaacaaatgttttttaaaaagcttttttaagcctgttaatagacagttgattcttcattatttgcagattctttgtttgcaaatttgcctacttactaaatcttatttgtaaccctcaaatcaatacttgtggcactttcacagtcattcgcagaaatgctcagagaggaggataatttctgagtctctcgtcatgcgtgttcctagccgatggcaaataacacaacaccctgccttcttgtttcagctctcatagtgtaaacaagtgtccttttcgaagtctactcgtgccatgtttttctcatttttgtgctttttgttggcgatttcaccatttaaaatgcaccccaagcattgtgcaaaagtactgtgtagtgttcaagtacagtgcaagaaagctgcgatgtgccttacagagacaataacgtgtgtttgataagcttcattcaggcaggagttaagtgctgttggctgtaagttcagtgttattgactcaacaatatatattaaatgagttgtttttaagcaagaatacacatgaaacagggttgcgtattgatgagttggcaaaaatataactggaggctcagaggaacctagccctgtatttcccttaggaacaatggtccagtgttccctaatttaatgtttttggagactaccaaaaataataaggtcagccatgtatctttctccttttctccttgctcttgcttgatctttccatctcttgttacctcaatctgtgtgtatatgatatgcatatatttacttaaattatatatgcatatatttagcaattatgatatcacatgatacacgattctgcaacctgtcttttaacttatcaattgtgttggcctttgggctgtttgcactgagatccatttgtcacccttgccctgctctgcaagggtgctgtgttacagggggttgacccctgccccctgacaatttgtcatcagtgggagatggcaaggcaagagaaagagaagctggagtatttgtccctccctctgtctgccttgggcagcatctctggcagtggcccctctacagctatcccacctgcaggttgggtcctccatggctctgtcatcggctggttggtcctgggtctcgagctttagccctgccttcttcctttgtccttttagctgatgggtggaagaagcttcctgctgatgctgatctctgagtttcttccctgtcccctgggtagagcatcagatttaaaagccaaggcaagacaaaaaatgagagaatggtagcaaagatccaacactttacaagaccgcctgagaaaagggaggagggggtggttcgacaccagggcctgcacactgagtgtgtgatgttgcagctctgcaggcacagattaagcagctaagatgccatcaatgcttggaaagcagccggtgcctcttgtcctgagcttatttgtctggaatatgattcccttgaacctgactagctcatccacggggagagagaaaaaaaaatattctgatagttatcctgaccaggctctaacagggcctccttccctaggatataattttttctggcctctttccattcacttcttcacattaggacccttttcccccagagtgtgagattccctgagggctctaaaaactggaatgctatacagcattttaagccccctgtgttggcacagtccttattaaaaatgtattttcctcaagccatggctgcaccccctgaagtgtggattaacagaaaggccttcagagctggaagacatttttgaagaaccgctgtaccaagtggcattaaatatttattgcctactacatgtaaattgttcatcatcttgttttaactcttggaccaaaaggtttctcatctgctttctgctaaagtggaaatcacaggaaaggtactctttactttgctgtggtattttgttttcccaggaatacggaatatttctttgttctcataagtaatactagaaaagattgccttgactctcagcatttcattgggaggccatgtggtgtcatgatggagaaaaactcgaattctggggcaagtgcattgggctttgccacctgcaagctgtgttggcttgagaacctgataccatttatgtttgttgtgctggaaaaatgggacattgcataaatagcagatagcacaattcctggcacccagtaagttctctctttctcctaggtcttctatttgggactttgcaaatacatttctaagcaacctagaataaaatatgctattaatatgctgttaataataaccaaaagcactcagcttaatctttacttattaaataaaactgaaatgttgctcagacaccttttgctgtttttggaatgcctttgtagacacttttgatcttgcttaaaaaacataacagcatttcaaaggcttatcttagctattcttattcatacctgaaaacctacagagtttggataattttggcacacatatgtgtgcacgcatgtatatgtataaatattctgtctctctaaatatatatgtatatgcaggcacatgtataactctttaagaaatgtttttctaatgtttaattttcttaaagtctgtacttcacatcatttttttccccagaactgtttatcctcactccagacatgacccttggaaaggtggcagaaaaaacaaacggctggtgtgttttggggcagtctgcattccttttaactctctgagaccaggcttatgcatgggctttcaagctatttgtccagaggcccaaccactttgatttctgcttgaaaattagcctgttgttcaagctcaggagagcttccacagagctttcttgggttcgcgaactagagatctatgaagtgtttgcttttatttgtaactttaaccacggcagccttaactggacttttgttttcttatttaacttttatccatgtaaccttaacctaagttctttttcaaatctccatcctcccccatctcacaatttctaatccctcttttgtccttagatttttccttcaaagtcaggatatgacatttatatctatgctttaggaagtatctgaaagctaacatacacatagaattatgatttttttcttgggttgcttaggaggattaaacaaaggttttagaaggcagaattcagaaaaaaattgatagaagttgtgctgcagcttggaggggagtgtggattttagaaagcataaggacactttcatttgtccctttcatatggacttttatttcctctgcgagaggcccaggggcctggcctgtggatggtttagacaggaaaagactgaagggataactgcttccagaccttcagccttgaatgttcagccattattcaagccgttgagaaagggagcaagaggcataaggaggcttcgggagtttccatgcagcttctctgagttccagcttgtgtgcattgttctccaaatgtgtccccagcactactgaaaggactttcatacctcaactaacccttattgcaagcctgtgaaggaagagttttttatatatatatatatatatatatataaacagacaaggcaactaaagctctgggaggttacagaaacttaaggcctaagtagggttacattgagaccagattaatcagttagtagattgtctttctatttcatcatgtgcttcatttcctccttggtttacatgacccttctttggaaatttccttctggtaatatcttagttaaatgaaataactaagttttatggagtatccattatgtgttaggcattgttttatgcaatatgcatctatgtagtgcacattctgataggaaccatgtgaagaaggtgtattacctccattttagacaggaaatccctgcaatacagagggttaggtaatttgctcaagatcacacaggacacagtaggtgacaccaggatttgagcccaggtctgattccagaacttatgccatgcccactacaccagccgtccttattaagaggaaggccattggtatgaggccacttgaaatagacatggtagatatgtggcaatcaatgcaaaggtattgtctttcatgctctgttgcaatctcatttcatttctagcattataggtatttaaagcagaggtaggcttgctttcttagtttcagttttctgagaaacaaagatagtaacaacaatgatgatggatcttgttaccatatgtgaatatctgtgtgtactaggcacggtacttggtctttacacatgttcttctaggttaaccttatgacaactctgtgaagttttctcaaatttatatctgagaaagcactcagaaaggttgagtcacttgcttgcccacatcacactactagtaagtggaggagtgaggatttgaacctaagacctcttacaataaaattatgttctttccactcagtatatgggacatgtatccctgggggcacatgtgagaactataattggtctgtaagattattgatgatggtatagggatagggtgttaaagaacattgatgcccatagtgaaaaagtaattccctttcacttgtcctaccaaccatctggttacatgaaagaggaagtctcagttaggtgccagtatgccttttacaattctaacagagaacagggctcagactctgaggctcgggcaggtaattgaatctagaagaccatggtgacgttctttttgtttttattgtattttaatatcttctcattaaaaaatattataatgtgttcatatatacaaaataaatgtaatgtatatataaggttaaaagaataatataatgagtatccatgtacctatcacctattgaagcattagattaattttagttactatgggaaccttctgtgtcactcttcccatcccaacttctttctttctctcctaccaacatcttacataatcactgtataactatcaaaatcagccagttaacattcacataatactattactcagtctacagactttttgctagttttgccagttgtcatactgtttcatttcctggaccagaatctaggatcacacaatacatttactagtcatatctcctttgtctttggaatagttcctcactctttttgtctttcatgaccatgacgtttttggagtctggttaggcattttgtagaatgtccctcactttgggttggtctgatgtttccacaatattaaattcaaattatgtgtttttggcagggaagctacagaaatgatgttgtgcctttcacagtgcatcacagcaggaggcacatgatgccgatttatcgtatcacaggtgatgtgaactttggccaatttgttaaggttgtgtcttccagtttatccactgtaaagttactatttttccatttgtaattaatgattaccttgtagggagatactttgagattatgtataatatcatgcttcttatacctttgtccactaattttagcaactattgtaaattcttgcctgaaacaattattcctgtggtttttccatatggtgtttttctatgattataattctttctatatttattaactggaatgctttgtaggtggctttatcctcgccacacacttatttattcattcagttgtttatttgtatcagtatgtacttacaaattcttattttattgtctggattataatccattagtatcattattttgttttgcaaatagtccttttaaccaatggggatcccttcaaattagcttttctatctttctgacatgtctccatcttttttaaggcatttttgctttctggtgccagaagataccactttgtgctttacttgctccaaccctgagagaagcctcctcttgctgttctgcatccattcctctcagtcactccttcatgcactataatatgatttccactctccccagtgcactgacacttccgtcacttaggtcattgctaaagcagtagatattttaattcttctattactgcatatcagacatctcttggccccatatcagatcttctcaggaggacagtaaagggaaattgtaccatctcttgttccagctgccgtgaccaagtttgcatagactctgaaaaacttcctacagtataagctgacagtacctcacctcatgctgcatgcttttccatagggcaccccacgaggttccatggggtttccttgtggttgctacctctggatctcactctgttcccacacatgtacaacctggatagagaattaatgcctcctttctctctatcgtggatggttctgagatacagttcatgtggcttggggtgtggagaggttgaggatgatcctatgggatagagaacgagtcacttctagtggggccatcttgataccacaacttcatcttgcctccccctccttattatttgttttattccctttgtctatcagtcctctccttctccctaagattgcactacctgatgcagtagaaccctcttccttgggtctgctgtctcggggacccaggaaaagatgtgcagtgtttaaactccttctctataatctcttaactttcacactatcacattttcattcatttattccaattcattcattcatttacaccttatttattgagactttccctgtgtgagacattgtgtacaggtagacaaaaatcttgatcttatagaagttattgtatttgggggagcagaaataactaaataaaaccaattcagctgaattataagtgcttttaagaaaatgcaacagggagagggcagagagtgggccacgtggggcctggcattgggatggttaccacatacactctgaggaaatgacatttgaactgataaggggtcagcaagaagaaatgggctgagagaagactgatctattcacaggaaagaggaagtgcaagagccctcattttctgttttgcactagaactgctttcctatgattcttcagattgtgccacctttcttccaactcccatgcatttgcacagattgtttctttgacctggaatgccctctctgacttaccaagctggcagatttctatccttagctcagatctcatctaaagcagctctccacccccagggacattttaagtcctttttctgttgttggtgtgctgtgctttgagcacagtattcatttataatagtgatgtcagtgtacgccttagaattgttcacctgcatctctccttcttggactaggagcactctgagggcaggactatgtttgtttactttgtattcccaacaaagtgcttatagggatttaaatctatttattgatgagttggatggatgaatggatgagtacatgggagaaagaggaaaaatgatatatgaattgaaataaataaatgaaagagccagtgaataaatgacagtgacctgaccttaaggcgttgtcttgtttgtgggtgagacaggagtataaccattcagagtactgtgatgaatgcttagagattctcagtgcatgaataacagtggcagtcagcaagttctgctcatagatgcatattgtttcagctatttcatgcttatttatttagtttttaagaaattcatttaggtaccaaacataaaaaaaaacccagacttgcagctttccagatttggggccagacacatgactgtaatcccagcactttgaggggccgaggtgtgcggattgcttgaggctaggagtttgagagcagcctgggcaacatggcaaaaccccgtctctacaaaaaatacaataattagctgggcgtggtggcacatgcctgtagtcccatctccttgggaggctgaggcatgagaattgcttgaacctgggatgtggaagttgtagcaagccgagattgcaccactgtgctccagcctgggcaatagagtgagatttcatctcaaaaaaacccaaaaaacagatttggcagtgctggacccttctacatggagctggggacaaaaatctgctggaaagtaggaaattattagaataactaactgtattaaaatatgttgaattcttcttgtcatgactgttttgacatttgtttgtactagttaagggaaaatgaaacttcaggttgacagcctttaccttccttgtgccataattaatttgctctattctgtttgttcaggaaattcagcttttgaaggcccagaaagaggactaagggtgcaggtggcaaggaaaggttgatttgtggtgacctggcatactgtattccatctttaagtcctcaccacaagtaggcctttatccaggttcttgttacctggaaatgtgtgttcatttggggtatctagatgaggcaggacttcaaggaaggggatggataatgcacttaatcttcatcttcacataaggatagctgctctttatcttctccctctggaagctgccattgtgaggcagcattaaggtgggagaggaccctctggagttcatccagaaccctctgggggcacctgtgtcccttctgtttgtcagtgtatcagccatggatcctgcgtgaaacaggtggcacatttaaatggggtaatccgagaagagtggacaagtgtagggaaaccacatggatagtgcaagatgcttggctatctaaagtggggctggtactctctctgggcctaaggaacaaggagaggggctacgagcaggccctggggagattgttttgtggaggtacttacctttgtgacctttggtggagagctgcagccatcctacactttctcctagtccactgatatccctctgtgtcctccattagctgaacctggctggaggccagaggcagaagagccctctggtgtgctccacacccatcagcatcctggcttacaaggcagggtggagaaagttagagattgaatttgaagagcacatggaagatgtctgggacatctgggcattctttctgtgtggttggttcttgtggtcagatatttgtggaggagtgaggtggtggtggtagtggctgtgctttagagtcagtgagtctgggacaggatcacatctgccccactcgctaacggagttaccctcagctcaaggtcagcaggcaccgatttctttgccgtctggtggggccaagggcaaatgcctatctcaaaaagctttgggaagatcaaaaatgaaaatacttaagtgtttttttgcagatttggaaaaggctgaaagaagttttattaaaatgtgagcaatatacctcaataaagttgttttcctatataagacaaataaaactgtgttgtgatttcacaacaagtgttgatttttttcttcattatatttttctgtattccagattttctgtcatcagaaaaccagacatccataagtgctatttagaaatatgttagtactgccttcaaattattactgttggctaatattgccttctctgggttactgaggtatgtgaattcacagctgcagcatagctgacttgactatggacagactagagtgaacgtgtatgtcatttcttacgatgtgcccatggattcaggtctagtgccccatccccaggaagcctttggcccttcagatgcttctcctctgagctcctgcagctcctgggctgcccctagcagttatcacactgttttgcggttttctccaccactagactgtggtctcctctaggtccaggactgaattttattcatctccaggtcagtgtctagcattgtcttgtaaatgctgtctttattcatgttgcccagcttctaccacacggctactggaagttctcaagctcataacaccgtagcttctacaacagagagcaactgactgtgctttctcctttctgttttcaaagccctgggaaagaattctgattagtttcatttgggtcaagtgtacctacatcccttattgaaccaactatacccatggagaggtatattacagtgatctcagctttggtcaagtgctcattcccagaggaatctgttgtgtggccaatagggtaggatctgtacaactatgacaggtcttatttaaatcaattagttacagtggagaagagaatgaatcagttaggaatgctttcagctgcagtgacaatgcaaaaaagcttttatttaaatcagttagttgcagtggggaagaagcatgtatcaggaatgcatttgcaagggagcaaaaattggttcttgggggatgaaaaagatcttagatattacaatcatttgtggccttctaaagcccatccttatgtaacagcataagtagatacacaatctgtctgtggtattgaaatttcacagtggcagggaaaaggaaaagactgtctggaaagggtctttagtgggggcgatagtgaaaaaaaagtttgagagtgatttatgatgacaataatcatacctaacttatttagtagttatgcaccaggaactgttatgaatgccttacatatactatattaaatcatttcaccatatatccatttgacagtgaccaaaacacaaatagtcttgatttcccactctcacacccctaaattacaagtacaaagatgatttgaccatgtcaccttcagcatatctttaattctttggacttttccctcatgctagctgcctcatggttgtaggatagttgctgcatctctggacgttacattctcctttgatgctggaagaattggtgagaagagcatgatgagattttttgttttgttttttaaatgagaggagcaaaacctttcccaggaatcttctcttcctactatacttctgcttaggtcttattggctggaattaagtcccatggccactcttagcagcaagaagcagggaaagtggaaaacaagattatcatggttggcttaaacctgcacattccaatatgatagttactagctatatggctatttaaatttttttagagagatataattcatataccctaaaattcaccattttatgtatacagtatagtatttctagtatattcacaggattatgcaaccataccccagtatccgattccaaaacattttcttcgccctcaaaagaaatctcatatccgtagcagtaagtcctcatatccctctacacctagccattggcaaccactagcctactttctttctctatggattttcctggacattttgtttggcttctttcacttggcataattttttcagggttcatctatgttgtagtatgtgccagtaatttttttatcagttcctgttttaattgataatactctgttgcatggatgtatcctattttgtttatccattcatctgttgatggacatttagattgtttcactttttagttactgtgactaatgctgctgtgaacactgattgatgtacaagtttttatatcaacatagttttgatttttctttgaattctcttgagcctattagaaggagtggaattgttgggttttatggtaacaccatgtttaaccctttgaggaaatgtcaaactgttttccaaagtggctacacattttgtacatcctggtaggaacatgtaaggattccaatttctccacatccttgtgagcacttgttattttttgtttgtttttattataaccatcttagtgggtgtgaagtggtatctcattgtggttttggtttgcctttatgtaatgactactaatgttgagaatatttaatgtgcctattttccatttgtatatattctttgcagaaatgtctgttcagatcatatgcccattataaaattggattgtctttttattgttgaattataataggtacttaaatttaaattaattaactttaagtaaaatagaaaacttagttcctcagtcatactggccacatttcaagtgctcagttgctgtgtgtggatagtggctatgttattggacagttgcagataaagataatttacatgattgcagaaacttctgttggacagcactggcttagaaccaccatgattgatcacttatagctgggcatatgacttctctaaataaaattgaggttttgttaagctaaggaaggattggtactccagaaagagtgaggtgtcctggtcccagaaaaggaggttatgcagactcagtgtataactcctaaagatgcatcagagtttaccaagggaagaactggggcaggggttgagtgggagggcaaaattctagaccagggcttggcagatgtcttttgcaaagggtcagatagtaaatattttggctttgctgactatatgatatctgtttcaactattgaactgtaaccaaaaagtgtctgagacagatttcaatcgatttagagaggtttattttgccaaggttgaggaagcacccgagaaaataaacacaagttacgttaggatctgtgactggtgttttgtccaaagaggattgtgaggacttcaggatttaaaagggaaagagtgagcaggaagggaaggaggaaagaaaaaaaaaagtttgaggggcataggcgatgaggcaagtggttacattcttgtgaggctttgattagtgctcaccaaatccacagtttacatgtgaaaagaggagtgggggaaagtcatttatgctcagtaaatctacattttacgtaagataaaggaagcatgtgaagttacagcaacccatttgagaacaaaaggatggcagttttttgattttttctttttttgtgtgtgtgtgtgtgactcagttcccaagcttaacttttctctttaacatagtgagtttggggtccaaagattttattttcctttcacacaactttgtccttatagtgaaaaagcagcctaagacaggccataaatgaatggacatggctgtgttctaatggaactttatttacaaaaactggcagcaggcacatttgggctacaggccagggtttcctagggacaatacatagaaaagtatggaagccagaaggggcctggcatactgaaataaagagaatggtaagacgtttggtatggctgaaaactggctgtaggagctatggctgtagagaaggctaggaatagagactggaaccagattataaagggtccgcaatgcatatcaatgttgttttgttctggttggtggtggtggttgtggtgctagtggcagtggtggttttctaaaatcctctaagtggcaagaagccgtcaaatatttttaagtaggacattatatgattatggctttttagacaaccctctggcagcattgtgaaaagaatattggaggaaatgaggctagaggtaaaaaaataccagttaagctttgtattttgtattaaaataaagatctggtaattatcttgctaattgcatcagtagagacatagaccaccaagctgataattcttatcctgactaacctactcactatgagctgagtaaaaagcagtattgatttaaatgagttatgaagagtggggcttggatatgctctttttatatcccaggggaatcaccctggaaacctagagaactggttccaagtattcatctgagaacatctgtgactctcagaaagttatgagattggagttgtacggggaaactcgctgtggccttggaagagttgacttctaaatggggtagtgaacttattctccgtggctcagttctaaaaggccctaagaggagaaaaggattcttgatgaactactaattgatgattttaggtccagagttaagcataatatggaggtttgcctgagagtgtctgccgtcagtgaagatgaattatccatgtgggcttagaaaatcacacatgcaaattatgtgtcaatggatttttttttcaacatgctaatcctagcctttgagtacacagcatattttcaaagccaattttgcaaacaactctatggtaaatgctgctaagctgttgataagttggctttccatttgtaagcctattagttcagaatcttctgaagtttaattcaaaatgagataatgtgtagtgatttgacagttttcattctgtgacgatgctcttcaagaaagcatcttggcttgttcactagttgaatcctcaccagttcctgaaattatgaaatgtaaatttgttataagcagccgctttgggcccttcacaaggcagaattgtaccttatccctgagtggaaataaatgaacatctcatgtgtgtagcttctctctctctgtacatcctgactccaaatgctgtgaggcaccagaaaatgtctcctgaatctgattttgggtggctggatcaatgtccagagggaattaggaatttttccaatggtggtacagatagaggtgataacattagaaaagactgacccttgacaagacccacattagtgaagtcgttattcccaaggagttgggtatgtacttcccacgtgttgtgaaaacagggctctattaccttgccagcaataccccaaaggcagaggctgtatttgtccttggatctcagtctttgacattgttttgggaaggtatgatgagaggcatgaggaaacctcatccattttgtgagtccagtgtacttaaacggtagagactgactccagggcatttggagttcacagaatttgtcaaattatttttcaagcttgtagggttcaagacttccccaaatgtatttttccaagtgcttgtaccctggtgtccattaagggaaatgtactccatatgtttctaattcttctaccctgaaatgatcaaaatattatattgctgagatctctgaagactagaaagatccttttcaattttttttttctctttgatgacactaacagaaatgggtgatcccagtaatcacaaagaggctcaaattcactcccaaatgcccggccaccaagaagctttggacataagtattttttgggggtatttgtgccaactgctgttttaggacatgtttctgataatgctttacacttaccagaaaagctgtttttgaaaaatccagtgttgtcttacaatcattaatttaaaaaaaaaaagtttcccaagtattttcttagagcaaggagatctctttctgatgaagaatacactctagcctaaaaagccacttaggtggaccagtttctttgattaacaaaagttacaaaggggaaaagaagagtgttagagaggatacctgtaacaaaaagagacaggagacatatggaacactcgtggtgtgtcacccttatttgaaccctcattcaaacaacaactgttaagaaaagtaaaacataggaggcatatatcaatacagaatggctatatgatgatattaaggaattattctttttaattatgatattgataattagctattttttgaaagatacctccttttatagatacatgctgaaatatttacagaaaaattttttaaaagcctggaatttgtttaaaaagaatcagggtgtggtatagttaaaactcctccctccctccatctctccctctccccctctctccctctccccctctctccctctctccttttctccttccctcactcccttttcttcttttttccctcccctcctccttcccctcctttctcccccactgccccagcttctcttcccttctgttctctttttctggccttcatttgggctgacaagaagaggatgcatgttttatatcaggttggcaggtatacttgagatatattgtcttggcaatacaaaggcctgacacttcctagggacccagatgggtattgtagatgtttagggcatgccttgacctctgagtagccttcttgggcttgaggtctcatttgactagactaccactccacagtcagccactgtggtctgttttttaaaaacgttgccatgatgagaatgtgaaggatttgggttgaagttaaggacacttcctttttattattagtctggagttttaaaggagatacctgggatcccacccttactttgttactttgatttggagtcagcccttggctttgagagtgtgctgtgatattggtctgatttaatcattgcctatgtagaaaaagagattagatcactggatcccaaactagcctcagaaagtaagtcattgatggcaagaatcacctggagagattttcagtttaattcttaaaaaatttagtgacgatacttggataaccctctgggaattctgattcagtagtcctgggtagaaatagaatctaaatatctgtaattttatcaggtttctacacgattctcatgttccaatagtttggtgatttaccaggttcaatgccttttaatagattcagttgctcaggagcagattgaggttgtatttccatatagtcctaccttgtaaaaaatggatgtgtcaagttttttgttggtgttattgtttttaattgttattttgacttgctgggctgggcgtggtgattcacgccagtagtcccagcaactttgggaggctgaattgggtggattgcttgagcccaggagtttgagaccagcctgggcaacatggaaaaaccgatctgtactaaaaaactggaaaattagccaggtgaggtagtgcgtgcctttagtcccagctactcaggaggctgaggtaggaggactgcttgagcccaggaggttgaggctgcagtgagctgtgatcatgcgctgcactccgatttgggtgacagcgagaccctgtctcaaaggaaaaaaaaaaaaaaggttacttgcttatgaataagaccttccatatagcagttattatataagcactaggtaaatattaataaatggcaaatactaaaaggaaagacaggaaaaggaaaggcaactgatatttattgaaggcctactattatagtaaacttgactcataatttatattttcttctttaattttaaccttggcatgcaatgattattacccaattttgtattcagtaaaattaaagcccagagaagtttagtatttttcctagagtcacatagtaaacacgtggcagcaggggtgtttggatactattgtgccaggcagcctttccgaacactccagcctatttctcaattctttcttggctccagaggattgtgtagcaggaggggaaatctgttcagagatcaggaaactggaccaattgggcaagctgccagagcttcctttactggattgtaccagcaagtttgtttttctctgtccaatactgggtaaaggtcccaccgaaagcctttgtctctgctcagaatgcctggtatgatctctgggaaactatttggcaaaggagtgtggcagctgaagcacagaagcctctcctaggtggttcacccatatctgatttttttttctttggcaccttgtaacagacctgagaatgttgaaattttgtgccaacgtggacaccattcagcatgtcagatttctctgataccgtgaagatcaatatgttggatgcaaaggaaaagtcccagcaatagattccagccctcactgccacttacctggtatattacaacagcctccatactggtcttcctatctgcagcctgtcctctgctttccggcccacttttctcagggggatcctctttcaaataaaggtctgattatgttcctccaatattaaaccccttcagtgactccccagttcttgaggaaaaaatgctgagtctctgagcatagcactgaatacccttcctggtctggccctgtttctccgcatgcttctcccactccacccagcttctggcaggtcatactaccgtggctcaccaaagatgccttggaaaccaggtactttcatgtctctgtttctccagctggagtttcgttccttctttgacctgcctggcaaactcctatgcattctttgattcctactccttcatgaagcctttcagcagtttctttcttagcacaactctaccaccttgtctcacctgttcacagacatctgcctgcctccctctctaggctatggtgccctccaaggggaggcaaggtgttgttttcaaatcattcacagtacttactacataggccacttacagtcagtgtgtaataactgaaggaggacttgagtgaataggcaaataaagatggttaccatgataggccgagatctgaaaagaagctaataatcaatgcatgaagatgtgtgaggaacttgtgtgtcttcagtaccattctaaataccatacaaatacaggtgccgccagagtgcttgcacatggcagcttcacagcccatttgagaagtagaattaatacatgtgaagaatgaggccgggcactgtggctcacgcctgtaatcccagcactctgggaggccgaggcaggcgaatcatgaggtcaagagattgaaactgtcctgctcaacatggtgaaaccccgtctctattaaaaatacaaaaattagctggacgtggtggcacacgcctgtaattccagctactcgggaagctgaggcaggagaatcgcttgaacccgagaggcagaggttgcagtgagccaaaatcgcgccactgcactccagcctggcgacagagtgagactctgtctcttaaaaaataaataaataaaataaaagaatgagtaagaaaaccaagaaaatatgcaatttagttcagcttgtttggtgctggtaatactttatttttcatgtgtcgatttttgatctccaccttgcactgtgagctccctgaggacagggactttgtcttggcaattatgtcttcacacttggcatacagtcagttttcaagatatgtttgttcaatgaataaatggatggtaggcaccattcagtgctgtttagggtcaaaggaaggcatgatttgtgtgggttgaagtggtcaaggagggcttcacacataagccagttatgaaggatataggcattgaagaagcactaaaactggttgtgagctttactcttcagagagtcacagttttagaaaagctcttgctctattggaaagaatatgggttttagaccaaatacatctagaatcaaatttggactctttcccttatctgctatgtgatcttgagatctctgagtttcagtttccttgcccataaaatgaaatcaatattacttcccttagaatatgcttgtgagccgtaaaagcgatatcatatataaagcatgtagcataatgcctagcgtacattaggctctcaataaatggtaagtaaaagctgatatataggtatagtgtgtctgaaatacctgggaaacatggattatttggatgacgtagtaacatttgattaaatttgcatgattattatattggcacataacaattagaattataatagattccagtatttttatggccttttaagtgtgttttggggatttctatcacatttctttacttttttaacattggaaaattggaaatggatatttgcccccaaattgtctgatatatagatctcgcccttcccattacacttgtgaagggaaggcttttctggcaggaggagcataatgcgtagaggagggaaagggaaatgagctttccattttgggagaaaaattagagctactcttccagtgacaaaccgcattgcctggctttccttctgcaggctctgcctcatgcctgtgttcctatagacattggagttaaagctctcattcatggtcatgattctcgcctctgtctaattcttttactttgtcgtgtaccatctctccttttcccactgttttttccagccacctctgtttcttttggtttccttgagcatgtcaagttcttttctggcctatgttctttgaatttactgttccctttgacagacattcttttcctctggctcttttcatttttcagaaaatcagctgactccttaccctgtggtggtattggagccaaataatggaattgatttttcagtgtttattccacataattccaaggaatatgattttaagagtgttcacaattcatatttttttttaatttttgaaattgaataagtttcaaatacgaaaatttaggaacatgatacaaaacttttctctgtgcaccactggagtactgcttttgaaatcaattctctctgtcctggattacccttagagctcctgtctcctgcatggaggagggtggagggcatttaacatgtccatctctcaccccattctacctgagcttccagcaccaccacctctgggcagttccgcttttagtcagcagctcccagttcccataattttgacttctgtccttgctagtccagaagaaatggctcttctgggattgaattcctccctttccccagcagaaatggattggggcagaggaattgcggagctccatggcatagagggtcctggaaggcttgtcattagggtatccagggtgggaaggggagtgaagggaggggaaggaggaaggaattgagttgggaagagtcaaggaggatgaatgaagttgctgactgatgtctggaataacattatttcaccctcaaaaataccagtaattcaggactgaaaaataaatttcacaatatgttttaatttcaaaaagtgatagtgtatttgacattcttatccagcctggtctcacctcaggagttcccccattggagaggccatccctgaatttctaactcacaggcctcccctacgttaatatatttatgtcctcctggcccttgtttactttttacttgtttacttttgcttttgtttacttgtttacttttgctccatgaagtcagggacctgcctgcttgctccgcaatccctagaactgtgtctagaaccttagttggttgcagtaaatatttgttgaatggatggatgagatggttgtagcaatctaagttgctttggatgagattaacactgaaaaaaaaaaaaaaactggttgcctgcaattctgtcagccagtccaggcaatgctaatacagctttgattattatgatcatgattattattttgttttgaaacctttttcagaggccaagcatgctggggacttgagggacataaaaatctttcaactgattatgccacctgcaaacaggataagcctgactttctacctcacccacctcttgctatcacagatatgaatcaacgaacacacaaaaaaggttttcaattctccctttggaaagagggcacatttaatattctgagtcaggcaaggaaagactctagccacaaagacagctgggaactcaggtccatagcaggcacccaggacggaggtgaagagaaggcgcctccctgtctggtgacagcagctggggcccttgctgcctccctccccacaaaaatccagttgggaccagtgcatgctgggaatctgcctgcctgacagaaacagatggcctcaggtggtgactgatctcttggtgacactaactgcatagctgctgctttactcatgaccgaatgagacacgagatggcggaggtaagagttggttaccttgccgtctcctcctcagctgaaatgactcacattgctgtagcttaaatttcagtccaggctctctggactcggggaatttctttttgctcatgctcctgagaaccagagttctccaggaacatctgtagtctctgtcttcaatcaaagcatttgagagatgctttatttttcccctttcctctgtacctgtcacagaagggggcctgtctgaataagatggcacataatctgctgagtgcagcaacccctctgtgcagccttgaggaagaagacaaggcagtcaaagtaccttccatcatttcctggaaaatgtgtcggtagcttggagaggcagagtgggagatggaagtaacactgcatgaggagttaggtggtctatgttcaggggccagggttgtcacttactagataggggacctttagccagtcacttaactccaatggccttctgcttcatatcatctcttatgtagggtggtgggactggattaaggacagcagatagattagctgtcagtcttactgattggaagttgctgtccagagtacagtatgggggatggctgggaagcccatctcagctaagtgagaaagagcagtcaactattggtatttgccaagtgtgtgacagtggcacatctgcctgctattatgagacttgatggtcatttctgcctctgtggttttatgattccaagtgtcctgcaagtgattctagagggatcatgaaacattttctggtcttaataattactcagggatctattaacaatggtgaggaacatactcacaaccagactttcattgagagtttaccatatgtatattatatcacttaaccctcatccttacggatagggaggctcaggctcatagtgattaaatgacttgccaaggtcactcagctaataggtgatggagctggaattcaaactctggtctgtctgcctccagaaccgaagcgctgaactgccaccctatactacttcccagttggagaatacctcagtacagtaattagatgccagtgtgtatggctttgcctatcagtacacagaaatcagaaaggtgattgagagattcattaatgcctccttgcccagttcttttgagcatatcttatttgagaaaggtgcacgtgaccttgggtcagtttgtctaactctgtcagtctcagttatcttatttgagaaatggggctatagcttttaagttaataatccagataaaacatcctatagtgccccagatgtcagtagcactcagtacatgttcatattatgttgccccaaggtcacgtggctgggaattgagctgaggactgcccacctccgaagtctatgatggcaccttttggttttggtacaagtgagtcctgagtggaccacatggcagcattagaggtgcttttgaatacgaaaggtggcgtgaggatccctctcacttatgtctgttctgttgtccagaacttagtgaaaatcctggtccttacccgctagagtgaaaaaggaaggaaaccttaccattctttctgtgtacctttctctggctggggctttctctggtctaggtgtgctcagcaaatatgacaagtagcaggccactcattttgaccacgcccatgtggcagacagctttcttcactttcacgcaaatgaagtacaagacaatcacatgtatggctgcactgaatgtaaaagattaaagagaagtgatatgccaaatagatgactgggagttgacgtttagcaaagtaaatctcttggtggccctggtaaagttaatttcaataattctggttttttttttcatcttagaaacttagaggttaaaaaataataaatatacatgaggagatttagagtgtatgtggaaacagagatcttcggaggacaagtgggatatttctttatagaaagagttttccctcttgatttttttgcttggtaagtttctttcaaatcaactcaattcatttggtgctattgcttttcttttgtgaaaacgattctggggatttgatcaaaaccgacatgaaaatacaaccctcaaatggtaaatatcagggaatctggaatttgcattttctaggctaaagtaatttactggccaagtttgctgtctcctcactcccccaacacatgtacaactcttaaatctcattcccctttaggctccttctctctcagtttatttccagcacacatgcatatgcatccatgcatacacaggtgtgcacatatgcatgtatacacacacacagacacacgacacacacgtgacgcacatattttactctgtgctaataaataggccagtattggctaggctgggcctcaggactgtctggtttaaatctaagctgcctgggagatctggagtaataagtgagtgacaacaggtgcagattttgttacacccttctgaactcagcccatagttctttctttgattcttttcacccaacacccttgcttcaattgtgtccaataaattttatagctgcatgatcctgtttcagagctgaagggagatttttccctccacttggctaaatggtgcctaagtcaaaacaccacttcctgccccctcctcacactttaagaagtaataaggaataaaccccaggccataagctgttgctgggtcctgtatcttcagttttgcatgtgaagagctaattttctggtcccattttagaaaagccaagaattaacttgcagagaattagccataattggggagaaaataattacttggctttttctgccctgtgataactggagccactggcaaatctttcacagcagtgtcaacgcctacttctgtttaaaacaaagtattgcaccaggggccttgaaagtcacatctgaatgttctctgtggtacattttggtccaaaccaccctgaatattggagttggattcatttcatgtcttttttggtgtaaaatcccggtgcagggagacatttcatattacactggaagacatgaatgtcttttgcaggtgtcaggtatgctcatgggccctgcatgcatacttaaggttgggtccaattggatttttttaggagcagtctgtggtctaagctgagaattttttctcataagggcccattttcctctagcatttttctgttttgagactttgcccagctgcctctattccctagtatgtagacttaataaaaaatctcttggttcataataaacatggaaaggagatggtacacgttttccatttgctagtagaggtttacctgaatacagttggtcatatatctcagtgtcgtcagagtacaacaaaatgtcatgccttcccatgatttcagacaccactcttcagtaatgacttatctgaatatcagccctgtacctctcctgagctccagccttaagggcacacttttcattgggtagccctacctgctgacccatagacaccctaggctcaactcattttccctaaataaatttgcttttctttctgtgttttctatcatggtaaaggtgctgtgatccaataactcaaacaagaaaccttgatggcatgccttccatatccattactgttagctaagtgggggacaatctatatattgcctcagatatcactgggatccattgccctcctaactaggctccctgggtccagtcatctttgcctttcctccaacttctcccccatgtcacctacctcctcttttctctacccccaccaaaacagtacttcatacatccctagtattgtctttaaatgtaaatctgatattatttaactatttgaattctttagtaacatcccactgctggcaggaaacaagtcctaacttcctagtataaggaatataaggtccaatgtgatccagctgctccctgactctccagtcttacctcctgtcacactaccatggatcaagccccatggttccctttattctctttcaactctgtattttcgcatatgtgactttcttctgctagtaatgccctttcttaattggcctgtacctttgactcctacacttctgtattattaggctatagcactagatgtggcttaaataagttagattatttgtttatctgatagtccggacgtagatgctttccatgagatcatccaggaacccaggtagcttctgcattggactgtgcttaacatgatgcccctttctgcatgatccaaagtggctttcaaccacagcttccttcaaggcagcaagatggagaatagatgaagaaggaacacaccttctcccttttggtgctgtgactaataagaaatatatttttagtttctgttccaggtttgtgacacagagctcctaaaagccttgtaatttccagagtgatcaacattctaggagtatcttttgttgtactatttagactttgactctggttcctaacagagcttctaaatcccttggggtttcctaagcgatagagcatcttttgctttaatgaggcgactcttgggctcctggataacttcagaatgggagttggtcagaatgggacttggtcactagaaagaccatgtgatggatagcagctcagaattttcagccctactccccacatccacccaatccaccaggaggggagagaggctggagattgagttaataagcaatcatgcctgtgtgatgaatcatccctaaaaatccctgaaagatggggtttggagagctcccgggttggtgaacaagtggaggtgcctggagagggcatgaaagctccccaccccttcccacataccttgccctatgtacctctttgtctggctgttcatttgtatttgtattctttataataagccagtaaatttaagtagagtgtttccctgagttttgtgagccattatagcaaattatcaaacctgaaaaaagggggttatgggaacctccagtatgtagctgatcagtcagaagtatggaaggcctagacttttgattggcatctgaaatgggagcagtcttggattgaagccttaacctgtgtgatctgcccttactccaggtagttagtttagaattgaattgtgggacacctggttggtttctgaagagttagagtattggttagtgtgggaaaatccctcacacacgtgatgtaaaaattgtcatgagtatgcagaaaaaagtttttcccctttagtggcagtttccagagtttgtaaatatctctgcttcccaatcttttgtgcctcctgtctgtctggtactccacctctgtagtaatggcagcagcagcaattctagtagtagtcacagtggtgtttctctagtagaagctgtaatagtagtaggaagaagaggtgtaggagtagtatcagtatcataatttcccattcctagtttcagaagagattgaaaggctaagtgacatgcctgaggtcacatagttaataagtaaacggcaaagctatcgttctgactgggagctctcttacttcagagctcaccactagactgtgggtagttttcaatccagtcacactaaatgccagttatttccttacatgattacctctcccacaagattcagaacttcttgaggaaaaggacatatccaactgacctttgtatctgtagagcctagctccaaggctgggcgtatccatcagttttagacattgaaatcagggtttcttaaccttggcaccattgacattttgggccagataattctttgttgtggggctgtcccattgtgcatgacaggatgtgtggcaccatccctgacttctacccactagttgccagtagcacatatccccacccgcagccagataaaccaaaaatatctccatgcattgccagctatctgctgggagacaaaatgtccctgattaagaaccactgatttaaattaaatgaaggccaaggagccttgagtagtgttcatatccgaaaagggcattttcagaattgttcaggctgctggatctctcaaagatgatgatgtattttccaggcctcatgtgtctggagcacaggttgcctgtggtggtggctgcaatgatctcagtgtgccaggccttcacggggaataccagagagggtccctctggagcagctcttactgggtcatggagaccatctgtctggcatggtaccacctggcaaaatctctttgccttaaccaaaaatatgcttttgtaaatttcctggcaaagcaggggctgcattctgtttcctgatttctctcttttatttccagatgtgtcactggtgacacatagagcccaatgagaactctgttggaaactcaagtttctcattcttcgccagctccgttgtcatgattttcccaccgtctaagccagtgtaggttacgttacccacgtgctggttagtgcttggatgtcagttttcctttttaaattctagatctgtagcatgctttagggaggaaactttatggcttattacacaaatggagttaacccttccctgctttgcagtgtttttgttagtgacagagacatgaattcaagatctgccatttattatttgtttcattttggacaacatgcttagcttctttgatccttgatttgtttaccttcaaaacagagtaacctacctgtcctgtctacctccatgggattattattaaaacacaataagataatctgctcaaaaggcttaaactccctagtatgatttactatcagtataccttttgcacccaagaaaactctacagtatcattgttcatgggcaccaaattgtaagttcagttaaggcagactttgtgtctttttctgccagtttctaggacctagaaggtattcagtaaatatatggtgaatgacagtatgaaaaaaattgggaagtcagattctgtggttcattgtaccagtgggggctggagggaggtaagtgaatggtttgtgtggctttgtgtcatttgtatttgtgacagacattccaagcaatagcattttcaagggttcacaagtgagtgcctgcagaggcaggacacacttaacactctggcagatatgcgacaagacagggtagggaggggcccaagggaactagagagggcatacccagctgtcttagtcattttgggctgctattaaaaaatgccatagactgggtggcttataaacaacggaaattatttctcactgttctggaggctaggaagtccaagatccaggccccagtttattccatgtctggtgaggactcacttcctggttcataggtagccatctcctctgtgtcctcaaaagacgggaggagtaaatgagctttctgggatccattttacaagggccctacttcttcatgacctaatcacctcccaaagccccccccacctccaaataccatcaccttgaggattaggtttcaacacaggaattttgagggggggatacacacactgtctatattgccaacctaaagacattcacagttacacattttgaagtctctgcatcagctaaacaaaatatgtctttgggccaatttaagtcttcagacaaaaatttacaactccttattgacagagtacctaatataaatactgggacagatgcggggcagataaagatgaggtgctcaggatccggcagcagtgatagacaggaaattagtgagacaatgagaatatccaagatacatggagagcttagcccagcactgtccaatgtcctttacaaatgacaacttgtatttaatcctcacaacagcccaatgtgagttagtggatattatgtcccctgttttataatgaggaccctaaggcacaaagaggttgatattttgccagaggctttgaagccagtatctggggaataataaaatgcaacgtgtatgtccaatgacaaaggaaacacagaagccccctcttagatctcactacttctactcctgcccctccagcccctccatttgaagatccctgagggatctgaaaatgcaactttgatcgtggcacagaccagtcctgaggttggtgcagtgacatccccatgccacagaggccctgtgccttctggacgctgcctctcttgccagccttgcccgcccctcatgctctatgctccacttcacttgcccagacagacaagcactttgcccctttgcagccactctcccctttgcctgtgtctccttgttatgcagggcctttcttattcctcaggcctcagatcaatgtcacctcctcagagtgggcctttgctgcccacgctgcccaaagatggcctactgggtcactttcttctttgccacttgcttatttccttcctcacgtgtgtgcctgcgtgtgtgtgtgtgtgtgtgtgtgtgtgtgtgtgtgtgtgtgtattttctgatgcctccacttgactgtaagctccaggagtgcaaagatttttgtcacgttcactgctgcatcccattgcctgagacagtggccagcatgaaggagatacacgagaaagcaatgtgtgtgcactgagtgagcgagcacatgggaggagctgacttcatggggcagattcagtcagagagactgtggctggcctggtgtcacattggtgagaagtggcacagtcgggatttgaactgatcatgacagcatctcgcttgaatcccatcattgcctccctaccgcgctcaggttggactccctggtgtttaccatggacaatgaatcttgatgtctggcccctgtagcacttctagcctcttcaccctcaattgtctgcacatcctcccttgcccctttctatctgcactgacttcaccgtccctcagtcaccccaccttctttctttccctgctcttccttatgttctcttcccacggcaggcaccctctgcccttctgtttcatggggctgtctcttcattgtccctgaaatttgaacttcagtcctcctccccccgcaaacttcttccaagcccatggactagactagaaccccctcaagtgcccctcattgcatttatcatggttgtaactctatagttatttttgtaatttattgtcttttctggcttttctgcccatggcccctacaacaacagcatgttcatctcattcttcttctgccctggctcgttaggtaggaggtgcttacataaacgtttgtcaaggaaatgaataaatgaataaataaatgaataaattgctggatgaatgaatgagagtaagtgaatgaagagttcctgaatttgcttttatgccacctcccttctctgggaaatttcacacaggataggatttctctggcatagagcaacacttctctttgtagatctcagcctgtgcctggagactgggtaaagttgaatgacggggtgcaggaagccttgtgttgtcttgtcacaacacaggaagggaaagtactttggcttttactgttgtaaataggactaaaagtagctcttcgggggtgatctttgtttaccactgcctaaggccactgtccttggagaaaggtcaggaggtgggtgtttacaagttctgtccaaactctcccatgacactatgccacaggccctcatttccctgacccattgttaattagagcagaggaggaacttcagatgctgagtttgtctttgaagaaggatccagaccctaggatgtcatcctggagactttgctcttccttatccttcatacctggtcctccaccttcctgacagtttctcttcttcctcatggttattgggagatagaatgggtggcagatttttattgtttcctgaggagccctgtgctttaatttccattatgtgtgaagatgtctgccatgaccaccaggttgggtgttctgctagattggtgtttgggagccagttgtagacagagtcaaccagaatataaaaagtgtgagtgcagagataaacccactcctgccctataacgacagtaacaaaactggcccagtggtagagctctcatcacaggccaggcactgcgctaagcacgcagtctgcacccctttagactggcccattctctggaaagtttcaaacatacacatcagcaaagagtataatgaaatcctgtgtacccattacgtgtaggggctgaaaatgtatttgccttgatcctgctttcaaagcaatgggtctagtgactgctttgggggaggagttagggaagtgcttaactcatattaacactgatattataaatttacagaatgcagctcgctctggagattatatctggttatatatgtgcacatatcagtgattgctatagtcccctggtaaggggatatatatttaacttaaaatgttctgtttggagtttttacataaatgtcactaaatacatgaatatttcagacccccttcccagtctagagtagtattgggttaagggaactaactgttttgagggaatctgagccaatttagtctggcaggaaaatcatgtagtgaagtagtgaggcccacatggcctctgaccagtcagggagagatactgaagttttacaagagaccatttaatgagagattatccataaaacttgatgcacagatttcaggagaagtctttttagtacttatgtgtgtgtgtgtatgtgagtgtttaaatgtggcaggctaaagtgaagaaatacgactgctactgatagtagctattgtttattgagggccagtatatgggtcagttgctgtgccaggaggtcctttgactacagtctattcctcaccaaggcttttagttcattgttattaccaccattgtagatgtgagaacatggagagtttcagagagttgcccaagactattcacataacaagtggcagggctggaatttcaatccaagttagcctgtttgcaaagcctttgccctttccattagactacatagcatcttaaaatattctggctgcttacttgagaggtaagtatcagttgggaacttactcacttccttctttgtttcaatatacaacccagaatgctttacaaattctgcagaattagccagtgctcatgtttaggcatatcatagattttttaaaatggctaatgttgctgttcctctccttgtgctttggaaaaaattttcagagtccgatacctattgtgacaacttttctaaacactcaaagtgccaagttcatcttgttagctgttcttccaccaggcaatcaaaactcatgttagttccctgtggattcattatagtccccgggaaaccaaaagttttgcctgtgtttggcacataccagttaattgcctaaattgtaacttctgagtattaggaattatcttaaaaactaataccaaaatttggtatgatgtatttcaattgagggggaaaatatttggaaatgaatttattttgactctggggtaatatcttttgcttcacatttagaaatttacatactgggttacttccatgacctaaaacaacttccaagttttcttatttcctcagtacccctagctttgttctggatgaggccagtctctgttccaacgcatgatttaaatatacacggttctgcatctttgtctataatgtttataatatttactatctcatgaattttttatatctacttcataatctactctctccctctatttttccttgcacttgacagcccaactggatgttgtctcttaattctttgtcacttcatggcagtttataattctttaatgttacttattatatttcagctacactgcagtaatggatgggcccattttctctcctccagcgtactgaatgggactgtgtcttgtctccgtgtgcctgacaccttgcatggaatttgcacctcatagccgctcaatagattttaattaattgaaatttaaaagggaacttgtgtggttttgtttaaacaagaccataaattagaaacaactattttcatgaatttgaaattcccagaaacattattctttaatactgtacttttgtcgagactgaagagtttggctttatagtaaatgaaatgaatcacagaatcattgaaccagagtaacaacaatactaataaaaacaccagaaatcatctgtgtaatccattcctctctcttaatgccagacagttccccagccaccttaaaatgatagaactctcctttccttaaagatccttttaaagaagactgtcatcttttcccattccacatcatcatgtcttctagccctacaagttaggcagcttctcctcagatgatcgaaaccctcccttactgaaatttatgcttattgctttcataaagatgaaaagcagctgcttttaactgaaaatagttctcttcctaaagatggttattccattattccatatccttctcttccctaggcataattttcctttccatctgacattcctttttgttctatatttccaaaccattgaatactactctctcaacttacggttttttgcctaagaaaacttggactgggtgtgattagtaagtgatcgttgattttagatgtactgagaaatatgtctcacaccattaaaactagtcgatccagccaggctggtgggtaactggaatactgtgacctcaaatgatatgtggtggtatcttttaaagcctgccatcaaccattcccatctcagtttctccagttgcttaatttataagacataatttatttgttataaactgctttgcaaggttcaaaaaaaaaaaaaaaaaacggaaatgatacacaagagaattagattgaatttaggccattttttccccctcatatctggtttttaaataagccctaagagtgctctcaattagaaaaacacatggtaattctaaaggagataaaaaaggaacatgtacactccaagtgcacttttatcttttcatatttaagaaaccccacaaagctccttcttgcaaattaaagaggatagcaagcaggcagctttctttcctcatttagtttagcaagcatattgatttacatttgagtaggggcctctgatctcttttgtttgtgggtggctttgtttgtttttaatatgaactcatttaaaaactaagcttatggactgagttgcaaaggtagagcttcagtccaacactcaaagtagtcttcctatgcaaaaataaaatagatatttatgtatgtggtagtaggtcaaagaagacatcagtgataactattgattcagtaaatattaaacatctactatgtgtcctccttactaggaagactaaaatgtagaatgtaccatccttgcatctagtgtgcagtgtagtatgggagagagaaataatttagcaggtgatcataatgcaataaatgctatgataggaagcaattaaggcacagtggaggggcgaataacacacctttggatgaattcccagaggaattgacaccagaaggtgattaggatttaccaaggttaagaaaggtgaaggtgtttcaggagtgcgttaccaagtacagaagtgaatggaagtgtgacccattcaagatactcttgagtttgtttcagccagagaacggacaaacaagggaaaacttaagtactctatcctgggttcctcaggatgcacactttaaggacgttttgcgtttttctctggtatttatttattgaagttctcagaacctccacagagctaatttctgtagccttttgtgctcccataaagctttatatatgtacccacatttaaaactttcttacaatactttttgcatttcctccatatgtctattttcccatctactctctgagctaatcaagggagaagacctagtactcacgtctatctatctgcagtgccatgctgagtgcttgcagaaatgtgtttgggaatcagtgcatctctctatgaatggctagagcattctaagtggttttgcttctaactgtgcaggagggcacagtttgggcccaatattggtttgcaaattcaagataagaaccaagaatttgattcttaactcaattttatgttgacttgagcaggctgaactgggttgcttatgccattatttcatttagttcggataatggctatcaaattagctgacaacccatctcagttccctgtagtattcttagcagtgtcttaaagtgggttttcatttgaacatttctttattatattttctttctcagaagtagccaagagatgatgatgatgttgatgctggggaaaacaatggtaacaagagcagctgctttttattgggtatgtgctatgtgaattaaccctgcacttaaccttttaatgaatttatgagataattactactgttaccttcttaacagatgaagaaaatgaagagcaaggaggatatcttactcactagtgaatgatggcttcaccatgtctgatccaaactgtactttgtaatgccttcttcatagcagcactaaaatctaaaagtctggaagagtctttaggagatcagttattccatttcacatctgggggcaggattatgcttgaactgaatgccttggtccactgcctgaaatgtatcctctacaacctttgtccacctggtgaactcctactcatatttcaggactcacaattcaagctgctactcccaagtgaagcttccttaatattcccaggtagagttgccctcttcctctgttgttcctcttaaatatcttgtatttcactcatgaaattcaccaatcatgcagagggtatgtttctagaggcagtttgtatagttgtgaaaggtatggactctgcagctaattgtttgggttccaactctagctctacccgtattagctaaataatatggtgctctcttcccctgacagactgttaatcccttgaggccagataatatttacaagaatttcttaaatggctaagtcacaaaattgtcatgttttttaccttaatagcaagtctgaatgtatcctccttctgaagagctgatgtattgtttctgctggtttctgcatcttgatccctgaaagatattgaaaacctaattttaaggccattttcctgtttgtttgtttttgtttttgtttttgtttttgtttttgttttccatttctgtttcctttccctcttttcctgtccttccttagagacaggacatcttgaaaggtacgaaatcttcaggtctgtacttctacttcaccaacttccttttaatgtttttacctctttgtcttgtgtggaaaatcttaatctgactctttctgctttgtgtcaaagggatactgttcatgttaaaattctcagctctgagaggtatgtgagtaggccgttccttgggtgatgggacagttgacatcatatctgagaagagcatcaccatggtgccctttacttatggccgttgtcatgatgacagtcatagccacctggagcacagtggcctgacaaagacaggaataggaagagggaaataattcgtccaacacttttgtattttgcacaatgggaaaagagtggcatcatttctagatcctaaaccaaaattgatagaaaaagaagactagaatgataagatctgctaaatattctcagggggttgaagtatcaaatatctgcagatggtatcactgagcaaaatcaaggagagcagtttaggatttttagtatgagggaaatgataatgcttttcagtacttcttagagttgtcagtgtctcataaaagataaagaatatttgttgagtgaccacaacttgctgggtactgggctacactacagtatagtatagttattactgagaatttgtagagataatcctagcttatcaaggaaatatttgttttataatttgttcaggtgcttatttatattgaagaatattctcaagttaagatgatttttttagatactccagaggccagaattaatcataaagggccctaatagccaaaaagaattgaaatgcactaggccaattggcagacactatttcagtctgctctctttcatcctttgccaggaattgtacattatctctttaaggcagagcagccttggatgaccatatattaatatgataacttgcttttccttgctccccaccccccaactagtggctttagaatagctttgctatttttcacttatttcttggcagtagcactagatcccaggcttaccgattatgcacactttagataactttgggtcagctcagtactgaacaaatggcaagtcaggaatgccattaagactgaagaatgttggaagataaggattatatagacaccactgtccttatacacactgtgttgtcctgtaattggataggccaaaatgagttgacactggaagaggtattttaatattggagcttataaaatgtttagaaatgttttcctatctgagtcagactgagataggtatgtatgttttctgtctcttctgagtgacactgggaaatagttatgattgggaataggccttggtaccaataacctcatatatacactagggtagaccttgcagaggaagctggcaccagggcatgggaccgtgaagcaaaggggttcagaagaactagagagtggtccaataatgagtcttcagatggccagaggcaaaggctgagatcaagcctcaggtccaagaagccagaatcataagcctgaaataattgagtgagaaacccaacattactagaatggagaagaggctaggggaaaggcaggagcaaacccaagggctgggggtctgaagatgttaccatcacaaggcagccccattttaatggcctctagccacagggtttgccattaaaaactgtaggagtagacagatgcttgatggaaacccttgaccccgggtctttgctcccttaatgaaggaatctaaggcaaagtagagattctttttttaacatttaaactttatttttaattgacagataataattgtacatattcatggggtacatagcaaagtttccatacatataatgcatagtgatcagattaattagcatatccatctcaagcctttttcatttcttcgtgttgggaatgtttaatatcctctttctagtgatgagaaactgtataatacattattgttaactgtagtcatcttacagtggtatagaacagggctccccaaccccatggggttctataccactgtaggatgactagggttaacaataatgtattatacaggtactggtctgtagcctgttaggaatctggctgcacagcatgaggtgggcggtgggctagtgagcattaccacctgagcatcacctcctgtcagatcagcagtggcattagctcctcaaaggaacaggaaccctattgtgaactgcgcatgcaagggatctaagttgcacgctccttatgagaatctaatgcctgatgatctgaggtggcacagtttcatcccggaaccttcctcctcgcaacccccacccatggaaaaattgtcatccacaaaactgggtcctggtgcccaaaaggctggggaccgctggtataaaacagagtttatttctccttatctagttgtaattgtgtatcctttaacagatctctccctatctttttacatgtcctttgataccataagctctatggacaccctataatatttcttcattatacttacccttcatagtaattactagagtgagctcttcatggatttttctcttttactagactctaagctccacgaaggaagagataatatctgtgcctggtacatagtaagagcctaataaatatttttggaaggagggagagaaagagggaggagggaaataaatggctcttttgctccttttcttcatgccagggcaacactcagcttctgaggtatgcacagcaaggatcttgctgagatgggtgtggccacttgcttgcctcacttccagccctgggcacatgcagttctttctacctggtgcagtcctcttcctccctgctctggcacttgcctctgcttccacttctgctgctgcttctttttctagtctcctgcagcctaatcatcctcttgacacattctttctttaaccatctgaatgccttcagtatggttcctgtgagctctgaatgttctggaagccattgttttgttttgataattttgaatattttactcttgctcattatggattaactttacagctgaactctcaaaaccagacttcattttcccaacttgagagaacatctcattgttgtccctgtgtccttgcctatggcacacatctcccgaacacccttttttaccagaacatcctcacagcaaacctaaggcagctaactgctttctacagctctgtgtttcttgacctcttccatctgttttattttcatatttttcctttgttaaaaaaaggagataacagacaagaaaaacacgagaaattaaatacctcaaaattactgtacattttcacttggagtaaccagtctttgtaatgttttgtaaatatctttccctgagtgggcctgaataagcatgtagttaacaagcatggacttttaattgatcagggcaggttttgaacttctgtcctgctctttcctaatgatacaacctccaatgacttaacttctgagcctcagtattctcttctgtgaaatggaaatactaataatagtatcctcacaagtttgttgtgatattcagtaacccacataaaatttctatgcataatgcctggcgtataataggcactaagtaagctgtcacttgttttctttactttcctgctttctctcatattgcctctaattagtaccgtccttattttttaggggacagatccaaatccgtgaatccaggggcttcatcacgatcttggaatattttggtggcaactttaagatcttttgttttctgactcttagatctctttcttttggtggcatgggaaaattccctcaactcgattatttattcagttctttcatgctccccatattgtcatggccacgtttgaatcatgttatcggcaagtctgaccgaaaaagcaatttaatattgccctgtgttgcatcattgcatatattatttcagcctgtcacgggcctgtcagcaagtcttgatgaagtacagagccaatagtaacaggcctgaaatctgacagctctttaacagaagctgctccgattggtgcagtggtatttcttcagaaattaaggccttcttggtctctttgttgatacaattagcaatccaatctgagtcattttatctcccaatgagctgtatcttcagggctggtaattcagtctgttgcatggcttggaaaaacagagccatcagaggcctgtgatgtaccaaaggctgcagccaggaatatcttggtaatttatccccactctcagctctaattattctgttcttcactggctggttcgattgagactctccaggttcagccttccctaagcagagaacaaaaggtttcccttgaaagttggggcctggcaatgtcagtacagtgagctgcgtataaataatgcagcagtgccggcttcatttttataaaatcttggtggagaaatgcatgagaatgatcaggcccctggaactcagcaggcatgtgcttttgatgtgcgccttgctctgagtaaaagcaggagaataaaaagttcttgtttgtgctgaggctacttcatggtctctggctcggattttggtgaccctttcgctttgtttctgatagagtctggaggctcctacctaactaggaaaactctgatatgtatatagagggaaataccttcagtaactattttctgattgaaactaaagatgatgaaaataaagatggtgattatagtagctttacttatattagctttacttacattccctcattttaatcttcctaaggttagagttatctggctaggctattttctctataccttctgctctcccaattagccttatatcttttcttttttctggtcagattccccaaaaataaatattcagggtgtgaacctagcagccaaagctctgggagctgagtcggggaaaggagcttgagggctggcctgcaaaaaagcagatactgaatcagtctctttttgtcaagatactctacccttacctggaccttttatcgcaccctatctaagggtggatgctatggtttggctgtgtccccacccaagtctcaccttgaattgtagctctggtaattcccatgtgttatgggagggacccagtgggagataattgaatcatggggctgtttctcctcctgctgttcttatggtagtgaataagtctcacaagatcagatggttttataagggggaaacccctttcacttggttctcctcctctcttgtctgctgccatataagacgtgccttttaccttccaccatgatggtgtggcctccccagccacgtggaaccatgagtttattaaacctctttttctttataaattacccagtctcaggtatgtctttatcagcagtgtgaaaatggactaatacattggaccttagtacttttcttccgtagtgtgggagaagtagtaccctggttgctaatagtgaggtcacatgggatctaattacttcctaaacatactttttgtaccatctgctgtttttagcctcatttttatcctcactttcaggggtggtgagcaccaccacctcctgaactttttgggtctctgtagggtaatcattttgcttctgggtttttcctgctgctatttaggttttacctttctcaagtctaccaagagagttactactaccatggtttttggcttttagattttcgatgctgtcatcttctatcctgttctcattgtgggtttttgcctctttgaaacattcttgtacaaccattttgttggaatttttaaagggcacagagttcaacacgtgtagtcaatctggcatctttaatcagaagcctctttttgtttttgtactttttgaaataggaaagaaggtctgctagagatctggcatgcatttgtgtcttgggcagtaggtggtgggaggaatgtgaggtaggcaaaaccaggagagcattgttggaaggctctcctggttccattgaggttaatggtctatgcaaggaacccagtgttctgcttcatgcactccaggagtctaacttttgtctcttctccagcctgcatacagagcagtatctaaagatctaggctttataatagaagccattaaaaaatgattaggaacctgaaagcttccttctataactgagatctgaaggtttttattcattcacttaattaacatgcattgtgctctcaaaatttgccagagtagcattgtgcttattcatccatataactggatgaaaaaggcagatatggaccctgctgtgggaggttgtggcctgaccttatatactgaaatttccagaaggccagatagagcatcaagaaataaaataaaataataacattcttttatgataatgagatagatccttcagtgcctcctggtcttccccactcatacacactcatgcctaaaatagtccacggttctggactcctttagtgggccagatcctttcatcaccatgggctgctgagaccactggaatttcaggcaaacctataaaacaggggcagctttaggtgaccacattctgtcatgaatccttgatttcatatacagtttttgcattacatgtttgctagtcctaggccaaaacaaaaggagaaaagatctaattttagctgagttcgagttgcctttctaaaaattatgatttcttctttatgagtctttttggtgaattgacccttttctcaatatgtaatgtacctgtttattcctggtaacatttcttgttctgaagtctactttgatattaatatagccacctcagcttattatttgtatctgcatgccttatctatttatttattttttgagactgagtcttgctctgtcccccaggctggagtgcaatggcacaatctcggctcactgcaacctccaccttccaggttcaagcaattctcctgcctcagcctcctgagtagctgattacaggcgcacaccaccacgcccaactaattttttttgtatttttagtagagatggggtttcaccatgttggtcaggctggtctcgaactcctgaccttgtgatccacctgcctcagcctcccaaggtgctgggattataggcgtgagccaccacacccagcctgcatgccatatttttgcatctttttactctttatcttgcatttttatattgaaaataagtattttttgtttgttttgttttgttttgtttttatccaggcactgcgactcacctcacacctgtaatcccagctactcacaaaactaaggcaggatgattgcttgaggccagcagatggagaccagcctcagcaacatagtgagacccccatctctaaaaaataaaaaaaagaaaaagtaatctgggcatggtggtgtgtgcttatagtctcagctacttaggaggctcaggtggcaggattccttaagctcaggagttaaaggctgcagtcagtcctcatcatgccactgcactccagcctgtgtaacagagtgagctcttctctaaaaagtagaataagtttcttttaaactccatatagttgggttttatttttattcagctttattatctctgccttcgcactggagattttaggtcatttacatttattggttgggttttaatctattttctttttctgtcttccatatattctatataattattcccttttcctgtattctccagattacttaaatatttgttagtattccattttatctctaaaaagttttacctcttgccagtttctaatatgcgtctttcacttatcacagtcgaccttaaaataattttgatgcctcattatatataatacactttcatatcttcctgtgatttgtgctattattctcatatgatttgttcatgcattggattgtataaagatttaaattcaatttttttaaagaaatttatgtctgttgtatttactcacatatttagcagttctgatactcttcattcctttgtgtgtgttcacatttccatttggtatctttaacccatgtagtttctgcatgaattataaagtattctccttctccctcctcctatatgagtatacagaattgagtttgttgattgtattaacaccctttaattccccagtagtaataataatagctattattactcttatagtttacatgtctcttcacattctgaaagtacaatcacatatttaaatagaattgtcttttttcaaatgctttttaaattttagaagctcttgtttcatatatttcatactacattgtttggttcataaaatattatgaatggtagttttcttggattgagcattttgtcattatgaaatattcttcttttccttgttaaatatttttgatcttgattctactttgatacttatattgtcatttaaaaatttttttgtttgtatttgttgtagaacatttttgaaagaaaactgaatcacattttaaaaaatctgaattataaacaaggtatatagcttaattttaaccacagtatgattaatcttatcttttaactggttgtggaattcagcccattcacatttgatgaaatactgagataattgaccttatttgttccatcttattttgttttctatttatattacatcactccccattccctttcctttttgttttgtgtggtttattggtttcactggcttgttaattttttctttattcccttttattccttgttactttgagagtcctactaagtgttttgtttctactagtggttacattctcattccttataaccaacaataaacttatgttctgcctaaacatgtatatgtatttcaaggaacgttttctgtgtaccccttctctagactcttacttaatatttgcttacttaatgtttattttcagttccagactgttactaagttttttttgttgttgtttgttttttttttgtagaacagcaagcctattgtattttaagaaaactcaatattacagattcctgcttacattattattatccacttagatttcaatacgtatatgcatatatttttatgcatatatgtatatgtttaagcatattatgcacatacatgcatatatatacatatatgcaggaaagagacacacagagtgagaaagggtctcagtgtctactggttcctctagtctttgatttccaccatattgagaaagctgctctgaatcaattgttatttggttatactctttctcaagtattgtcctcagacagtgcttatgagtttactttttgaatccttgtgtgttgaaaatgttttttttgcctcttacagctaaataatattttgtctgggtataggattctttaatcagtttctcgtaatagtttgtacattattctagtgtcttctacattccagagttgtagatgagaattcccttagctaggattaatcctttgtaagtaacctattctttctgtctggaagcttgtataattttctgtttactcttgaaattcaagtgtttcctggatttacttcctggacttaatgagacttttaatctgtgggcttaaatcttacttcagttcagtataataaaatacctagccctgtattcatttaattacagtatctccctcatttgttcttttctttttttttttttattccttttctctctcctaaaaaacacaaaatctgttctggaatttctgttattctcatgttaggcttctggaatctgtcctccaagcctcttatctcttccatcattatgtcaatctctttgtatctttgctacttgtagtagcaaagtgggagagatggtgaaatgaatgagcaaagacagttactatggtaaattaagataaagataaagataaaattcagatgtcatatgtcatatttcatttacttggtcttccagagcattaatttgattttcattagtgtcagtgattttttagttcttctgtggaaattttaaacgtaaaatcagtatttatacttccagaaagaattttttgcattcttctgatttctcattgttttcatcattaaaagattctaccatatttttcatcatttctacttctgtgggacttgcctcttgtagatgttctatgtggtctctcaggtgaactactcccattaagttagttaatgtttttgttttgcctactcattgataaatgctattttgactttcatataggtttttagtatctattctgcattaacaagtctgaaagcagtgaaaggtacatcagttcctgccctggcacttgggctggcagtcacccaaccggccaacagcaagtggccccttctttcttcttagagcacccttggtggaagcagcactcctctctagctgccaatcttagaagcaactcagactgccagtgtagccctgactctgtagggcccctatctctaattctaattttacaaacctttgggtgggggtgactagtaggtacagcttgcctaaaggtgaatagttatccaaagagggcaagttgctaaaacacttcaggaaatgtcaaaactggtcttaatagaagactcccggaggggtaagccctttgttctgctgctagtaccttgcctttacccactaataatatgaacaaagtcctatgttttctttccctcctggagagttttggagtacctgtggcttcaattgtactcactaaactttaccagttctgctgcttaatagcacgtccatattacccatcagtttgatttaaagaaactcaatgaattggaccctaatattgtttgaataatcccaatgaaggagggagttgccagaggcatctgtagccataaaacttctgtagtcatcttcactccaggcatactctcttattttaacttcttgtaaagaccaagacatccctaactttccctttattggggaaaaaatctgcttggaaaaacttagttatgctgtgaagtgttgagtttttaaactattgctgtattatgaaccacaaccaatgcttgttagtttaatacagtaatcatttatttgactcatggacagctcatttaggctgtgctgtcctaggtgatccttctggtctcagttggactcactcactggagtcttggctgactgatccacgttgatccaagacaacctgggggtatctgatccagattgagctcagctggctattgccctgctccatgtttctcttatcctcctcatgggaccagtggactagcctagaatgatctcatggcagtgccagaggtgcaagagaacaagcagaaacacatagaatctcttgaggctcagactcggaactggcatgcagttacttctgcttccttattttggctaaattcagtcatgtgacagaatcagaagtcagaggtaaggaatcagaatcagaggtaggaaaggaagccctgcctacaatgtgggggacaggaggaggagggtgcagtactacaaagttacatggcaaagagtgtgggtatgtggagacatgaagacttagggccatgaactcaacctttatcagctgttgagaaatacagtgcaatattttaaacttacaatggtacctcaagagagagagccacgagtttagcttggaggtagtagagaaactttcacagaggagctgacattggaactggaccataaggacaacctggagtttaccaagcagacaaagataggtgaaaggagtaataatccattaagatggaaggagaagtcaaagtagaggcccagcactctacagacaagaatgggacatctggggatttaggagttaccctgtgtgattggatcattggaaacaatccttctatactgccttttgctccctaatattactcttgccagggagctatcgtacctccccaaaagttggaatttcagatgtcatatgccaggaggagttagcatattgtatactcttcagaacatgttacataggtgggctgccttctccacttattagagatgtatgttgcttaaaaaaccgtgaataatttagcatgtttctagaagtgcttgcattccttcagtatatttatgccacttagcatagctcaatgtgttctgtgatctgtgccacatgtaaaaaaatcattaatgataagtgacatttgttggctttcaaaagacatttaagcctcactcagtgctacctcctctatgaacccctccttgatatttcctccctgtctcccaccagattatgtcaggttcttctgctaaaggctttcatttctccctctacttccttcagagtattcatggctgtttgttagtatatgattttagttgtgattatttgatcaatttctgtctccccaattaaactttcagcttctgtgactgcaaaagactagatattttgcataccactggtttcctggatcctagtatagtgccaggatcatagtaactgaatattaaacatttattaagtgagtgagtgaatgcatgaatctatgtgagtgactgaatgagatacatctagactattgtccttgtgagataggttttgggttatctttaaaattgcatgagctcccaggtttaccatttacctaccatgtaatggacaaacgattcattctttaatgtttccattcagtcagtgttcattgtggcttgtcataatcctgaatgtgaatgaggtatttgtgatacagagaagagtaaggctgattctgggctgacggagttgctggtttagtgggagagatggtgaaatgaatgggcaaagacagttactgtggtaaattaagataaaggtatgtccagattggaacttggagaagaagcttttcactcagtctgcccttcattggggcttcctgaaaaaggacaatctgagctgagtcatgaaggctaactaagagttagatgcataatggggatgactgttccaggaagaatgaagcaaaagggttcagtacacagggaagtgggaaatcaaggctcactatagcaaactccaaataattcagtattgcagaatgagaaggcaagggtggggatggccagaacggagtgactgtggagatggacacagtcatatcacaaagggttctttaagccctgctgtgcattggactttgtcctgaagttagagcgtagcaattgaaggatcttaatcagagattgacataaaatattttattttataaagtttgccctgggtacaatatggagaacagattataaggcaataagactgtaggggagcaatatgaagaagcagttacttacccagcatgataagggctatggtagaagacatactccatgctctgggaaatcagaagaggagtgcctaacccagaactggaatctcagcctaggctaaagtaagagtttgaattatcatggtgaagaagctgggatgagttttcccaacagatgggggtagggcaaaggcactgaagtatgtcagaacatgactttcttcagagaactgtaagtaactttttattgttagactacagaatattaagggtaaattgagaaatgtagctggaaagcatctagcgttcaagtcttcctcctattaaatattgccttagactgggatgaccatactctttattatctccaccagacactttaaaaacttttttttatcatagaaacttttgaacatgtagcgagagtagtataattaacacccatgaacccatcactctgtcccaacaaccacccatgaccaatcttgcccttagccacatgccatttacttctccttctcatgttgcttaaagcgcattccagataccatgtatcttatacaaacattttcagtatgtatctctaaatgataaggagccttttgttaacataaccacaactaccaatatcatatctaaaatttcataatttttttatcaaatagcaaggttataatttctaattatctcacaaatgtcatgtaaacgtagatgtaaatacgaatattcatatacagattgtttaatcaggatccaaataaaggactgaaacttttttttttttttttttttgagacagagtctcaccctgttgcccaggctggagtgcagtggcacgatcttggctcactgcaagctctgcctcctgggttcaagcaattcttctgcctcagcctcccgagtagctgggactagaggcatccaccaccaagcctggctaattttgtatttttagtagagacggggtttgaccatgttggccaggctggtctccaactcctgaccttaagtgatctgcctgccttggcctcccaaagtgctgggattacaggtgtgtgccactgtgcccagccagggctgagacttttgaaagtgaaggaaggtactatccataattaacaggtatccatggagactttttacctaagcagggatgtgtcattatctacactggcttattccacttctttaatacctctgcagatacctggacgggtattttgcaaaatataaaggaagcctcactcatatggtcagttctatctatatctcttctattttcttaggtctctctgctccctggtgtgtaagtggacatattcagcagagaaaggctgggacgacagtttctggaaaatgattggtttggaagactttgttgcagataattacagcaaaataggtaaaagaataaaacatctgtagagtgattatgtgcattggaggatcttgatgggtttgttgttattgtggtttgtatgtttcttgtttttgtatgcatgaaaatacaggaatgaagttcactttttccaagacaaatgagttaattatgatgggtaggccatgactagtaggctcttgccttaagatttatatgaactgagtagagatacatgctatgaaaatctgcattgaaatatagaatcagaaattgcgctgggcatggtggctcacacctgtaatcccagcactttgggaactgaggcaggcagattgcttgagcccaggagttcgggaccagtctgggcaacatggtaaaaccccatttctacaagaaaaatacaaatgttagcctggcctcgtgcatatgtctgtagtgtcagctactccggaggctgaggtggggggattgcttgagcctgggaggcagaggaggttgcagtgagctgagatcgtgccactgcatgcagcttgggcaacagacagagcagaactctgttttgagggggaaaaaaaaatgggctagactgaggaagatatttgcaaggagcagcttgggaatagcatactcaaggggctgtgtatggactgcttccagtcagtactacgaaaataattttacaaattaggttcacaggacaaggcaaggctgtgaacaggtaaaaaataaagctaaaagatcaatattagaaaatctagaaaaaagcagaaactagaacgagtcagtggctcctaactaaggccttagggtctcagactaaggccttttatgtgggtggtaaagtacatcttctatgtcccaagcacatttctctgtgcttgtatgtaccttgttttatatatttctcacaactactgacaaaagcactgttgcatgtttacagatgagaatcagagagattagtaaccttgcctaacctggcatggaatcaataaatggtaagtcaggatcgaaattctcccaatgggaggacctagaaggaactaatattttactggaacacaaatttcagcttcagttacctaatggtttaagtgatttgtaaaatgtatatgccctccaaaaaattagttgttttttgctgaatattcccatggtatgttgttaaacatagctttattagtgtatatattgattacctgtatatgtgtcttgattcctcactagactgtgagctgtttgacataaggattttcacttatttacctttgtatttcctgtcctagcacaaggcatggcatattttcatatctcagtgactttttgattaaaatattgagatgcttggtactaggaggttggcactctttcctttaaaaatctgtaatgatatttactgattttaacattatctttggcaattgggtataacttcaactctgattttctgattatttttatatttttctgctcctctttcctgcctcacacatgacacatgtttaattagtatattagctctgctaacgtagcagtatctacaagaaatattcattagaagtccataatgttaatctagcagaaaatttccagagtaactttattagattttttccctgttaagttaatggatttttaatggatttcctaaggagacatatcattaagcagaatattgctgtacgtgaattagaacttacccatttatcaaaattaattgtgtgatgtttcctttgattttcgcttctggacacttgagcttgtagtttcagtctgaacccaaagtagaagatatttaagaggctgtttattctcagttgtgactttcagaaactcctctggaagctacctctagacattctttagcaattcttggaactatgaaagatgaatctcagaagcctccctatgaagtgttaaacatttccagtggcctcattgcccgtcaagatgtgggcaatatagtgtgaaaccttttagcagatttgagcattgagcgtcctggatttgagcattaatacaattaccataatttgctccatgtggagcttttagccaagcctttaccaggcttcctgggcccatgcagtaaataaatgctttccctgaaaactgaacacctcagcaactgatggtcttatggaggaatatttttaaaatgaattatttatgaagtgtaagttaaggatcaaatgcaatatttatatggtgcatttcaaggacaggagaaaaaatttacagggttttaagtaataacatgcaagtttctaaagctaaaatgttactacctaatgccttctttcaaggaggtatttggatggcttggtttgggaacattcacaaagtaaggaaaaatagttttgtgcatcaaaagaatatagtagaaatttctttacaattgaatagaaatttctttacagttgaaactgtacaagttgacttaatgttcagaattgatggagaaaaatgaaacagattttgggtaggagattatatagccctactgacaaaatgatctgtgttcaatgaaatgatccaacaaactgatctgtgtcaataaattttgacctttaattccacatgaataattccccagttacctatctaatcctaaacatctatcaaaagcaaacaggaaggaagagatcagcagggagaaaggaccttaggaagataagcaacatcccacctgttctaattgattatccaggtgccatttcagcatgccgcggttgcctttttaattcctgggaaaatctctttgttctactattggggtagcccactttatgaaaagtcgtgtgtgcaacatggctgaattatagagtgattatctgcattactaacagggtttgtcatataaagggattcagtgtattagcttatagatcattcctttatttgggaccagggaagccaggcaaagaaaaatgtaaattccaagtccaggaagttagtaagtgttaagtgagaggcagaaatgaagataaagggcaggagacagtttcttgagtggagggaggctgctttttaaatgggtttcctcgacccgggaagcacaaggggtgggggagatttccctttcctagacaagggaagccatgacagactgtatctggaaaatcgggacactgccgcccaaatactgggcttttccaacagtcttagcaaacggcacaccaggagattatatcctgcgcctggctcggcgggtcccatgcccagggagccttgctctcactgctagcacagcagtccgagatcgaactgcaaggtggcagtgaggccaggggagaggcttccaccattgctgaggcttgagtaggtaaacagagcagctcggaagctcgaactgggtgcagcccaccacagctcatctaggcctccctgcctctgtagaccccaccactgggggcacggcgtagctgaacaaaaggcagcagaaacctctgcagtcttaaacgttcctgtctgacagctctgaagagagcagtggttctcccagcacagtgtttgagctctgagaactggacagactgcctcctcaagtgggtccctcacccccgtgtagcctaaataggagacacctcccagtaggggccgactgacatctcatacagctgggtgcccctctgggatgaagcttccagaggaaggatcaggcagcaatatttgctgttctgcagtatttgttgttctgcagcctccgctggtaatacccaggcaaactgtctggagtggacctccagcaaattccactttatgaaaattcctgcagctgaggaacctggctgttagaaggaactctaacaaacagaaaggaatagcatcaacatcaacaaaaaggacatccacaacaaaaccatcatcaaagaccaaaggtagataaaactataaagatggagagaaaccagagcagaaaagctgaaaattctaaaaaccagagcacctcttctcctccaaaggatcacaattccctgccagctacggaacaaagctggacggagaatgactttcacgagttgacagaagtaggcttcagaaggtcggtaataacaaacttctccgagctaaaggaggatattcaaccccatcgcaaggaagctaaaaaccttgaaaaaagattagatgaatagctaactagaataaacagtgtagagaagaccttaaatgacctgatggagctgaaaaccatggcacaagaactacgtgacacatgcgcaagcttcaatagccaattcaatcaagtggaagaaagggtatcagtgattgaagatcaaatgaatgaaataaagcaagaagagaagtttagagaaaaaagagtaacaagaaacgaatgaagcctccaagaaatgtgggactatgtgagaagaccatatctacatttgattggtgtacctgaaagtgacgggaagaatggaaacaagctggaaaacacatttcaggatattatccaggagaacttccctaacctaggaaggccaacattcaaattcaggaaatacagataacaccacaaagatactcctcaagaagagcaaccccaagacacataattgtcagattcaccaaggttgaaatgaaggaaaaaatgttaaggggagccacagagaaaggtcacattacccacaaaggaaagcccatcagactcaccacggatctctcagcagaaactctaccagccagaagagagtggaggccaatattcaacattcttttgttttgttttgttttgttttgttttttattttattgtattttatttttttcttctattattattattatactttaagttttagggtacatgtgcacaatgtgcaggttagttacatatgtatacatgtgccatgctggtgtgctgcacccattaactcctcatttagcattaggtatatctcctaatgctatccctccctcctccccccaccccacaacagtccccagagtgtgatgttccccttcctgtgtccatgtgttctcattgttcaattcccatctatgagtgagaacatgcagtgtttggttttttgtccttgcgatagtttacagagatatagatcaatggaacagaacagagccctcagaaataacgccgcatatctacaactatctgatctttgacaaacctgagaaaaacaagaaatggggaaaggattccctatttaataaatggtgctgggaaaactggctagccatatgtagaaagctgaaactggatcccttccttacaccttatacaaaagttaattcaaggtggattaaagacttaaccgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctggacagcaaaagaaactaccatcagagtgaacaggcaacccacaaaatggcagaaaattttcgcaacctacttatctgacaagggctaatatccagaatctacagtgaactcaagcaaatttacaaggaaaaaacaaacaaccccatcagcaagtgggcaaaggatatgaacagacacttctcaaaagaagacatttatgcagccaaaacacacatgaaaaaatgctcatcatcacttgccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggctctgttcacaatagcaaagacttggaaccaacccaaatgtccatcaatgacagactggattaagaaaatgtggcacatatacaccatggaatactatgcagcctatacaccatggaatactatgcagccataaaaaatgatgagttcatgtcctttgtagggacatggatgaaattggaaatcaacattcttaaagaaaagaattttcaacacagaatttcatatccagccaaactaagcttcataagtgaaggagaaataaaatcctttacacacaagcaaatgctgagagattttgtcaccaccaggcctgccttacaagagctcctgaaggaagcactacacacggaaaggaacaaccagtaccagccactgcaaaaacatgccaaattgtaaagaccatcgatgctaggaagcaactgcatcaactaacgggcaaaataaccagcttacatcataatgacaggatcaaattcacacataacaatattaaccttaaatttaaatgggctaaaggccccaattaaaagacacagactggcaaatatgataaagagtcaagacccatcagtgtgctgtattcaggaaacccgtctcacgtgcagagacacacataggctcaaaataaagggatggaggaagatctaccaagcaaatggaaaaaaaaaaaaaaaggcaggggttgcaatccttgtctctgataaaacagactttaaaccaacaaagatcaaaagagacaaagaaggccattacataatggtaaagggatcaattcaacaagaagagctaactatcctaaatacatatgtgcccaatataggagcacccagattcataaagcaagtgcttagagacctacaaagagatttagactcccacacaataataatgtgagactttaacaccccactgtcaatattccacagatcaacaagacagaagcttaacaaggatacccaggacttgaattcagctctgcaccaggcagacctaatagacatctacagaactctccacccctaatcaacagaatatatgttcttctgagcaccacattgcacttattccaaaattgaccacatagttggaagtaaagcaatcctccgcaaatatgaaagaacagaaatcacaacaaactgtctttcagaccacagtgcaatcaaattggaactcaggattaagaaactcactcaaaactgcacaactacgtggaaagtgaacaacctgctcctgaatgactactgggtaaataatgaaatgaatgtggaaataacgatgttctttgaaaccaatgagaacaaagacacaacgtaccagaatctctgggacacgtttaaagcagtgtgtagagggaaacttatagcactaaatgcccacaagagaaagcaggaaagatccaaaattgacaccctaacatcacaattaaaagaactagagaagcaagggcaaacacattcaaaagatagcagaaggcaagaaataactaaaattagcagaacggaaggagatagagacacacacacaaaaaaacccttcaaaaaatcaatgaatctaggagctggttttttgaaaagatcaacaaaattgatagactgctagcaagactaataaagaagaagacagagaagaatcaaatagatgcaataaaaaataatataggagatatcaccaccaatcccacagaaatacaaactaccatcagagaacactataaacacctctatgcaaataaactagaaaatctggaagaaatggataaattcctggacacatacaccttcccaagactaaaccaggaaaaagttgaattcctgaatacaccaataacaggctctgaaattgaaacaatatttaatagcctaccaaccaaaaaaaagttcaggaccagacagattcacagccgacttctacaaagaggagctgctaccattccttctgaaactattccaatcaatagaaaaagagggtatcctccctaattcattttatgaggccagcatcatcctgataccaatgcctggcagaagcacaacaaaaaagagaattttagatcaatatccctgatgaacatcgatgcagaaatcctcaataacgtactggcaaaccgaatccagcagcacatcaaaaagtttgtccaccatgatcaagttggtttcacccctgggatgtaaggcggttccacatatgcaaattaattaacataatccatcacataaacagaaccaaagacaaaaaccacatgattatctcaatagatgcagaaaagactgacaaaatttaacagtacataatgctaaaaacttaataaactaggtattgatggaacatatctcaaaataataagagctgtttatgacagacccacagccaatatcatactgaatgggcaaaaactggaagcattcccttggaaaactggcacaagacagggatgccctctctcaccactcctattcaacatagtgttggaagttctggccagggcagtcaggcaagagaaagaaataaagggtattcaattaggaaaagaggaagtcaaattgtccctgtttgcagatgacatgattgtatatttagaaaactccattgtctcagaccaaaatctcctcagctaataagcaacttcagcaaagtctcaggatacaaagtcaatgtgcaaaaatcacaagcatttcctatacaccaacaacagacagacagagccaaatcatgtatgaattcccattcacaattgctacaaagagaataaaatacctagaaatccaacttacaaaggatgtgaagtacctcttcaaggagaactacaaaccactgctcaatgaaataaaagaggacacaaacaaatggaagaacattgcatgctcatggataggaagaatcaatatcatgaaaattgccatactgcccaaggtaatttatagattccatgccattcccatcaagctaccaatgactttcttcacagaactgaaaaaaactactttaaagttcatatggaaccaaaaaagagctcacattgccaagacaatcctaagcaaaaagaaaaagctggaggcatcatgctacctgacttcaaactatactacaaggctacagtaaccaaaagagcatagtactgctaccaaaacagagatatagaccaatggaacagaacagagccctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaccaaaagccaaaattgacaaatgggatctcattaaactaaagagcttctgcacagcaaaagaaactaccatcagagtgaacaggcaacctacagaatgggagaaaattttcacaacctgctcatctgacaaagggctagtatccagaatgtacaaagaactcaaacaactttacaagaaaaaataaaacaaccccatcaaaaagtgggcaacggatatgaacagacacttctcaaaagaagacatttatgcagccaacagacacatgaaaacatgctcatcatcactggtcattagataaatgcaaatcaaaaccacaatgagataccatctcacaccagttagaatggtgatcattaaacaggaaacaacaggtgctggagaggatgtggacaaataggaacacttttacattgttggtggtagtgtaaactagttcaaccattgtggaagatagtgtggcaattcttcaaggatccagaactagaaataccatttgacccagcgattccattactgggtatatacccacggattatacatcatgctactataaagacacgcgtacacgtatttttattggggcactattcacaatagcaaagacttggaaccaagtcgaatttccaccaatgatagactgaattaagaaaatgtaacagatagacaccatggaatactatgcagcaataaaacaggatgagtacatgtcttttgtagggacatggatgaagctggaaaccatcattctgagcaaactatcacaaggacagaaaaccaaacacggcatgttctcactcataggtgggaattgaacgatgagaacacttggacacagggtggggaatatacaccagggcctgtcgtggggtgggggaatgggggagggatagcattagaataaatatctaatgtaaatgacaagttaatgggtgcagcaaaccaacatggcatatgtatacatatgtaacaaacctgcatgttgtgcacatgtaccttagaacttaaagtataataaaaaaaaaacatacaaacctattatacttttcccttcttaaatttatccctttctttgatcttacatttccctgtaggctacatcttgttactgtaattccttttattatagagttactacaataattgtcttttactgcctctacttcctatgatgacattacagttacactttcttccccaccactgtactgaaattaaaaaaataataataaaatggatttcctccatccctatgagactgtactttgggtgtcagatgacaaaaacacagtcacttggcacattttagatactgatgaaatattcattgaatgagttaatatatgtttgaattaaggatttgattttttttaagtcccttgttggcttcaattgtttctttcttgttttttttgttttgttttgttttgtttttttttgagatgtagtttctctcttgttgcccaggctggaatgcaagggcatagtctcggctcactgcaacctctgcctcccggtttcaagtggttcttctgcctcagccttccgagtagctgggattacaggcatgcgccaccatacctggctaattttgtatttttagtagagacggggttgctctatgttggtcaggctggtctcgaactctcgacctcaagtgatccgcccccctcagcctcccaaagtgctgggattataggcataagtcaccgcgcccgactggcttcaattgtttctaaaccacaatggactttcgtaaattttttgaattaaataatactactagctaacaggcaatgaatgtatttccttaattcagtgttcactgtcatctttcatgaacaccttctacataagacgggtccctgcagaagatacaccctatgttgagtgatagtgcaattctatttcattcctgtagcaaatctctcagagacttttctatcttaggaaatatcacagactccttcacagaaggaaaacaagaattaatcttagaaaggttgggcatttcactttttcatagagtaaaataaactgaacattaaatgaagctacactttagatatttttgtcatgtaggctaaaaatttgtaagtaaagaatcttggctgggcgtggtggctcacacctgtaatcccagcactttgggaggccgaggcaggtggatcatggggtcaggagatcgagaccatactggctaacatggtgaaaccctgtctttattaaaaatacaaaaaatcagccaggtgtggtcgcgggcgcctgtagtcccagctacttgggaggctgaggcaggagaatggcgtgaacatgggaggcggagcttgcagtgagccaagattgcaccactgcactccagtctgctccactgagcaagactctgtctttaaaaaaaaaaaaaaaaaaaaaggatcttgactaatgaactaatgataggtatatgctggggacataaatgtgccagtgaacagagccacctcaggcaagggtgcagtattggctttggtcacactgaatcaaagttcagggatcttctgcctcttgttggaatctggctagactttggaacctgcacaatactgacttatccacccactggctggccaagaagctgagacaaagagaaaagaagccacctatacttgcctgaagcaagctgcacttgatcagattgattcatgaactcagagcccacaggcctgagtacaggtggctcaagaagaaagtattagttcttttctgctgctataacagaatacttgaggttgggtgatttataatcagcagagattaattcagctcatggttctggaggctgcagtgcccaagggtgccgataacttctgggcatctgataagggccttcttgctgcatcatcccatggcaaagggtgcaagagtgtgggactgcacacacaagaatgagagagggcaagagggggcttggctttatcagaagtgcctcctaagacaatggcattaatccattcatgagggcagagccctcatggcttaatcacatcttaaaagtctcaccttttaatactgtcataatggcaatgaaattttaacatgactttttgttttaatatgctgagcttttattcatatttttttttaacttttaagttcaagggtagaagtgcagttttgttacataggtaaacttgtgtcatgggggtttgttttacatattattttgtcacccaggtattaagcctagtacccgttatttttcctgatcctcttcctcctcccaccctttgtcctccaccctcccaaaggacccagtgtgtgttatccccctcattgtgtccgtgtgttctcattctttagttcccacttaaaagtgagaacatgtgatatttggttttctgttcctgtgttagttgctaagaatgatggcctctagctccatccatgtccctgcaaaggacatgatcttgttctttttttatggctgcataatagtccatggtgtacatgtaccacattttctttatccagtctaccattgatgggcatttaggttgattccatgtctttgctattgtgaacagtgctgcagtgaacatacatgtacatgtgtctttataatagaatgatctatattctttggggtatatacccagtaatgagatttctgggtcagatggtatttccatctttaggtctttgaggaatcgccacattgtcttccacaatggctgaactatttcacactcccaccaacagtgtatcaacagcgtttaagtattcccttttcttcacaacctcaccagcatctgttattttttgactttttaatagccattctgactggtgtgagatggtatctcattgtggttttgatttgcatttctctaatgatcagtgatgttgacctttttttcatatcaatatgacttctgaaggggacattcaaaccatcacagagatacatgccaagccttcatgaactccacttcaggactgtggccccacttcccatttaacacggcctcatggatactattatacaatcttttcagtctcagggatccagctaagtgattccttctcccatggatggaataagggagattataaaagcaggaaatgggagcattcacaccaatactacctcattttaggggaaagaagaggaaattcccttttgtaaacaaaccatagaggtttccaccaacaacatgcattatgtccagtgctggaagcctgaatccagtgatgccatccatagttgtgggtgttgtaaaatccttttagagcaattaatattcaatgttctgaatttttccagtaaaagtggacatgtttacaaggattcatgtcttcattctttatagtgtgtggcttgtttttcattttgatttgaatgagccatataattcagttatttctgtcctcagagctttgctgaagtgctgcttcatctttgtatcatgtgatataagtgccaattttactaatttatattgagagctctggagaaatctttaactacaggtaatcccagccttttctaggttaaatggggcccatcacaccattacctcccctctcctgagggaggcttatatggtttgcctctgcatccccacccaaatctcatctcaaattgtaatccacacatatatcaagggggagacttggtgggaggtgattagatcctgggggctgtttccccaatgctgttctcttgatagtgaaggagttctcagagatctggttgtttgataaatgtttggcattttccctgcttgttcttgctctctcctgccttccttccccctctccttccaccatgattctaagtttcctgaggcctcccaagccaggtggaatggtgagtcaattaaacctcttttcttcataaattacacagtctcaggtatttctttatagcaatgtgaagatggagtaatatagaggccatccctgtgggtactctggactgagatttgcttttgcctgtcaccctgagcttttgatcttaccttatcctcttattatccttctcttccctgtctaagtgacagaaccaggtcttcacagtacttgaaggcaagtacctatcctctgagtattgatgccttattttactctttagtatcgaatttctgcctgataaagaatgacttggaggtctccatgccagttagccatccatccagtcatgcatccagccaaccacactccccaagtgtctcctgtgtgccaggtgctgggctaagtcctagggatacaaaagtgaattcatcatggtctatccctttggggatctcatgtctactaggggtaggggcaggtaaatgaatcagtaatctcaaggtttttcagtaactctacagatgtccaagatgccatggagaagcagagcaggcagtcactggcactggtggtggtatcaaggaaattttctcatgaggtggcattttatgtgtctggaaaattggagtggtagtgagaagtgacagcgtgctggcagtcctcacagccctcgctcgctctccgcgcctcctctgcctgggctcccactttggcggcacttgagcccttcagcccgccgctgcactgtgggagcccctttctgggctggccaaggccggagccggccccctcagcttgcggggaggtgtggaaggagaggcgcgggcgggaaccggggctgcgcgcagtgcttgcgggccagcgtgagttccgggtgggtgtgggctcggcggaccccgcacttggagcggtcggccggctccaccggcccagggcagtgaggggcttagcacctgggccagcagctgctgtgctcaatttctcgaggggccttagctgccttcccgcggggcagggctcggaacctgcagcccgccatgcctgagcctccccctgttccgtgggctcctgtggggcccgagcctccctgacgagcgccgccccctgctccacggagcctagtcccatcgaccacccaagggctgaggaatgcgggcgcacggcgcgggactggcaggcagctccacctgcagccccggtgcgggatccactgggtgaagccagctgggctcctgagtctggtggggacatggagaacctttatgtctagatcagggattgtaaatacaccaattggcactctgtatctaggtcaaggtttgtaaacacaccaatcggcaccctgtgtctagctcagggtttgcgaatgcaccagtccacactctgtatctagctactctggtggggacttggagaacctttgtgtggacactctgtatctagctaatctggtggggaggtggagaacttttgtgtctagctcagggattgtaaatacaccaatcggctctctgtatctagctgaaggtttgtaaacacaccaatcagcacccagtgtctagctcagggtttgtgaatgcaccaatcaacactctgtatctagctactctggtggggacttggagaacctttgtgtctagctcagggattgtaaacgcaccaatcagcactctgtcaaaacagaccactcggctctaccaatcagcaggttgtgggtggggccagataagagaataaaagtaggctgcccgagccagcagtggcaacccactcgggtccccttccacactgtggaagctttgttctttctctctttgcaataaatcttgctgctgctcactctttgggtccactttgcctttatgagctgtaacactcactgcaaaggtctgcagcttcactcctgaagccagcgagaccacgaacccaccgggaggaacgaacaactccagacgcgccggcttaagagctgtaacactcaccgcgaaggtccgcagcttcactcctgagccagcgagaccacgaacccaccagaaggaagaaactccgaacacatctgaacatcagaaggaacaaactccggacacgccacctttaagaactgtaacactcaccgtgagggtccgcggcttcattcttgaagtcagtgagaccaagaacccagcaattctggacacagtagtttaccagaaaagaggggaaatggcttccaaggcagaagaaacagtgcaggcacagacatggaggcatggaagagtgcagagtgtgtgtgaactgttgggtgtggccagagcatagtggacctgaagcaaggtggagaggagtagttgtgggcaagatagagtttatggggggctagtttctgatggaacttctaactttcctcaaagatggggccaccgattagagactcaacatggcaggagtcactctattcctttcaagagatggttctaattactactcctgccaatgcagtaaataacacttgagggcagtaggagccattttagaatatttgtggctcctatgaagctgtttgtgtgtcggggcaggtggcaagcccatttcttttcttttctaaagtcacataccttgccccttagctatcctcccttccataaaggtttgttgtgaagctggaatgtgatatcagatgtcacagggcagtgtggtttacgaagcctgtagaaatgttcttaccaactgtaagtacaccttggcacctggaggacaagaatattcactcctgcatcactctgttccaactgtgttcacactccttagattcgcagaaggactgttttcagctgctggcccttccaggaatagccctaaagagccagaagggcaaaggagtaacattgaccacatcatggtgatacaaggtaataactttcagaggttttgctgtggaaatgttcctcctttcaatacggcatctgaaagataattggaagtcccccaaaagtgaggtcacccccaacttctcttcctactgctggagaatcagcgattgtcagagctgaaagggatcatagagattttactgtaatgcactcattttatagacaaaaaactgagactcagggatgtgaggtgaatttccttggtcctgcagcattttaatgacagaaatgagaccagaaaccaggtcttctgactcttagtcctgtggtggttctactccttcctgccacttctcctgtttgagttttttggcaatgtgaggacatttagccaatctggatactgacatttgaatgaagctaaccactagaagaatgtcaaggagggaacgatttacataggtaaatttacccaatccattgtccaatcttcagtcatgcaaatgtaggaactggactttgcccaagtcagagacctttggatctaggaacacactgatcaagcccttaagtgactgatgtagataaacgagaataaataagtaataagttcacagttgcctatggtaatagttaagagattggtcaccagggtcagatggacttgacttcaattctgactgtcatctgtaatgaaatttctgccatatgtaactttgggtgagttacttgatctttctcagcctcaattagtatattatgaagattagtaagtatatcatgaggatgaaaggtaataatgcaggtaaagttcctagcatacaataggtcttcagaaaatgaaagttcttactactataatgattgtccattcctctgaattcagatttctctctaggtgatagattatctgccaaagaccataaccccttgaataatcccaggtaattattgccaacttctagatttggaatttttccttttttctgagcttcttccttggattcacacaacctttttccaaccaagatacaataagattaattagatttctgcttctaaattataatcacatttcataatcacaaaccttccttgagaggcatcttaattggaattaagggttttcctgaattcgtcaggtccacatgactggcaatctttagctttttttccatgaatagaggggtgcatatccacaggcaaataaaaaaaatacaggatatgttggttaacaattaactagttaattaataatggctaatgttcctacagtgctttacaacttagaagagtttttcttttcatgcactattgtgcttttttcttccaccaaacttgtaaaataggtttgatttcagttttacacttggggaagccaggattgatgagctttggtcttttccatctcagtagaaggtgtcacaattctccctgtcattcaggacccaaacctagaagtcattcttaatgcttctcttcttcctcttacaccttacatttaatccatcaacaagtactttctgctttgctccaaagtggacccggaatgaggcattcctgcccctcttcactattagtatcgtagttcaaagtagttttatttcttgctggatttgtgtgctagcctcttaaatggtctccctgtttctgtccttccctctgataatccattctccacacagcagccagagtgatattttaaaaatgtaaatcagatcatgttactctcctgcttaaattcctccagtggctccccattgcagctgggaaaaaaataactccttgccatgttcaacaaagtcttgcgtgatctctgtctgacttttattgcttaccatgcccccacgtagtcaccatccaaccacaatgaccttctttttgtccctcagacatttccagtgtatatagcttttgcgttaactctgccttctgtctggcatggcccttctcaaaatattcacatggtctacctctttctctttgttcagatctcagcttcaatgtcatcagagaagagctttcccttaccacccaaacactctcttctactccagcagtattctgtttccctgttgtattttattcttaacactcatgactatccaaaattaatcagtcttgtctggatgctttataggtattaactcgtttaatgcctttaaccagtctagacaggtactactatattcattttactgatgaggaaattaaggaaaggagaggttaagtaagttgctcaaggtcacacagtaagtaatggaatcagagacaggtctgctccagatcctgcacatctgtccatgtagctgcagtctcctggcctgggctgcgctgatacagctgcagttctcagactaagttcaacaagagtcccagtcctagtccagtgatgcctgaagtcacatgtttcattctgggcctcacattcatgaagaccactgacaaaaaggccccagggccccagatgaaaaacataatttaaagccagtgaatttgagaagcagttgagcagttttgggttttctcatcaaattacctgcccaatgtcaaaatattagtaaattatagatctagattttaattgagtgttgtctgacattcccttcctcagtgctgacttgagattactcaagatgacagaagaaaagtgctgcctcagaggttctttcctccctctctgtctttgaaaaagcacagggagaagagggctgaagatgtgactgtccagtaattggaaccatctcggctcctctgaaattctaggagaagaataagtgaacagtatgatatcttgcaaagcttcatgtgccttaatcacattaaaattcacaattcagttttggatttatttttccttgttttttgaaagttattgacttgggacttgcttctggatctcagttggacatctgacctcatgccattattgtcatccatttagaggtcatttatttcagtgttcttgaaaggcagccattcccagtggttggccttctctattgcatgtgacacatcgcagctcttctgcttagcttttcttggtcacacagctatcaggtggtgactttggcctccaatgtggcccttacctctgactttgtagctcctctgcagtactcttcactctggttctgtggagttttgactccgagatacccatgaccttttaagtttcccagcaccagctaacctttctgagaatctgcatcagagggctgcagtggtcagggtggcaggtcaccagttgactaatggcctcctccaaggtttgctggcagacactgcgttgccatgaaccctattgatcccagaagtttgcctgctgcttagacagtctttgcgggcgtgaggaggtagtgagtcatggagccaccacccctgctacccatctgttcttgtggtgaggagaacaaagatgatctctttgtggtatcataaaacctagaaagacattaaaaattccgttaaattttcatacgcttttagctgttgaaatgtacaatctattatgaggggggaaaaacccactgtaattttccccccactgcccttacttcagaggctacttaagggaccaggtaatgattttacgatgtttattaatacttcatgttctgcttccctcccccattcatttatctttaaattgaaagcacagaaactgccagggatctttaaaatccagagtttttgcaatgtcataggttgttctgttatggatattgtatgtagagatctattgttgactcagagctggggatggggttgggggtggtatttatttttaaaatgcactttggagtaatggaaataacatgagttttggagccagatatacatgagtttgaatcctggccctgccatttactacctttgtgaccagtatcaaacaagttacctaacctccgaaggccactcagttcaaccacttgccagattgggaaagtaatacctctctctgagaatttggatgacctcaaacagagacctctcaatgcaggcctcgtgggaacaatcttatcttatccggatatccagataatttttagtttttcttagttgttctgagtaattacttttattttctctgtctctcgtgggtatcatgtggagtaactgtcaagatatccctcacccctttggttgcttgagaattgacagcatattgaagcctcatctatagtagatttataaactatggtataaagctataacctcacctcaatttattttgttcccatgtttggtttatttaatctttgatcccacttacctcattttatatttgcctactagttataagctgtctgaaacattttataacatagcatgtagaaatatgtctggaacatagtaggtactcaatagatatttggtaaatgaatgaataagtaagcattagagatacagatacaatatgtttcagaggataattaaataaaagagggcaagataatgagtttgtgcctttgagatatccaaataaaaacatagagtagacatttggatctatgctaggaaaaaaggctagaaatagagatttggaagtcataagtgtagatgatatttgaagccatagatatgtgtgagagactctagagggagaagagaaatttcagtactttagaggccaggtagaggaagatgtgcctgcaaaggaggctaaggatgtacctgccaagggcagggagataatgaggagattttacaaggggagggaacaatctccaaggatgctgaaaaaggaagggagataaggactggacactgttcatttgatatagtgactcggggaccttagtgaaagtcacttgcttataatagtgaggcagaagataaaagtcgtacagcagccacagctaacactgagcacagatgctgtgccaagtgcttaatgtggactgttacattacaacaacatgagatgtgtagtcatctcaccccattcccattttttacagaggataaaaatgaggcataaagaagttaatcacccaaggtcatatagctgggttcaagccaagacaggtgtcaggactcagagtcacagttgagaaaatgaagccagaaagtttagataactcaagaaatttggtcagagtgtggggggagagagagagagatggggtggtcactaggggaggaagacggttggaaataggtagagtgttccactgtttggttgattgattgttggaagatggagatttgcttgagcatgtctgattgctgataagaagattctagtagtgagtgatgggttgctgatacccagagagaagggagaatcagtactgtgggtccagagaagacaggcaggattagccttggaatacagactttctattttaataggtaggaagaagacaaaaatggtacagctcatgggagcagcatgtgctcggaagtgggaagttaagggatttcccttcatgaggcttctgttttctttgtgaagtaaaaagtgagatgatcttctgacagagtggtagccaagtgagagagtcagaatctgtaaaaaatggaaaaggtttaaaatagaagtacagaggatcggggaaaagatgattagagaaatcttggaggattatcaaacggtacacagaaccctgcttaggggtcgccatgaatttattataaatctgccctgtggtgtgattttctccagcagcactcagcatctggttgtaagcacacaggaaagggttgttcttttgttttattaatcttaatgaatagcagtagtctgttctgcaagtccttgacaccaccctcttttctatatgctgtatctaatctgttaccaagtgctgtcagtcttaggctccaaatacgtctataattcatgaactctttccacctcaaaatgctacctagcctgtgttcccataatctcgcaactggattattcaacaggcttataacacttgtcattgaatggaaacttgcctttttcagtccatcctgaacactgcagccagcatgaactttttataatgaaaatctaatctaatcctgtgacctcccagcataaaccttctcaagtcttcccaatgcttttagggcaaaaaccaaaaacccgaattatggtctcccctccttctggcaccactgttttcattgatctctgacctcagttgccctcttttggttttctgcacacgacacccttctcaccgcaagatctgctctcatggtcttgttttgcttccagtatcgagtccatgttccaggaagaaggacaaggacaaagggcaaaagtatggactttgcttctgttccagtgttaactctgaaacctcactcggtctcttctgcctacatgtcaatggccagaaccgtattacatactactacctgcaagggaagctggggaaaggtccattttttgccagtcacatttcagccttcaataaaatgagagttgtgttatttaaaaagaagaggaggaggggcactaggtaagcaacctggagtcccaccttcaatgaggaagtgttttctaggtgaagagttgagtgaaggagatgctgacagaagtgacagcatgaatacagtttagtgctgagcaatatgatgtgggaagaaggtgctggaacactgagtttgaggcagggaaaagggagggaggaaacagagaagtaggcagggatcaaaaaatcataatgcccttctattccagctgaggaacttaaacttcatcccgtgtgttagcctctaaatgaggtcttatatgccaggtgatgtcaagcaagatggtctactgggtatagacaaaaatgttggtatttttatttatctccatttttatttcattttgtttaaattctatttttaggtatgcatcttgacatacacacatataatttataagttcaatagtacattatatacaatttataagtaatagctatgttgggagtccatctgaagacttttttcttagtgacttgcacagtcaaaatgtttagaaactattgcattaggcatcagggaactgttaaaacattttaaacaaggaaatgatgtgatccaaattgaatatggtccaatttgccttttctttcccctatagagttctttaaatttttaaaaattttagaatgttagtacttagaaagaaacattagggagcatcaaccctgtgtcataagtaagataactgaggcccaggaatattaaataattagaaccattaatttgtggctgagctggagccccatccaacctgggtctcatcttctcccagtggtcctttgtggccctgtgcgagtgctttctctcttcctgaatgcatgtccctattcttcagcaaatactcttctcatcagaattatgacatgtgggaatcaagaggggagtaaaagggcatatttataaaaaacgtggaaaccaagaaatctgttttgtaaaaatgaatcacctatttagcctcagggttctgttgactctttagctgtcaacatggaagtctctaggtaccgattcctgcaggttctgttttcataatgccagacccatcagcagtttaactgagacataccgttgtacaatgtcattattttaggtattgtatttgcaaggccagcggtctaagtaagagattaaactgaacagatttctgacttggtaagacagagactttctaaggggtacactgccccactttatcttaccccagtgtatatgaagaaacacatgtttacccatgggaatgtgtatgtatttggatctatttcacagagtatcttataaaaaccgacatgaaaagaaagtctgatttatagaatcctatttcctgacattgtgaatactagttcaggactttgctaactactttttgaccagtgtgactgatttatttccccatgccatcatcaacccagctatgcaagtacaggaagacagggtatctaataaccagatggtgaacaagatctgtattctcttgggtatactaagctattctgaaaattcagtttataggggtacagactaagggttatatatctccaaacaaatgtgtttgtcaagttgatgatcatgtttaccaagatccttttatcaccagctgagtcctcttttagtggcttaggtcaccctggaattatttcaaaaaccagcctgatgtttagaacctcctgtgggctcgggcttgccagacacaaacctaaaatgaagcctgtagccttcatggtagcaaactgtaacctcaagcacaattatatgaatcatggacaaatgttttcactttcaagcaagtttttgccgcagcaaaaatgaccacttatctaagaggctgcatatttatatatatataaacagtttttggacataagaatcttgactattatttcccacagagaattacagatttatatatgtgtgtctatgtgtatatatatgtgtgtgtgtgtgtgtgtgtctgtgtgtgtatatatacatatgtgtgtgtgtgtgtctgtgtgtatatatatatatatataaacaccatattctgtgtcttttatatatagtatcacttgattattataattaccatgaagtgccattgttcttctcattttataggtgaggaaactgaagctcagagaggtgaaataacatcacaaagctaagaggttgtaaatttggcacttttaaaattatctagttattacaaaagttgatcttcagatcaacaaacttaactgacatttcctttttgggccccattttctactctgtgaactgaggaggattgaattcagtgattctcaaaccagagcatacgtcagaaccacctggggggattcttaaaacactgattcctgggcctgcttagagtttctaaatcagaaattctctggagcgattaagaactggtgtttccaataagttcccaagtggtggttcccagccacactttgagatccattggagtagatgatctctcagtgtcttccagctgttacatcctggagggtcagcaacctgccatacttcattggtgtgtgaccaaaaatactgcttcttcatggagtgactttcctactacttttgccaagtttgttggttagccaggaaaattctcaacatgaatggaggaaaatgctgatgaaaatcactccttcctgtatttattaactcatttgccagactaatatttactgagtataccctttgcagatattgtgctacatactggagatagcacatgtgaagatactcagcccctgcctgcgagatgcctatcaactatggagaaaacagatgattaatttattgttattactaaaagggaagtgctgagacctatgagaataaaatacttctctaggatttgtgattatgacttcaaacttttcctaaacaggactattttctactgtggtcttaagtcataaattgtctattctctgtatctagttcgattctgttcttagctttttgaggtatttctttattgggacaggtcagtaagtggcattttcatttattttttaccaacctaagcatttccttcctgccctagatgaaaacttagctttgttcaaaatttgcattttcatttttagcctatggtgacagtttaaatcaacagcaaaagcagaaacccttgtctaaagcaatttcctcactgttattccaacttcagtgaaatgagaagtcctggggagatgaattcagactgtcttctctactcccaccccttctcctaacagtttggcttcttgaaaaaaaataaaagatgaaggaagcaggggtcttgaagggaagatgtctactgtaaaaaaaatagggaaaggaaatagtgtactgataatggttatcatttgttgagtgtgcattatatgccagggactgtcgccaaacattgtacatgaattagcaggtaaacttccccagtaaccaatgaggtacaggtaccattattatcttccttttacagatatggaaattgaagctcacagagggtagataactgtcccaaagtctcatggttatttgatggaggaacaggaattcaaaagcaggcctgactccaaaatctcatgctttttaccagtaaattagatctccagtcatttcaatccctgcatttttcatagggatggtgctgactcatttggcttcctggttttctgactcatctcactgaacagggccagatccgatatgtcttctgcattctcccttatatcatctttctccctgctcccttttctattatggtccacctactctatcatcttctttccatgggccttaaaggaataccttcttgtggactgtctctgtgatgcagtagaaatctggtaagcttgccagggtgtaaaaagtgcatttgtttaggactgtaatgtttatttgaaagggactttcaatcacagacatgacttttttatgagcctcattatatatccttgtgattggaaaaatgcatcagtaaataatgcctccatgaagagtcactctcacttgcattattttaaaagatttggtaataaaaagtactcagattattgataatccataattaatatgaagtaaataatgtgtgttttcaaataaaattcaccatgataagtgatgagagtatgggcttttatatttctttgtaagtcagagacttataaaagataggttatccatcactaaggaatatgtagacacattaattttagcattcagttttttttctctcttttctaaaaaacatgattctattcttcaaaagaaagagtggttttattatttttccagctctttaaaatggttcaaaaatcttggcctgcagacatctttttaaaaaatcaatttttcaataatttagagtgaatcacacccataggggggatgtgctttcaaaataattaaagtagaggaggcaggattatagatcttgagaaaatgtgcttggaaaatgtcctttgatttgttgtgaaccccaaagctttgaataaaataggataggactggaatcaacttctgaactttctcactagctagtggcatgttaccagtagtccagagaatgctgaatgcccatctaatctacactgtcatcccttttattaacaaaacttaggcttttagggtacatcagggtctttcattatagactacatttcccagctccctttgcagctacacatgttcatctaagttttggccaatgaggtataagcagatgtgtcctgtgggattcctgagacgtctcctttaaggagatcaggcagtggccatcctctttccctcccctgggtcaggtagattggctggtcaggtaggttagcagtgactttggataagggggacagacgccatactccagggatggcagaacagtgagcttttgtggaacttccataccagccttggattcactacctctggactttgtttgtatgagtaggaaatttgtttatttgtttttgctgttgtttttgctttattagaaaatcactgttttgtagatttgtagctacacttaatcataactaataaaaatggtgactcataaggtttgggaaaacaacagttaaattaaggtagtaagtttagctatcattattgagcacctactatttactaggaactgttctaagatctttatttgtaatagctcacataactcattcaacagtctttctaagagacttacccccattttacagatggtcagtcacagagaggttaaataacttgcccaagatcatacagccaagccaggagttaaaatcttcagtctatctcttaaactttctgtaaatcactgtgatgaagtgacttgacaacattctaaaaacaagtaaaactggacctaaactccaacttttccctatgtaggatacctgtctcctagacttgttgctaattatgttagttggcctctggcacatcacttagagcccctgtgcctcagacttaacactaataagaggcatgggacaatacctcaccattgtttagtatccattctgagcctggcactgtgccagacacacagatgtgtgaatgacagcgcacccagagggagaccatgcgttggtcaaggagacaaggcctgaacacttaagaagagccaaggaacagcaagggaaatgcagaaccacaatgtcactacatccaggagggttcttggtgcttgatatgtggctagcaaccagtgaacatccctggaaccaagtggcaatgcatgttaagtgccctgtgagcaggcagaaataaatgttttgaatcaaaagaggaggggagctttggcatctaaaggattcagggacacatggtgagtgctttggttcatgttggttgtgccagtaattgaaggagtcttgtagttggtaagatttggggaggtgatgggaagttaggctcttcccccttctggctttctctgccccagggctaacagggctagttcctggaacaccgtctgtgctcccctgtcttgggtcctacacacagctacctacctgtcagcttgggatgctttcccagcctttcatcctagctaccttcttatcctcctggtctcagaaaaaaatgacatgacctatatggagtctctcctaagtagaccacatcccacttacttgctctactgtgtggtgaaatcccatcaaaatggaggatatggttccaaagtcagtgcatactgtgagcagtgaatcagccaagagaatccttgaaaatccctgagggagctatctccacagtggaaactgataagctatctccagtaagtctaacacattaattccggtatttcttttttccctgttcgagatagctgtcctattttaaagtctaggttgtatgaaaaaaatctaggttacatgtagccaagctataggttatacactccaaggagtctcatgtacatagaccatgatgggagtgacacacccctgaggtttttcagtgtatatagaactgtacatagtggaggtattagggtcagatgtagcaaaaggagatattcacactaaaagaaaatagaaaccgaagccaacccagggaagagctgatttacactccattctcgggttgagctccctgtgtaggatggtgaaataaatcacttgcattatttatattgtttaatttctctctgcatctccttcatttgcttcctgaagcctatgtacagttgactgtgtgtgtctatctctgcaaactacagatcttcacttcctattataacacttatcacatttgaatttttcatggattgtaattatgggttaaatgtgcctgccagattatacattccatgagggcaggggccatgtccatctcattacctgctgtggcccagcacctgcatggtacctggcacacagtctttccaagcagttctgtcctagacattgttgtggctttcttctcacccgccttcaggaagatccacccaacttctttctcagttactcagcattaagatctgtagttgctgaggcactcagttaagcttagggtggagctaaaacctgcctgggctggtgcttctctgatacagaaacccctgaaactgatgattatccagaaatacttgatctctttgggggcctgaggagctttggaccaccttaactcatcacctccttaagctcccctacctctaaatgctcttctcaccgctcccactcccaccccctcccccttgccccaaggctcctcctcagcccaactaactgaggctctttcacaatcctaaaagcatcatctttgttttaattttttcttttatcttcaaaagcatctaaaagtaaaaacaactaaagaaaagccagaaagtgaatgaagcagaaaaacaatttcagcactctgatacagtaccccaaaacaattttagttcactttgcctttttttgtgccattttaacgcagttgaaaccatgccgtatatgccagtgtgtagtctgcagttttaaggtgacattattgcatattcatattttcatgatattctttagaagcataattttaataatgccataatattttattgaatgctgtaatgatatttttaagccttctattaaggttggacacttaaatgtttacctttttttctctagtatgtaaatattatggtacaaatacacaaaaatactgcagggaacctttttattttctgcatctgacagactcgcagaaatggaattactaagtaaaaaatacaaactctttaaaatagatttttatttcaggtgatacttaatgcatattaagtgtaaaaaacttagaaaatacataaaagtatttcatccagcatttacctccaagagatggctaattttttgtatattttctgtctttttgatgtatgtgtatatgtgtgtgtatatatatgtattatgtatatattatatataaatatgtattatgtatatattatatatattatatgtatctataataaaatttatactgtattgatatattcatactatatatgtatcattactttacacaattgaaatactttatatgcatgttgttaaaactcttcaaatatacagcttttaatttactgtgtaacgatttttaaaacaacacttttcttgtatcatttaaattttttctgatttcttctattttgttgtatttgtatacataccttgtcagcattttatgttattccttaggatggattccagtaatggatttaccaagtcaaaaggtataaatttttaaggctcttggtgtatattgtcaagtttctttccaggaagattttgccaaattgcatttccaacagtccataagattataaagcaatggaaaatagcatgtcctttctgttttaatttctatcttattaactcttagtgaggttgagctttttccttatatgttattcatgtatatcttcttttgtgaattgtctagatacttaaaaggctaagaatatttggaggttatttttaaaaaataattttttatttttaattgacgttttatacatatttagggggtacatagtgatgtcacagtacatataatgtgtagtgatcgggtcagtgtaattagcatatccatcatctcaaacatttgtcatttctttgtgctagaaacattcaatatcctcctaggtatttgaaaggatatattattgttaactatagttattctacagtggtatagaatactagaacttattactcgcatctagctgtaattttgtgttttttaataaatctctccctcttcccctcttccctctaccattctctgcctctaatatcctctactttttacttctatgagatcaacattttttagcttcaacatgtgggcaagaatatgcagtgtttaactttctgttcttggcgtatttcacttaatataatgtcctccatttccatccatattgctacaaatgacaggattttgttgtttttttatgtctgaatagtattccattgtgtatgtatatcacattttctttgttcattcatctattattggatacctaggctgattcatatcttggctattgtgaacagtgctgcagtaaatgggagtaaagatatgtctttggtatactgattttgtttcctttggataaatgccccagtggtgggatcagtggatcatatattagttctgtttgtagttttttgaggaacctccatactgttccccataatggctcttctagtttacattcccaccaatagtgtaagagtcctttttctctgcatcttcaccagcatgttaattttttgtcttattttgataatcactatcctaactgggataagatgatatctcattatggttttgatttgcatttccctgatgattagtgatattgaacattttttcatatttttgttgtccatttatatgtcttcttttgagaaatatctgttcagatcatttgccttttttaaaaaatttatttttaggagacgggatttcactgtgttgcctagactgtagtgcagtggcacagtcatagctcactgcagccttgaactcctgggctcaagtgatcttcccacctcagcttcccaagtagctgagactacagatgcacaccaccatacccacctaattaaaaaaaatttttttggacagggtcttgctatattgcccaggcaggtcttaaactcctggcctcaagcaatcctccagtgtcagcctcctaagtctctgagattacaggcgtgagtcaccatttgccaatatttaaatcaggttggttgtttttttcctgtaccaatggttgaattctctgtgtattctggatattaatgtcttgaccaatgaatagtttgcaagtattttctcccattctataggttgaattttcactgtgttgattgtttcctttgctgtgcagaagcttgttagtttgacataattccctttttaaaaattttttcttttgttgcctgtgctttttagatcttattcataaaatattttccctggccaatatcctgaagcatttcccctatgttttcttctagtagttttatagttgcaggtcttgtgtttaggtctttgatccattttgagttgttttttgcatagagtaagagttgggagtctaacttcattcttctgcacatagatatccagttttctgagcaccatttattgacaagactgtcctttcaaagcccagtgaatgctgttggtgcttttttcaaaaatcagttggctgtagataggtggattaaagtctgtgttctctgttcttttccattggtctgtgtgtctgtttttctgccaatactgtgctgttactgttttggttactaaagctttgtaatatactttgaagtctgaaaatgtgatgcctccagcctgcttgcttgcttgcttgcttcctttcctttcctttcctttcctttcctttcctttcctttccttccttccttccttccttccttccttccttccttccttccttccttccttccttccttccttccttccctccttccctccttccttccttccttccttccttcctttctctctttctctctttttttctttcttctttcttttttgcttaatattgctttggcattgtgttttttgtggttccatacaaattttaaggcttttttctatttctgtgaagaatgtcattggtattttgatagggattacgttgagtgtgtaggttgctttgggtagtatggtcatttaataatattaattattctgatgcatgagcatggaatgtctttccatttatttttatcctctttagtttctctcatttgtggttttccttgtagagatctttactaccttggttacattattgtatttaattatttttgtagctattgtaaatgggattgccttcttgctttgtttttcatctagtttgttgttcatgtataaaaatgctactgatttttcatgtcaattttgtatcctgaaaatttactgaatttgttgatcaattctaagagtttttttggtagaatgtttaggtttctctatatatgtgaccatgtcatctacaaacagggataatttgacttccttctttccagtttagctgttcttttttttttttcttgcctagttgctctggcttattcaaaggttgttgacacatacatagatacctattttaaaagagtggcatgtgagaaaaatacaggaaatagagcccaataagatatgaatatttgaatttgctgatccattctttcatataggactataagatttaactcttaaaacttcaaaatttttctgtatgtactttccatcttgtaaagttataatagacgcgtgtcgttcttattggagtcaatgaattgggctctgtcatttgttgagatatcatccttctggctctggagttctgtaagaaaatgacaatatatttagggtgataaagctaatatctcaagtctcaattgtttgagagccagttatcagattacctttcacttctgttcctatcattttgttaataactattgttcatttatttatgtacttattgtctggtaccccactataatgcgtccatcaagagagcttacatctctctcagtagtctgtttccttcatttcctccaaatttccattaactttttaatctgtttgcttatttgggtttctgtctttcatattaggggctctcttcagatgataaggtgatccttggctgtctgtttcatgcttgagaatggggtactaaaaagatgactgggaactctatacatgcataaggcttatcaacagtggtttgtacttgtacggtgatctggatggcttgtttagaaggggaaatcctctgccagtatttttggatttttttctattagtttaattaacatccccagagcaaaactttcaatctttcaatatctaattgcagaaataaagcctggctgctggagttcaaggggctagcataggaaagagactagatgactccagtagatattatgaaaactttcactaaatcctcctttttcactttaacttttttactttcagctgcctggtatccactatctagatgccttctgtttttcctttccaggtaataaacctcgagtcttttgccaagttgacaaaagggatggtcacaccagtgtcaagtcagtactgagtctgcctttttattaaacaggctttcagccagttttactattttcagtccctctttactctcacttctagagatatcatctgccaccaaattcctaagcactttggggttctataaggcaaattgagttactttttagcttttgtcacaatcaattaaggcttcaggttgcttcaaattgttaaattggttaccatttatctttttactttttaactttcatgattttgttgctgctattattttctgtcatatttttgtcttgatgggtttgtatattttaaaaaaatacctcttccatgtcatactcattaggatggctactattaccaaacaaaacacacacacacacacacacacacacacacacacaaaacagaaagtaagtgttggtgaagatgtggagaaattggaaaccttgtgcagtgttggtgggaatgtaaaatggtgtggctgctgtaaaacatggtggtagttcctcaaaaagttacaaacaatattaccatatgatccagcatttcatttctggccatatacccaaaagaatggaaagcaaggactcaaatacatgtttgttcacccacgttaataaaagcatcattcacaatagctaaaatgtggaagcaaaccaagtgttcattagtggcagaactgataaaatgtgatatatacacataacagaatatgattcagcattaaaaagggagggaattatgacacatactatagcatggatgaatcttgaagatactatgttaaatgaaataaggcagtcacaaaaggaccaatactgtatgatccttcttatatgggatacatagagtagtcagattcatagagatagaaagtagaatgatagttaccagggatttgggggaagggggaaaggagaagttagtgtttaatggatatagagtttcagttttgcaagatgaaaaatgttctagaaatgggtggttgtaatgatttcatgatgtgtgaatgtacttaatacaactgaattgtatgcataaaaacagttaagatagtaaatgttatcttacatatattttaccacaattaaaaaatttttaaaaacaatgaaaaataattccactttacatttattttattctcttcttgggggagatagagactaattaatgtattcaatgtgttgcttaaaattaaatctattatttcttagtttacagctaagatgagcctttttagggctaaatcacttgccctggtcacagatctagtcattggcagcctagggtttgattcagttctgggaggaaggcagggtttgtatctgctgtgatacatagatcagttcgattcattctttcattagccagcattagaacacctttttcattccagcactcttgaaggtagcagtaagcaagacagtaaggttacatcacattaccatgtgagatggagaaaccagacagtaagcaagtatatacataaacaagacaaatgcaaatgtggctaattgttatgatggaaataaagtgctggctgaaatgtgggtagggaaggcttctctaaggaggagacttcagagttgtgacatcaatgtggagatggcctaatcagtgtgaacatgtgggcaggagtgttcctggcagaagcaacagcaggagcagaggcccagggctgggaataaggttggcatgtttgagaagatagaaaagaccagtttagcagaatgtactgaggaaggggaaggacaagtgatggggtaagaggtgtaaaaaatgcagaaccttgtgagccttggagtaaagcagccaaagctttcctaggtatacagaaagccactagaggggtttcaaagggaaatgatgattttactttttaacattctgttggctttcactttgtatctactgtatagcagatggtaggttgtagataccagaaatgcaatatgtaatactgttgcccacaaggaaattatggtctggtgaggaagaaagagcagagagtgccagaaaaatatagcagcatattccacagtgtacactttggggtactagaggtgatttttaggaaacaaaaattctttatagtagaacaatttatattcctttgggtatatacctactaatgggattgctgggtaaaatggttctttgagaaagaagttctctaagttctttgagaaatcaccaaagtgctttccacaatggctgaatgaatttacattcacaccactagtgtataggcattcccttttctccacaacctcaccagtatctgttatcttctgactttttaatgatagccattctgactgatgtgagatggtatctcattgtgattttgattttgatttctctaatgattaacactttttcatatgtttgttggttgtatgtcttcttttgaaaagtgttcatgttatttccccattttttaatggggttatttttcgcttgttaatttgcttaaattccttaaatattctgggtattaatcctttgttggatgcatagtttgcaaatattttctcctattctgtaggttgactgtttactctattgatagtttcttttgctgtgtggaagctttttagtttaattaggccccatttgtcaatttttgcttttgttgcaattgcttttgacatcttcatcgtgaaatcttagccagagcctatgtctagaatggtatttcctaggttttcttctagggtttttatagttttaggttttatatctaagtctttaatctatcttgaattgatttttatatatggagtattgattttatatatgatttttatatatggtatacaattaggtatataatacctaattgtatttcctaggttttcttctagggtttttatagttttaggttttacatctaagtctttaatctatcttgaattgatttttatatgtggtataaggaaggggtccagtttcaatcttctgcatatggctagttatcccagcaccatttattgaattggggggaggggtctttccttattgcttgtttgtgtcaactttgttgaagatcagattgttgtaggtgtgtggctttatttctgtgctctctattcttttccatggatctatgtgtctgttattgtactagtgtcatactgttttagttactgtagccttggaatatagtttgaagtcaggtaatgtggtgcctccagctttgttctttgtgcttaggattgctttgtctattcgggctcttttttggttccatatgaattttagaatagttttttctagttctgtgaaaaatgtcattggcagtttgatgggaatagcattgaatctgtaaattactttgggcagtatggccattttaataatattgattcctcctttccatgagcatggaatgtttttccatttatttgtgtcatctctgatttctttcagcagtgttttgtaattctcgttgtagagatctttcacctctctggttagctgtattcctagatatttttattttttgtgtcactattcaaaatagcaaagacatgaaatcaacctagatgcccatcaacagtggaccggataaagaaaatatggcacatgtataccctggaatactacacagccattaaaaagaataagattttgtcctctgcagcaacatgaatggagctggaggccattatcctaagcaaactaatgcaggaacagaaaaccacatactgcatattctcactggtaagtgggagctaaacaccaagtacatatgaacacaaaggagagaacagtagacactggggcctacttaagggtagaggttgggaagagggtgaggatcgaaaaactacctgtagagtgctatgcttatcagctgggtgatgaaataatctgcacaccaaactaatgtgacacgcagtttacctgtgtaacaagcctgcacatgtacccctgagcctaaaataaaagttaaaaaaaaataaaatagatgaacaaataaataaataaaatgtggttactagattgattaaaaaaatgtctacaatcaaatcaggttggggattcatatgtgatatttccttagagattctcagtgcacaccagcatattaaagtcccaattgttacatcacagaaacctgtgtactttgttcaactttacatttcctaaatttatttgcacaaatagcttctttcaaataataccttttaacatctttttaaactcctctgggaaacactgatttaaggcaacatgacaattatatgttaggtgttatggcaataatgaggggggcctaactaccacaactctgggtgtgaaacaggtaagcattcaggattgccttcctggagtaggtgacccctgaattgcttccagaaggagtagagaggttagccttgtgaagaatagagaagggtatttcatagagaaagaactgccaaaacacagatatgtagacccaaacatcccacatcatcatccttggaaaatagatttacaaatttccagcaggaagaggaaaaaaagtgcttgaagtgtgctggtttctcaccttagtggaaataattgcttaaaaaaacagccagaggctggacacggtggctcatgcctataatcccagcactttgcgaggccgaggcagcagatcagctgaggtcaggagtttgagaccagcctggccaacatggcaaaaccccatctctactaaaaaatacaaaaattagccaggcgtggtggcaggcacctgtaatcctagctactcaggaggctgaggcaggagaatagtttgaagccaggaggcagaggttgcagtaagccgagatcatgccactacactccagcctgggcgacagagccagactccgtctcaaacaaacaaagaaacaaaaaaaaccagagtagaatgcaattctcctcatctggatttcagcaagaattgcccatttctgttcagccgtaggcctccatcctctgttgccagtctgttcttctgactctcacctgtctcctttctgcacacagaaggccagagagaatgaacaattcttccccatgtcagttggctcacccttcctggaagtgtggatttcctgttagtacctgcaactctgtcggcgctgctatttctgtcttcgcgttgtttcagaatactctcacactgctgccccatttttccgtacgcagtcttccaggcccttttttgcacctgatttttgccaggcagcataattagaggatgttacatttccctgaaagagcatattctcatggacaacaggacacaagggagtaagaaagcttcaaagatgctggagggtctccctcctgtaccccaacctgtgccacttggtataacaggattctacatgagttagcttttctttattgttattaggagattaataaaaattgacctcatttatttagtgcttactatgtaccagacactgtaccaagaatttattatcattcaactttcacaaccctaaaatatgtgtattttacaaatgaggagaagtaggctggcgagtagcttgcccaaagtcattcaactcagaagagaggccatcgtttaatcttagattgtacttgtaaaattcacacatccaatacataatgcctttaaatgttctcattgttaacatttattttctttggattctgtgcctatttctgcttatgtctccggattacctgggagcttttaaaaataagaatcctagggttccactttataacattgaccagaagtcaagaatggggcccaggaattgctattttcagaagctccctaggtgactctaatgcagggctcttcataccttggtgtgcgtcaaaatcacctggtgagggaggatggctgggctccacaccacagtttctgcttcagtaggtctagggtggggactgagaatgcacacttctaacaagttcccaaatgctgttcatgctgccatcctagcacttgagcatttttcccaatatgtgtatgatccccctcccccaccaactgggtgacgtagatagaactttaagtgtcattaagttatgtcatgttttgaatctttctctgctcgatttccacgtcaacatgagtgagggcttcagggattttactccatcattttggctaaatgccaacttggcaaattccactcctcccccggagggactgcaaatgccagtgtcctccttcattcaggagtgaggtcattgtctgtgtggttaaaagtggacactttctgctgcttctgcttttgcactgtagtagaagtttcaaggagctctattttacagttccaaattaccatccctcccctctttaatgcttccaagatggatagtctctcaccataggttaatgtttagattttgatctctatttctcagccccccaaatctggatgatcctctggtgccagagctgttgcatgtatcacccctggacactttcttctctgcttgaaccagagaataattatatatagtagttcccccttgtccatggaaaataccttccaagacccccagtggatgcctaaaaacatgggtagtactgaaccctatgtatactatgtttgttttttttttttttttgatctggtaactgagaggattactaagcggacgacagggaggtagtgcctacagcatggatttgctggacaaagggatgattcacatcccaggtgggaccaagctagataacgtgagaattcatcacactattcagaatggtgtgcaatttaaaacttatgaattgtttatttctggaattttccatttaatatttttgtactagagttgaccatgagaaattgaaaccatggaaagcgaaactgcagataaggggagactgctgtgctagagtgctatagaggatttcatttggaaaaaaaaagttttggtcctggaaaaaaagtttaagaacatagtcgtattccatttcttcatatgtttgagatatttctggctttggtgaaacataggctaggaaaagaacctaacatcttattagtgtaactgaacaacagtaacagcagacttagcctttcttccttatgtgcaacattacctgtgacctgactcttgaaacatagctgctattaaagtacaagtgagtcatgcatagcagcttctccttgcccagttaatttctctgtaaaatctttactctcttttattcatgtatatatatgtatgtgtgtgtgtgtaaatatatacatatatatgtttgtatttccctttaaggatttcaaacacaaagaccctagtcatttgattgtctctgtactgtcgaattttgcctacaaccctgactgtagagacacattgttacctgttttccatattctgtctagtaaatgcttggttgtcaggacaacggcatagaaggtggaagctcattgataaccacgtgaattctttaaacaaatatgatcagagcaaattccagggtatgcttgaaagtagatttaaggaagagcaaaggtttcagacatatccttccttttataaacttgatattcatctttaaggatcagcaacagttggagttactcataattttatttaaaatcctgaataaagatatcaccttagttttatggtacgtttgtcattccagcttgttaggcatgagtgtgttgttactgacagagcccctggaggacaggcagacactgtggttctccatggtctctcagtaccaggcacagagcaagcacccaatacatattataggaataaatgatctcaaatcttcacagtgcctcttatagatggcttttatgatatatatctgcagagaaactgaattcagggattttaagtgccttttttgcaaggcccttaaagtttgggaaagtaggtgcatggaattagaactcagattatcctgacttctaagatcacactcttcattgtagcacactgccttcttgccaaaaaaaaaaaaaaaaaaaaaaaggaagaaacatgtaaaaagacagaccatttctaagatgaaatgtgtgcttttcaaaacaatagcagaaaaccttcttcaaaggtaaaatagttggaaatagaagaagaaataatatgtaatttagcgttcgttgaggataagcaattaatcctgccctccaggggtgaatttatgtctagcctatttgcacatgaaagtacaagttgggcttcatttctatgcaagtaagacatctggttgggaagtgaaaaattttgtcagttacctgaatcatgtttggtctacatgatagaaaagcccctgatgtcttcagatcaccagaagacatttggcattgtatagttaacaccagatccactgactgagtggttcacctgagagttgctgcttgacatcctgtagattcacccattgttaggaggctgttaccattttgtaagtcagcagtttgcaaacagtagtccagacgagaaaccaacgctggcccttgacaaagtgttcactggtgtgtgatgcaataaatacatgaggtcataaaaggaagtgtatttaccttaaaaaagaacatcctttattttgagatcctctgcttcctatgtttttagtgatacaattttgtgtcaaataaatcctcattgtaagatttggttttaattagtaaatgagacaggataaaaaattgagaaacctatataaatccctagttttctttatgtgatctttgtatttgattgtgaaaaaaaaaagcaaaattgtagaaaccactgctttaaaccttgtaatatttttagcacaatgacacctaaagtattttcatgtatttcccaagttttccttttcctagaagtggggtaactctccatggtagaactgtttgcatgggtcttgaaagcattggacatcttaacagtcaagtattttgctgacaaaataatgaattttccttttgaaacaagcgttttgttcttaaaataactctaaagagaacaccttctgcacttttaaagcatttccctctgaaggcatgccgtggagacatgaccatagggagaaactttttgtgctagaaaactgaattccaccactgtgaattttttaacagctttcacaggttctgcagtttgctctcatgaccccaaaagcatatatctccacatgctgtaacatcaaggatctctcctcaagctttgtaagctcggccagaatgagctgagtaccctctgtgtgtcaggcgatgtccaatacactgggaatagggagtcataataaccataattttatctgacttttgtctagcatttgtcatgtggcagacaacatgctaaaacacttatttgcattatcttgcttgattcttataaccactctgggagaaaaataacattattatagcctttttacaggtgaggaaaccgttgcagggaagttaaatcacttgcccaaggtcacaagccctgtgagtgataaagccaccaccatccaagcctgtccaccccctaacctgaactcccaagtgctatgctaaaccacctgcctcttatggatatattatctacaaaaagagctctgccctcaaggcgattataatctaaattagaagagggaagcacaagggaaaaagccattatgtagagcagaatgatgtaattccaaaaaacatgctgttggattgtagaggaaagagtgattaattatgatctacccagggaaggctttttgcatgtggccttaggctaggtgagaacaaaatagggcaccagcaattatctagagaattgggtcactgtgggtgccaaagtggatgatgatttcaagctaaaaagactatgctctgaatagttcagaattggccgcccacactcctggaatctgttgaatttttgccaactcccttgttctctttgtgacttattgccctggcttagatgagcttcctactccaggtgggggaagatgcaggatggtgctgccatagcagggagtgctgacaacgtggaagaagccttccttgagtcaggagctctggattcaatctagactctgctcccacaactggttgactccagggaagccacctccttctctgggttcagttttctctactgtaaaatgtatacactgaagttgatggtctgtatgggccattcaaaatcccgtgtctctgtttttggaacagagaaggaatcagaggagaggactggaagaagctaaaagattcagcatgttcggatttcatgactcttgtggttttgttcctagacaggacctaccaggggagcctcctgcaaatgaggtggtcttccttttctactcatcacattctatgcctgccctctctaacctacatggtatagtaggaagacgccataccatggagtcagagaatcttgggctaaaatcctgaccatgtcccattacatagtgactttgaacaaattatgtaatctttctgtgcttgtatttctacaactgtagaataataggttgcaatatcatagactcttcatgtagagaatctaattctattactataaaatctaattctaataccattggtttggtgttagcaatgaaggtgatagcaactgaaaagtaagaagagcagtgactaaaagctcataggttttgataaatgggcactattactattataatatttattgtgttaaaatacaaattatgtacagcactcctctgaacactgacctacaatagttaccagttgcttgttggacttcttgaaccagacttgaccaggcaaagagaatttgagaacctctatttcactaaaaaggtggtatctacaatatcttgccactgtagcatctgctatgtgtaatgagatgcttgggcctgctggtggtcacctattttctaggtatacgcattggcttttgtggtgtcgccatatatatatatatatatatatataaaatatgtattatatatataatatatatacatgatatagatataattaaatgttatattcaattaaaataaatataattttaaattaaatataaggaacatgagagttagcaggaatcatgggtgaaaaaaatatgtataataacaccacaaatgcatatatataggtttttgcccatgattcctggttaactcccatagcccttattataacattggggcacttgaggcctcaggcaacagtctctctcagtgaccccctctggtccttcttcacctgcccaaggtaggatgctaatttgattatggatcagaagaccctcattccagagagggtcctgccccatagcctagtggaaagaatgctacacagagaggccaaaaaaagtctgagcagatagtccttgctggatttagatcatatgctttttgtccaatcatatttttacatggttgtcaatcatgcctgtgtaaaaaagcctccataaaaacccaagagtacagggtttggagagctttttgattgctgaatacatggatgttcctggagggtggagtgcccagggaaggcatggaagctctgcgccccttcccccttaccttgccatgtgcatctgttcatctgtatcctttgtaatagtatttataataaaccaataaacgtgtttccctgagttatgtgagctgctctagcaaattaatcaaacccaaagacagggttgtgagaaccccaacttgaagccagtagttcagaagttgtggaagttggacttgccactggtgtctggtgcgtggggttgggggcattcttggggactgagccttcaatctgtgagatctgatgcaatctccaagtagataatgtcagaattgaactaaatgacatccagctggcgtctgctacagaattaagtgcttgcttggtggttgggagaaactcctacacatttagtaacagaagtcaccttctatgtggatgattgctgtggtgtaagaccagaggaaaaacatgatttcagagtttttccctcaacagccttgagatactccattttaataagatagagagatgaaagtgtattactggtgggattatgttagaaaacacatttcttgtcccagtagcattcaagatcaagagttaaacttaatacagtctctcctctttactctcccaactgatattcagcttcctgtgtgagtgtatgtttaatgtttttgtctaaattaattgatctttgtcttatgatctctcgtcttaaaaaaactaagttcagctaaatgaacattgctgagaacttatgttctagacactgctgacgttgtgctgaggggaaatgaatatagaggtaaataaaataatttgaactattctctgtctagtgggaaagagagatcgaggtataaataggggaaaaaataaaacacaacgtaagggtcataatttttaagttggattaaaaatatgtgtgtgtttctttattaaacacctcttataggccagactatcgggccagggatataacattatataaaactcagtccaaattgcataggtgtctacaagatgtaataactacaagatggcataagaagaggtattggatgggaatagtgtcgactagaaagtaagctacttgagcgtaggggccttaactatcttgttccttaatgcatttttagcattagaacagtgcttggctcgtatcaggtactcattaaacatttctgtagtaagtgatgaggctatcataaagttttgtttccccacccctaaaccagattgtaggttcagtctgaaaggactccaggaccctctctgctggtaagacatggtgccactttgtactctcccagccaatctgattggcctcttgactttggcaaaactgagctgggggctggcccccagtgccaagcacagaggaagcagggtcacatgccacccatgcccaaagctctttctgacatttccatgggcctggaaccaactctcctcctgggtttcatctcattatatgtgggaagacaaaagaacactgaaccttccagttaattcaacaccccgcccccacttaccccttcctggagaggataacagttctgttgaccattataatgcattttctgtctcccagcagtccacatagtcattaatttctgctgctgacatcaggaaagaggattatgtgtgtgtctgaaactgttcccaaagtgctcattagtcatagataattgaaaaactggtaggggaagatttggtgtaataggagcccccgcctgtgaagagggactgcaaccaccagataattgtagattccagcttttgaccactcagactgaatctgcccatccaaatgggaattcagcagacttgagcctaagagctctcagagtgatagtgtttttacatacccaggtgagggtgtgtacaccgagacagagacagccaaatcaagagaataggtgaactgcccttgggtctctttcctgccttcagactgtggagcagtgtttggaaaaagtgtccagtattctcctttattttgtttttatttcaacgtaagattgttttgatcacaaaagacatacaaggtcatgggatataagaaacacaaacattagagaagagtaccctacactggatcccaacccatgctgtgacaaaattctagggtttttctggaagtttatgtgcttacatttttatatccttttctttaaaaaaaaaaatcacatgatcatactaagaatactattctgcatcttgccattttttctgaatttatcttggagttccaaatctataccttaattcaagttcattcattttaatggcaaggtgggattctgaccagatttaagggggaaaaacatcttttaaaatattatacaagaggctgggcatggtggcttatgcctgtaatcccagcattttgggaggccaaggtgggtggatcacttgaggtcaggagttcgagaccagtctggccaacatggcgaaaccctgtctctcctaaaaatacaaaaattagccagccgtgctggcgtgtgcccgtagtcccagcaacttgagaagccgaggcatgagaatcgcttgaacctgggaggcagaggttgtagtgagctgagattgtgccactgcactccatcctgggcaacagagcgagactctgtctcaaaaaaaaaattacacaagaaatgtagaccaattagaaattagagaaaaaagaaaaaaaggaaagaaaaaagaaatcactcataattcctccacccagagaaaacctattttctgtatttttttcccctaggaatgtatttttacaaatagttcatctactttcattgttgttgttcttacagctgttaaaagaaaacctttaggcaaattaaatttaacagtttaactgtgcaaagaatgattcatgaattgggcaggtccccaaccagaataggttcagagagacttttgctcagccacatggttgaagagaaattacggacagaaaaagggaagtgaggtacagaaaaatggaagtaaagtacagaaacagctggattgggtacagctctgcatcggccttatttgaacagagtttgaacagttggccgcctgtgggtggttgaagtatgtcttctgtgattggctgagactcagcttctagttacaagagtaggttacagtgtgtttacaaatccagttaagttacagtcactgtgtatgaagaaacctttaggctgaagttacaaacggacacctttaagttaaacttaatttaacaaaaggaagtcatatactgcatgttttgcagcctctatttttcacttggtttgactgttttaaatataaaaattattccccaagcttttctttacactgtgtgtttatcttcttttttatttatttatttttttgagacggagtctcattcttgttgcccaggatggagtgcagtggcgcaatctcggcttactgcaacctctgccttcctgggttcaagcgattctcctgcttcagcctcccaagcagctgggattacaggcaactgcaaccatgcttggctaatttttttttttttttttttttttgtatttttagtagagacggggtttcatcatgttggccaggctggtctcaaactcctgactttgtgatctgcctgcctcggcctcccaaagtgctggggattacaggcatgagcaaccacgcccggccacatttatcttcttaaaaacccaacctgagcacttacagtcgtgcccctctgggcaattcctttttgcctggccacgcctgaagccctccgctgcctcttgtcccgtctgttccagttctctgttcctccttgttcccctttttgcgacatactaaatgcctcaaacacaccatgcccctcagggctccctacaggaaactcactttttgctctgctgtcatccctttccccggagcatgccagcactgaaaccaccaatctccaacttgcctttccacacaggcttgaaagtcatcttcaccttgaagactgtattcactctactagccaccctaactggaccctccacagttctctgggaacaccatgtacacatttcacctttctagcattttctacatggccctaagagtcttagtttttcatcatctttgtcccaaaccacaatatgagacctcagcacctagatcttagcacatggtagatggaaatctatgcaggcaatcattagttctattgtttctgaaatgtttgttaaaatgcatgaatgaatgcttgaatgaagcctagaaagaactgcaaatgctcaggcagtgaagtcttgatttctgggaaaagcaatgctgtgaataatttaattttatggtgaaagaaaagccaaacaaggattatattgggaaaagttgtcaggaggcactaatgtttgcctctgacagctctagtgccctcagtgtacctctggctgataaacttagagtgtgattttgaaggggtgatttctcagggattctcacctatttctatcatcctctctcatgccaagctgtttcattttggtctctaaataaacaaagctccttcctgcttggagtccagatagcctattcctgaaggctgtggttccaaatgaaagatgggatatttgtccttgtatatatttattttcatccctaaccactggattgaggagaaggctggttcactgctgtaggttgggttttccagaagcaaaggctgagacagatttggggggataaggtgtttattagggatggttggctgtgaaagaaggaagagagagaaggactgggtagagggaaaagagctgaactgaggtgcattcctgcagcaccttggtgaactcagcagagtctctggagtgagtggtgtctatcagagcccttctgcctctgctttgcaaagtcaccaggtactggctgtcctgggaggtgcatcaccttgggaaggcagctctctgcaactgaggcaggccctggaacatctggcagctgtctgctgactttactccatccttaagggggagtttgagccatggtatctcagtctctaccatgcttcctatatccacgcaaccactgtgacctgttatttcttgttccatggaatcccttctgtctgcctctgtttctacatctccgttaccaatatctcagtgaagatccttatattctctctctttctttgattactgaaatagattcacactattttccctaaccccagtctatcctctgctataatactgccagagagtgcttaaaaaagcacaagtttaatcgctttcctcctggcttaatgctcctttagtggtttacagtgggcttcatgattaagttcaaacacttaagtatggattacaaggccctgcatccactgccccatctgcctccccagcttcctctgtccttcaacacccaccccctaccagttcacaccccagcctatgttccaatttacctagcccttttgatagttcccttaggggccccttctcccttttttctgtccttgctcaagacgcatcctctgctgatgaagctccctgtggtcctatagcctataattagacccagatctcctgtctgcatgcccaggactctctctgcctcgcagtggtctgcagcctcatgttctgagcctagaggacatagaatcaaattaagctcctttaccagctaaggtttcttcctaaattactatagagaaaacttggaagagtgccccaccctgctaatcctgtctagaaccttttttataaaaattacaccttttatgtttgtggagattgggggtgaaggtggaacagaatttccattttgaccttcctatgaaaaccatttttaaaaaatctcaatttagtaggcaagatttctaaacggtgctcctttttctttttcttttttctttttttttttttttaacatacataatgcttgttctaaaaatacttctcttgatcctttcatccattcagaacccatttttaaacaacttttactccaaaaggtaatgtaatgaataagagcagaggtgtggatatcagtcagagtagaacccatggcctgtcttcagctcttaggctgtctctagggtgtttatttttcttctgtaaaccacaattttcccatctgtctgtaaaatgggggtagtatgggtcctattgtacccttcacagagggttaatatgaaaatgaaatgagaaaatgcatgctatgtccttagtgcagtccctagcatgaaagtgctcagcaaactggagtgcagtctctcctgtgttagatactagccatagtgacataattaagatattgtccagaaccgtattatacaaagccaaggacactgctctcttccaggtttctgctactttggcatttgaaacagaataagattttcctgttctctgccccatcctttgagcatcttatacttatcctccagaccatcagtgtccaatagaaatataatatgagccacatatgtaatcttaaattttttagtagccatgctgaagaaagtgatactaatttttaatgtatcttatttaacttagtatattcaaattattattttaacatggaattgatataaaaattattgaggtattttacattcatttttccagatgaaatctttgatatctggtgtgtattttccgcttaacacctctcaattcagacgctagatttttgttggaaatacttgatttagatttcttaaattaatctagaaaaagtagattcgcatacccaagttgttccgaacatacttaaaagtttttcagtaactgaatttaatatcagtttttaagttgaagttaaaactaaataaaactaaataaaatgaagaatttagtccctgagttactctagccatacttcaagtgctcagcccacatgtgactagtggctgccatattggacagcagagttcttctagaagtcactgcagaggtttcagtcttactcttcttagctaaacttgttttcatattcaattgtagatagaagctcttaaaatggataaaaatggtgtcgtcaaagtgctttggttccatttagaggaggttggttaagctgttcactctctgacccctctcccaacctccaccctcacctctacccccagaggtcctggagcacctctgcccagtccttgagctccatggaacaattaacaagtggcatcttagcactcaaaaattgctgattatgcacccagattctatcttggggctcaaaggggtcttaatatatctatgagtcaactcctagcccctccctgcagtgcagaaatactatagaatccttgggggatgagagagggctcgggctctgtttaacacctaggagcagatggatcatttcattctattctgtcttacgtggttctctgggttcttatcttgtcttcctaactaggttgggggcaaggactgcttttcacagccccacagcacccacacaaagcaagacaatcaattcttaactgaaggcctgactgcaagaattcaaggtcacttgaaaaatcagggtcactgcattgcacaactccaaagaacatcattcaaattgtattatatgattgtgcaagtggcagccttgtaaaatttgcaaaggtttagactggaatattttttccagctgagaaaaactttttaactaattatttgttggtacaaagtacacctttttcctcttatcctctgccaggaagcaactgaaagagtaagttttcttgacttaggaatatacgttcattagagagggtgtatggatgtgtgaacatgtgggtttacgtgcgtttaagtaggttagtagatctgctgtgttaggaagcccatttggaatggtttgagcatttaaaccttgtatttaagaggctactgtgtttatattccttttgaaatttcccattttcagaatctttatctggtttgaatgatgctttagagttccttgtttgtaaagctccacaaagcatgacccataggtaccaagcacgtacactaaagtcactggatgagcaaagggactcttgatgactgcatggtttttatctttgcaaatgcagaggagggaggagagagcaaagagtttctcttaaaaaaaaccctctgtttacttttgtgtttttcaaactgatggtgtttgttttttctcatgtctacccaggaaaccaagtgctacctcctggagcttctcttggaaatgggctcacaccagaggcagcaagagaccttggccttctccctgggattgcggtcgcagcttcactcattgatgcccatgcaggaggactaggtaatctcttatttgttgcctacagccaaaaccgtattcaaatggaatattccctagaaccgaagacactccttttctgtttttaaagcaaaggtcaaggactttggtgtttcaggatataataatgaaaagcctttttacagctaggcatttggatagaattacagaacttttcattaatgataaaatttatttataattgtattaatttctttatacatggcaatagaaaaaaatgtatttgaataactttctgcatagttcttttgtttactgaaaattcaaaaaagatatgttaatttcttgccacacttagctctactgtttttttgtaaggtactccaaaacccttataagtctcttagatttattttaataatatatttggcttatgtcctgtatccagttccttggctgcagtcttgattttatcttgtacataactctcaagtctttcattcatgtattcatttgttcattcataaaacacccgttgaacacttaccatgtccaggcatggtgctagaagacagtgaacttaaaacaaaaccaaataaaaccaaagtctcttccccagcttttaatgggaaaacacacagggaaacaaagaattacagtaaagaatgatgacttcctcatccttattgcaggttgtgtgtgttttttgcaggggaagttgttctggttctcagcatctctcatctcaactgtagccatatatttttttcctagcctttcattctaacaatgttttgttttaaactatgatttataattcatgagatcaatttagcaggacatgaccactgaatttgcacaacagaatggaacagaattgaatagaacaaagtggaaaacatcagagtacatttcacaaagtaagggaaggcactgctttgtggagctgtgtttccattctgtgtgtgtatactttcagacacttccatactctgcccatgcatttacacctctgtgacttggcacacatgttctttgtccagaatgattggtcctccacttctccagctggctaactcctcctctaactgcaagacccatatcagatgctttctgctctgcatagccttccatgaaacactcaggtgtatttagaaattctctaaattatgctttttttcagcacactatttgaagaaatgatcatattgcattgtaatttcaaatatatctgcatgtcatttccattagagtgtgaactccttgagaacaggaacattatgttatctgtcctgtatccttcatgccaagccctatgtctggttcctatagctgcttattaagtttattaaatgaatagtcacattaaggcaagaataaggtgaaatggctttaaacagtagagtgaagattaatctgttttcttatgcaacggattattaaatggtgccttgttctacatactacatggatttccagagcaggatcgctctcatcaatctatggacatgtctgtcctgttcatctctctgtcctcaggatctaaaacagtgcctaagaattagtaaacaactcataatatatgtaggttggttgaatgctatgtaacgtagttctgattacaggcaaggttgtttctctccaaatacttttcagtgtgagcaatgtgtgcttttgattggaatgttaagattttggtttttacatacaagcacagagagaacttgaggtctaggcagacatggagtgtttctgtcccctagcaatcctgacattccagatcatgtgtgaggccacaaaagctttctctgtcatgctttttaaattatccctggggtgacagtgtcaatcatccacccctacctgggtgacaatcacttggctgggaccggcatatgctgaaagaaagagaactgctgcttgaagagccgcaggcactacagtttccttgtcagtttcccagacttccctcagggacgtgccaaaacacaccttctcacttctgcccaggactcactatgtcctccaggaggggagactgtcaatgaccctcacctttttcctaaacagagatgttcagtggcagaagttttacccttagaagctttggcttaagccttttgttccccgtaaaatgcaaatgcttgtaagtgatatggtttggctgtgtccccattcaaatctccacagagttgtatctcccagaattcccacatgttgtgggagggacccagggggaggtaattgaatcatggaggccggtctttcccatgctattctcgtgatagtgaataagtctcacgagatccgataggtttatcaggggtttccgcttttgcttcttccttattctttcttgctgccaccatgtaagaagtgccttttgctcttcgccatgattatgagacctccccagccatgtggaactgtaagtcaaattaaacctccttttcttccttgtctcgggtatgtctttatcagcagcataaaaacagactaatacagtaaattggtaccagtagagtggggcattgctgaaaagatacttgaaaatgtggacacaactttggtactgggtaacaagctcatagagggaagagacttgccttgtctctgatgagactttggactgtggacttctgggttaattctgaaatgagttaagactttggaggactgttgggaaagcagctgggagggaggctgtaccctgcaaagccacagaggcagcgctgcccaagaccatgggaacccacctcttgcatcagtgtgacttggatatgagacctggagtcaaaggaggtcattttggagctttaaaatttgattgccttgctggattttggacttgcctgggccctgaaactcctttgttttggccaatttctcctggaatggctgtatgtacctaatacctgtacccgcattgtatctaggaagtaactgacttgttttttattttacaggctcatgggtggaagggacttgacttgtctcagatgagactttggactgtggacttttggattaattctgaaatgagtaaagactttgggggacttttgggagggcatgattggttttgaaatgtgaggacctgagattgggaggggccaggggcggaatgataatgatttggctgtgtctctattcaaatctcaactaacttatatctcccagaattcccacatgttgtgggagggacttagggggagggaattgaatcataagggccagtctttcccatgctgttctcgtgatagtaagtctcacaagatctgatgggtttatcaggcttttctgcgtttgcttcttcctcattctttcttgctgccaccatgtaagaagtgccttttgccctccaccatgattatgagacctcccagccgtgtggaactgtaagtcaaattaaacatcctattcttcccagtctcaggtttgtctttatcagcagcataaaaatggactaatgcagtaagttagtaactttcccccatatttttgttagtggaaagatagaatagtttttttttgttttaatggaaagatagaataagaatcttggattctttaaggcctgaacttagatgccagcagtggctgggaagggcacaggaaggtgatagtccatgatgacgggttgatacagacttacttaatatatgttgactatgttttatccttattatgccttcttatgccttcttatgcctctttctttacccttcaccttacagccaatccaagagttggatatctcaaaaaaattaggaggcctgggtgcaaatgtttcctttcatttctacctttcctatacccctattaggatgtggaggtgaacagatgcctgaaaatcttgaaaaggttgtccatgggtccaactctatattaactaaatataattgagtgaatgcaacctgtcagtgattggtctaggcactggagattattagcagtgaacaagtcaggcaaagtccattcgttttggaaagaaaattctcattgttctcccctgcctgcatgtttgtagcttaatagtataggtttgggacagctaatccctgagacatattgtgatgctatgacaagggcactcaaaatggaattttaagttctggatttagattgtgtttctgcctacaaatatggtgcttcgcagaacttttgtctcctgttatgcagtgagagagtgagagacaacagaatgcaggattcactactttgtgattctgtataggttgaggtcagtaatagcctcaagaactggctaaatgaaccctgtgttaagagatttctgaatgtcaagtacagacacagctttggatttggaattgccacccaggaagaggccatccaggcctctcaccaacaaaccctgacaactgtagtcacttcaaatgctgacctggcatggcctgcttgaaaccccacattctgactagtatgaggggtcagcactctgctttagagaaatacccctggactttcattcccaagggaggcctgggatgggaggataaagatcaaagaagcaagcaaaactcaacccatgcttttcccagttctggaaaaagaggaggaagggctttgtgggaataaaaatcaatgataaaagaacattttgttcttaaggtgctggttagtaagttctccagcagacagtcagaagataggagtagctttgtttgcactttgtgggggtggttctggccagggctcctgctgctgatatttttctagcttataaaaataacattaacttttttccaggtcttttcttggctccagcaccccaactgccctgaaaggcaataacaacctgatttctgtctcaggcccttctcttctcagttgctctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaatcagttgctcttatctggcagacagactcctgattatccatcaaatcttgaatcctgttctcctctgggaagccctccctgacttcccaagttgacttaagcactctctttttcccccactgtgtcttgcgcttgcaggtttgtgtgtgccacattgcctcatctactaatttataaactctttgggcaacctgttgtttcatactcccactgcagcagcctgcagagtgctttacatatggaggacccttaacacatgcgtatttagtgaatgagtgaatgaatgaatggcattccctccatgaggaacggatattacaactgagagagagagtaacctctcattcaaaggcaattgtccctatacaatagttatacttggcttatttctgcaggagcaaaagtttgggttcttctagatgtttggaaatctgtctcctttttgccctcatcacattaccaagtttcggccaagagcaagctttgttccttggtttagcacaactatttgattaccaatattggattatttggcagatgttgaactggcttaaattgctcatctgggccagatattgaattggtttaaactgctcatttcaattgcagagccaggccaaaatgaggattttgaatttcttttctttttaaatggaagaatttattgagccagtcttgcaaaaagggcctttggttcatgccctagaacaacacatagtttgttccagtaaacaataaaacatgccaataacatttctcaccattatcagtgttctagaagacaggataaaggctgcgatctaaagcctgcgactttagataatgtgatttggggggaacatttatttataagtagtatatatactaaatgtagcatgatggataaagaaatatacttattggcaatagtccattgcgtttgtaaacttttgatttatgaagcatgatatggtttggatctgtgtcctcacccaaatctcatgcaaattgtaatccccagtgttggaggggtccctagtgggaggggattgtatcatggtggtggatttctcatgaatggtttcgcatcatccccttggtgctgttctcatgatagtgcatgagttcccttcagatctggttgtttaatagtgtgttgcaccaccccactctctctcttgcttctgctccggccatgtgaagtgcctgcttccccatcaccttttgccatgatcgtaagtttcctgaggcctccccagaagccgagcagacaccatcatgcttcctacacagcctgcagaaccttgagccaattaaaactctgtcttctataaactgttcagtttcaggtattcctttatagcaatgcgagaatggactaatacaaaacacatctatgttcattatagaatttgctccttatagcaactttgtagtgaagttaggacaggtatgtgttccctcattttgcacagcaaacagctgaggctcagtgtattataaactcaagaatagatatttatcttacacttagttcttaaggcaactttatacatactattattctatttgtcagatgagacagttgaggctcacaagactacctaacattctgagctacacagttaaatgagagatgcgtgacttaagcccatgctttgtgcacacttatcactgtgttataaagaatggcctacctatttaaacatgatccactctgctctttaatttgaccctaaaaatgtgagcaagtaacaaattttgaaaaaggaaagtctttaatatttattgacgacccactttactagttcatggggttagacagtgactatgagagagaagtggacttctgggaatttgtattctagtaaagaaaatagacaagtaaataaacagttacggttacttgtgccgtgtatggaaggctttggaaaaacataaaatgggcctaaaattgagacttaaacaattattaaaggattcctagagggagtgatgtccagtaatctaattacgacactgctttccctgttattgcttcctggtaaagtggaatttatatattttttgcgacttttaaacttcaactaggcttcatttctaataataaaataataacattgttaattagaacaaatacaaccaccactctgactggtactactatgatgaccatttcttacatgtgtcctatgtgccaagtactctacctgatactgctcagactttatatcttgctcctcacgataagcctacaaggtagaggttgtttccccattctgcatgagggaattgaaggcagaaagaataatgtttccacaatcacataactaatctcatagcaagatttgaaattgagtctgcctccaaggttcatatatcttttctctaggccagtggttctcaaccaggggtgatttgacccctcaggggacatttggcaatgtctggggacagttttgtttattgcttctggggaaagggaaatggcactggcctgtggtgggtagaggccagggatgctgccaaacaccttacaatgcccaggccaaccccctgcaacaaagaattatccagcttcaaatgtcaaatgtcagtagcactgaaggtgagaaaccctattctctcctggaacacctccagtgatattatttctcttcatcaattcagcttatttctatagaagccaaaaagcagcccacaataagggttttgctgatacattagtactttgttgaaatgtgttttgtgaaattgactcttcagtaaaagtagttgtgagattaagaaaataatagaagtgaagcctgaggagtagggaggacaggatggtttctagctcatctatttcagagtcaagccacacgggacaacttggccgtctttcagcacatcatgcacattccacctcctttcctttgttactcatccatcagcactcagtctaaatgttactttgtggaaacatctccaaatttaatccattcttagaaaagcaccaatcactctctatgctgtatctgtgaaatactttacaactatttcagttttttcaccaaatcatgttcacgtttgtatgcccatcatccagcatgaaatccacatagctggtcttcactaaatcaatgtaattatttaattactattattagtaattaagataataaatataagagggttttgaaaaatccagaataagaattggtaaatataggtgagggagactttaagaaaatatagattcccatgccctaccctgctgaggatgcctggaatcttgttctaagtgtggaaaatgtcacctggtacccagaggagacagcctggggggatgagttggcactgaggacactggggtcagaagcagtattgatgtgtttctgccaagtaggcagatcagaccagagcagaaccgtgctgcgcaggagccaggccaggcgctggccaaaagctgggggcaggagggagcttgtccaaaatgagagagaatatggatccaaagaggcagacggtctgcaagaaattgggggtggggggggattagaaatgcagataaagtcatgccgtggaatctggaaggagaaaaccgtgccagtccctgagcagatagagcaaggacaactctgggagttcctggatgtgaatcacagagggcagaggaagaacgtattcatgggattgcaagtttattgttttaagttgaggttcggtttaatgcgacccactactgcctgagacctcggcagttcatgagccgtggcaacagctcatgtgatggagggaggggcagagagcatacgtggggggaaggataactgagtttcctgttcccaggctccaaggctttcttggagtgctgtgattctctggactgcagaaggctggccttagctgagagaccagactttgactctgtggaagaaaaccgagagaatccagggcctggtgctattgccagctccccatgtgtccccagtttttaaatcttgtgccacacgtcagtgtatatggctgtgaacctgccatgaaaccataatattttgagtttaatacatacactcctgtttggataatgagtaatcataggctttagaactaaaaggctgctcaaagattctgtataccaaattcttcaatttgcagatgagaaaactgaggcccagacaatggtgaatcatccaaagttaccccagcatattactttcagagtcaaatttagaatctgagtgacctagttcatcagccagggtccccgccccattgtactacactgtctccagattaggaaaagggaatgactcctgatttgttattccattttataccttatatcccatttaatggccacaggcagcttcactggtggttattaaataggtaatttagttttcctgagccacacttgagtaaatctctttgttttgttgtcacaatctacaaaaagctccaaagaatctcctccagagctggaaataataaaaacacctgctattcgagttccttccaaagagctcaaagcagttatttttatttcacctaccaatcgttgaatacctatgctgtgccaagtgttttgctaggtacttgactattcactattgtgagctcacaaccacactgtgagctacaattatttttggactttaacatacaaggatgaaggtttaagaacctgccaaaggttacattttaataaattataaagttgggttcctggacccaccgattgcagagcctatgagctctcccgtgttgacctggctagtgaatctatttgtgtgtaggtatgtttgtgcctttacttacgttagcccatacttacaccaatgcatatttgtatctatagtggaagatagagcttctgcttaatatccttctggacgtttgtagatctattttatggatgagaaagttgaggcccagggtggagaagtgactctaataaagtgtatttaaagcagcacaggagtctgggttccatcaatcatggggaataaggccaggcttattagatcagggtaggaatgggatgcgtagctattggggttgtgtggtggagagataaacaatattaatgttgacgttaattttgtttactaaatttgttaattaatgcttacaatctcaatctcaaagattaatcttaatctttttgtagtgacttgctgtttttaaactacccttggaatagggaaggtatttttacctcccacgaatggttgggaaaactgaccttcgaggaggtgaagggatttgcctaaggttacaggaccaggaagactggatccaagactcaaacccttatttgtgtgcctctgtcttcacatcagctttagtgcaacccttgcatcaaacaatggaaaagtagtacctagtaaatggagcaaggtgtcttattctgtgcccagagcctctcattttaaacaagctctgatcatctcatctactacagaactgtatctggtattctggggccatttttaaacagaaggtttcacttattctctcctgtattagtatatggccgagaaaattagctgagctgttattttcctttgctgaactggggaacaaaaacaaaaaaacacacagtaatccagccactggttctgacactgccaagcacctgttaggaggacttcctactccaagttcaaaaggtacggactgctagaaaagtgtgtgtttgggggcccagagtctaagattgcacttgcgtcactggctgcaagagtaggatcaggtccactgtttttcatggcacaaaaactcaacagatagtgcttcacatccatatactgtttctaagcactaatgtttactttgggtcttgcacatcagcagctgatggtgggaaaatacacatctctagttattgccccaaggcggcagcctcacatctaaactgctggcttcttccttattatctctccacaggcctggttcatttccttgttttcagttttctcttagctgtgcattcatatcagtcattgtaaagagcaaagagaaataattttaaaaattttccatatgggcatcttgagcattgcctcagtacactctgtagctagtatagatatctggggaaactaagaaggaaaatttctttgaatatagaaaaatcatactagtctccagttatatcattcaacagcagtccccccagcccacctttccatacctctaatctgtatctgtgctttgtactatgactctgatgtaagagtttggctctctgaagatggtaaaaatttaaatgcttgaggtaaacacagtaagatagttaaaaacacactactggttccatcagctgtctctttgcccttggaagtcatctgacactgatggcagcagtgacccatctggagcagccactgcgaagatgctggctgcagtagaggaatgcactctgcagagctggctggggccagaacaggtgggagccctgtcccctaccaagttggcagggtgggagccccatgctcccaggcacatctgcagccgcccagctgcggctctggacctgggcatccctacgctctcaggggcccaggaagccccccttcctttgcagacttggaaatgcttgctcctactccctggcctcttcccattgctggtgcctgctctggagtggggcagagttgtggctgagcccagtgctgtcacaatccagccaggtgtacatgcacttgaggtggtgctgacacgctagcctcctgccaccttggccctctctggaccttgggcgccaacgagcatggcaggagctgagggcagctcggctcaggcctgcaggtgcctcagtaggaacagactgggtggcgggttgatggcaggaggaagcagacaggctcctgggcagaaaggagcgggtccctggcgaaaccccaccttcaagccagggacagtccgaagcctggtggctggactgccagttccaagtggagtctgtggcccagagtgagaacttgtgttgctttttctgggtccacccatggctacccatggaccaatcagtactcatttcctcccttctgagcccgtaaaaatccctggacccagtcagacacggacagactcaggactaccagctgcaggaaggagctacccactttgggtttctccacccattgggatgacctgcctgcagaaaggagctacccacttcgggtctcctctccactgagagctggacactcatctagacgacctgcctgcagaaaagagctacccactttgggtcttctgagagctattctgtcactcaatgaagcttctctccaccttgctcaccctgcagttgtctgtgtatctcattcttccaggttgtaggataagaactcaggacccactgaatggcaggactgaaagagctgtaatacaaacaaggctggaaacacatccctccggctcactcgctactttgtgggcaatgaggagagaagagctgtggcccttcatggagcccagacctaggggctccccaagccaggggtgtgacactgtctttaaggctttgaggttcatggcatctccaagcctccaggtgcccgtgttcccctcatccagatgcgggtgcccatagcagaagccccatgcagcacatcagatccagctgcagccttgcgtggagctggcacctgtgccagcacctgtagctgcctcccctgccacagcagcttgcttgtctggttgtgtgcagtggccggactctgcacttgctcacccacacacccctcactgctccacgcctgggtcacccttggtaggtgtgggatccaggatggtggcgtgagctgagcccagcctgctgggccaagtgggtggaatgagcccagcaggcacgagcaatactcaggcagaagatgccaccagccacagaggtttccggctggcaaagtgacaccccgaggatcccatgacagtacttcatgcctcagttcccccatctgagaaatgggaataatagtacctcttgcatagatttgagtaataaatgagcttttatttgtaaagcacttagaataatgtctggccatactctgtgtgtgtttagctatgattaatgtgattgcagtaaagttacattatgaatagtagcagtgagcaagagaaaatcaaagatttattacttgatttacaggtagatgacgtcttccttctgtgtgtcaggcattgttataggtatgttagatacagtggtaaacaaagccaagctccttctcttatagagcttctatcctactggggacgttcataaactcccatttaaacatatgtatttataggtatatgtaagtatacatatatgtattgtatgtgtgcataactgtgtgtctctgtatatgtgcatatttataagtgtcttcatacacatgtgtttatgcatggatctggtatttatacatgtatgtgtattacatgtgtatatctgtatgtagttgtgcatgcatatgcatccatgcctgtgtctgaatgcgtgtgtgtatgtgtatatactgtgcatgcacatgtttgcatgcccctatttgtatgtctgtttatgtgtacatttatgtgtgtgtctgatttgtgatgtgtttatgtgtatgtgtgtatattctaatgttcatgagtgtatatgcatgtgtccgtatatatgtatgtgtatatgtgagtggatatgcatgcatgtgtttgcatagggtactgctgagtgttatgaagaatagtcctgattaaagtgatggaaagttccaggaggtgctactggtatacagaggtcaggaaagttcagtctagaatggggacatttgaggaaacataccttaatgaagagaggaaatatttcattgtgtaaaaagcaaggcagagattttttcaatcagcaaatatatgttgagcacatactttgcctcaagcatgtgctgggcactgggaataccaggatgaagatgacccagtcccttctctagatgactcagcagctggtggaaatgggagatctgtattcagaaaaatcctaatacaacttgcatactgcttttccaggcggtgtaaaaatgttacaagagtatagggaatggatcagccagctcttccaggacaagttaggaggtgaaaactcctagaaagtgaaaacttggataagccttttaagaagcagtagtagaatgtgcagaggctcagggacgttaaaatgcccttcataatcaaggaacattttggtgtggccacctcgccattcaaatgtgcgagaggggcagcgagaggcagccgggaagacggagcctgtgtagcacactctgactggaatcagactgcctgggttcaaacccctgttttgccacttgttagtaaagagcttacctgctctgtgcctcagatttcccttctgcaaatggggatgggaatagtgcctcacagggttattttagagatgccttctcctgacacattgtaagcactcaacaagtgttagctactcccagttggaagctagaatgtaaaaggccttaaattcccagccaaagagattgaatgctaaaattaatttcaagcaaacctatctgttcaaatagctttctcagcactgattttgatgtgaaaaatatctggaatattcttcgttatcaagcatgtgccttggtagtgtaattacagtttttaatactaatggatgatcttccattaaagtagtaaaaagataccatctcattttaagcttagagcaaaagcttacttaagtgaaattaagcagatatttattttgtcaggctctggggaggattccgaaattatttgctccctactagtgcctagcactttatctttgcaaccgcacttaccctgtagagtcatagttgcacaggaaactgtattcctgcatctctaccttcagtgtttcacgatcactgtttctcatctgccaggcctgagggtgggcagtgctgatttcactgtctcatacccactcttctttctgccagtgtcttttgtgagagcaattttatctctgcccctttctcttcaccccattgtctcttctccagtcttcaaacccaaacaaaaaacatacaaagtttgctcatattcactgcagtctgagctgctgaatgttcttccagagccccttaggatttctgcacccatacttgtaaatgtttgcatcttcattttgttggtggtgatgacaaattaccccacataacttgcctctgttcctgttttagttagaaattactgtttactggagacagaatggaaaatgtatgaaggggcaacatgagaaaataggttattttgattacttccaatcatccatcgttaatcgaattcataatatagataaccaaataaaaagattatttcaatttaaacttagaatgacttataggtttttttaatctgatttccattcttattacttcttgcagcagttttcaaacttgagtctgcataggcattcatggagctagttaaaatgcggatggctgggtccccaccaccacaactcattctgatcagtggctttaactggggcctaaatatctgcactgtatccagcccacacatgagcctgatgaacttcaccagtggtaccttaaaagatagcaagaggggcagactaattagactcaacgttgtttaccatcaaaaactgtctgtacataatccagaaagagcaaagttgaatccaggctaattgaaagactgcattttaaattttttgtttcaaaagtagagcaataaagagtttttccaatgtgttatacttcccatgagctggatactacctgtttacctagatgccacttaatgtggacagcaacttttatggctgtgcacattctcaccacccccatttaaagagaggaaggagactcgcttagactcaggcagctagtgtggttgaacagagagaaccttggtctgtctggccccagcttgctctcttttaccattatatagcttcacccaagccagcgttaacagctgtagatgattttcttctaatgttctaaaacctgaagacatggggcatcttttaaccaaatgctcagctctagggaaagctaagcctcttctattttgttgaaagataaagtgttaggctgtcgatctgtattgttacaggtccctgggctggatttagcctcaggagttaaaagtatatcagccttgtgactcaccaccatgaaaccctcagatgggagtctcctaccagtatcaataatatgaatgaaaactttatatgccttctggattgaggcctctcacagctcaaagttgtaaagaaaaacccacgcaattggattttgtgaaatatattaaatatgcccagtaatgtggctcttcaaaggaatttatatactgtctgctttactgtggtgtatcattatagctcagccaaatgcgtggcctaataatttgtttcccttatgcatatccatcattaaatgtaacatgcagacaataactatttaaacacctaaatagatgattatatagctgtctgtcccacttagactgtgaactttttatgaacaatggaatctagtcatcttcatctctgtgtctcttagctcagtaaatgaatgaatatatgcatgaatgaatacatgcgtgaatgaatgggtttgcttaacatgctaagcactagactagttactgtggcaaatacagtgatacaaagaaatagaggcagatggattgagttctacaggaattttaaaaagggaagaatcactttcagttgaaacagtaaggcaaagaaaagacaaaaatactaatatttattgagggaccttcctgatagaaatatgctagagagtctacatgtataatcttcacattgactccagcagcttgctcaaggtcacacagctggcagtgagaaccccctgaggttagctaccatggtccttctgggaagtgggaagggatagcctttgaatgaatctgggagaataggtgtattctccactggaagcaatgaaacgtagagtattctggatggagagaataacataaatggaggcactgagatgaggtcgtggaatggtaagcatttcagtttggctgaaatctatgatatctctaagggattcctggaagaagaggatataatgatcaaataggtggagatagattgggagtctgtcccatctgagtaccgttttggagtttgtgcttcctctttctccctggaggcattggcaaatcattgaaggtgatctcaagccagagattcattttaagcatggctttatatacttttatacacaatagttgggggaaaaggcaaagaggtttcctgaaataggttttggcagtggggcttgaaaagaagatagggagtttgacaactttttaaaacaaatccatgcattaggcacaagttatttaaaatttttgatgttctttatattcttctagctctttctatttacatagctattactaaattaaatgtataaaagtatttttcctttttaatttgaaatagatttcatctcatatttggcagaagataataataacttgttaacttcaaggcagtcagggtaattcatccagtctcaaactgggcattcatttaaatctattgtcttagatggagatatctagtatactcactcatttaaagtagagccgtaaatcctgaagttaaataagcaaaacaaaaggcctcccaaagctgagaaaacacttgccatagagtgcacatactgtaggaaagtacaaggattattctccggctgtcacccagcactgctaacttagaattatagataaaatatgctgtaattttaataattaatagctgactatgcaaaaatattattttctcctagcttcaaccaacaggtaacatatctgcctttcatgtcaggtactgtgctaggtactaaagatataaatatgaacaaattatagtctctgtcctcaaagagctcccattctgattggacaaacaggcaagtaagccatccgagtatgatgtggaaagtgtctgataaaagcatgtctgggctattacaggagtctaacctcactttacctgagcaagttagtaaaattccctccccttcccccaaaaatgattggtttgacacttaaagatgaattggagggagaaataggaatttatcagatggacaagacggctaggcaggaaggagggtgagaaggagagggaagcagagggaggtagtatgcaccaagatccagaagcatgagggtacccctttggctgcagaataccgagtatactatagtgtagagtatgctgaaatagaagtgtgagagatatatgtggggacaaagtttttgagggccttgaacatcatttaaaagagattggaatttttatccttaaggtactagcttgtaaacagaaactttagaggcagtgaggttaatggaccagaagacgggactgttgtaagagaccttgaaggccagaactgacgcagttccaaggcagtatcaatggaacaagaggggacattaaaaaattaaaaataggctgatgaacagtgatggggtcctttaatgcatgggcttaaagtgctacatatatagctctctgaagcaagagtgcactggacaatgatggcatggcactatttaacagaagtaagcagagtctatgtgtcaggaggattgagtgtaagtctcaaatctgcccttaccagttatgtaacttctacaagtcacctctttaaacctcacttttttatataggtgtgaagatcaagattcatgctttttcttctaatatatccacttttatatgccaaaattttcctactattgaagtggtattgttggaataaatgtgatcacaaatagaatgtatttaattcattaatttattcacttgccatttattgaatttttttttctggcaacaatgggctgtcctcttggtcccccaaaataaaaagctggtgaaaattaaatgtatccacatattcaactcacaaggcaccagagagctactaaaggacttgaggggccaagatcaaaagagaagcctacagagctgggttcaacatttccacccttttatacgctgagcatttactgacttgctgagatttggactcaacatttccaccattttataatacactatgagcatttgctgagttgaaacctgcaactcagaggccaagaagctaaacaccagtttgggcagtctgcaggctggaagtatatatatttgagtttggacatcattgaagagggagaatactagtaaatcctctaggtgttatttgggaccccgaaagtcagtgtaaactaaaaatagacaaactttacaaaggccaaagcctgggtttgaattaaattaacatctgattaaattcagatcatctatccctacttgagctaactgcaagaagcaaggttatatcctttctagaggtaggtaacataatcagaagctcaagttataactaaaaggtttcatatgtaatgtctgcattgagtagaaaataagcatgtaaaatatgaataatttcaaaaatcaagagtaaaaacaaagccacagaaaagtccatatgctggtggtatttgacatgaactctaacatatctgtgattaatatggtcaacaaattataggagaagatggagaattcagcagagatctgggaagtagaaaaagaagtggggattctagaattgaaactaataactgagattaagaattgactaaatggagtaaagtcaacagcatacaatataattgaaaagagaattagagaactgaaacatagatctgaaaaatctatttatactacagccagtatacaaaaggatggaaaatacatgaaatacacaaacaagtatgagatatatggagcatggtaaagaggtctaacagaggtgtagttggagtccaagaatgagagaagagagataataaatcatacatagaagctatatttgaagagatattggccaaaagtttttcaaaacttataaaagaactcaagtgagttattttaacttttgaataatcaattaatgcaattccatattaaaaggatgcaagagaaaaattaacagttgtttacaaatgcttttgatacaacttagcacatattcatgatttttttaaaaatcatggcaaactacgagtagaaaggaacttattttgattaaggatatcaacaaagaaaaaaacataatgcaaatatcatacttaatggtgaaatattacaatgttccaattcttaccacgtttattccacagggcctatctagtgcaacaagtcaagaaaaataaatggaaaatataagaattagaaagaaagaaagctaacatcatagatgatacaattatacacatatagaatgtcaaaagaatctatagataaaatattaaaattaataagtaatttagcaaggttgctattgcagaaagtcaatacaaaactctattttatttctctaatccagaggcaaccatttagaaaataaaaattttagggaggagccaagatggccgaataggaacagctcccgtctacagctcccagcttgagcgacacagcagacggtgatttctgcatttccgtctgaggtacggggttcatctcactagggagtgccagtcagtgggcgcaggacagtgggtgccgcgcaccatgcacgagctgaagcagggcaaggcattgcctcactcgggaagtgcaaggggtcagggagttccctttcctagtcaaagaaaggggtgacagcacctggaaaatcgggtgactcccacccgaatattgcgcttttccgacgggcttaaaaaacagcacaccagattatatcccgcacctggctcggagggtcctacgcccacggagtctcactgattgctagcacagcagtctgagatcaaactgcaaggctgcagcgaggctgggggaggggcgcccgccattgcccaggcttgcttaggtaagcaaagcagccgggaagctcgaactgggtggagcccaccacagctcaaggaggcctgcctgcctctgtaggctccacctctgggggcagggaacagacaaaaagacagcagtaacctctgcagacttaaatgtccctgtctgacagctttgaagagagcagtggttctcccagcacgcagctggagacctgagaacgggcagactgcctccttaagtgggtccctgacccctgaaccccgagcagcctaactgagaggcaccccccagcaggggcagactgacacctcacacagacctgcagctgagggtcctgtctgttagaaggaaaactaacaaacagaaaggacatccacaccaaaatcccatctgtacatcaccatcatcaaagaccaaaagtagataaaaccacaaagatggggaaaaaacagagcagaaaaactggaaactctgaaacgcagagcgcctctcctcctccaaaggaacggagttcctcaccagcaacggaacaaagctggacggagaatgactttgaagagctgagagaagaaggcttcagacgatcaaattactccgagctacgggaggacattcaaaccaaaggcaaagaagttgaaaactttgaaaaacatttagaagaatgtataattagaataaccaatacagagaagtgcttaaaggagctgatggagctgaaaaccaaggctcgagaactacgtgaagaatgcagaagcctcaggagccgatgcgatcacctagaagaaagggtatcagcgatggaagatgagatgaatgaaatgaagtgagaagggaagattagagaaaaaagaataaaaagaaacgaacaaagcctccaagaaatatgggactatgtgaaaagaccaaatctacgtctgattggtgtacctgaaagtgacggggagaatggaaccaagttgaaaaacactctgcaggatattatccaggagaactcccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtagggttatcctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcttgaaggaagtgctaaacatggaaaggaaaaaccagtaccagccactgcaaaatcatgccaaaatgtaaagaccatcgagactaggaagaaactgcatcaactaacgagcaaaatcaccagctaacatcataatgacaggaacaaattcacacataacaatattaactttaaatgtaaatggactaaatgctccaattaaaagacacagactggcaaattggataaagagtcaagacccatcagtgtgctgtattcaggaaacccatctcacctgcagagacacacatagactcaaaataaaaggatggaggaagatctacctagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcacccagattcataaagcaagtcctgagtgacctacaaagagacttagactcccacacattaataatgggagactttaacacctcactgtcaacattagacagatcaacgagagagaaagtcaacaaggatacccaggaattgaactcagctctgcaccaaggagacctaatagacatctacagaactctccaccccaaatcaacagaatatacatttttttcagcaccacaccacacctattccaaaattgaccacatagttggaagcaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatcttctttgaaaccaacgagaacaaagacacaacataccagaatctctgggatgcattcaaagcagtgtgtagagggaaatttatagcactaaatgcccacaagagaaagcaggaaagatccaaaattgacaccgtaacatcacaattaaaagaactagaaaagcaagagcaaacacattcaaaagctagcagaaggcaagaaataactaaaatcacagcagaactgaaggaaatcaagacacaaaaaacccttcaaaaaattaatgaatccaggagctggttttttgaaaggatcaacaaaattgatagacctctagcaagagtaataaggaaaaaaataagaatcaaatagatgcaataaaaaatgataaaggggatatcaccaccgatcccacagaaatacaaactaccatcagagaatactacaaacacctctctgcaaataaactagaaaatctagaagaaatggataaattcctcgacacatacactttcccaagactaaaccaggaagaagttgaatctctgaatagaccaataacaggctctgaaattgtgtcaataatcaatagcttaccaaccaaaaaaagtccaggaccagatggattcacagccgaattctaccagaggtacaaggagtaagtggtaccattccttctgaaactattccaatcaatagaaaaagaaggtatcctccctaactcattttatgaggccagcatcatcctgataccaaagccaggcagagacacaaccaaaaaagagaattttagaccaatatccttgatgaacactgatgcaaaaatcctcggtaaaatactggcaaaccgaatccagcagcacatcaaaaagcttatccagcagcacatcaaaaagcttatccaccatgatcaagtgggcttcatccctgggatgcaaggctggttcaatataggtaaatcaaaaaatataatccagcatatacagaaccaaagacaaaaaccacatgattatctcaatagatgcaggcctttgacaaaattcaacaacccttcatgctaaaaactctcaataaattagatattgatgggacatatttcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggtaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagatccaaatcatgagtgaactcccattcacaattgcttcaaagagaataaaatagctaggaatccaacttacaagggatgtgaaggacctcttcaaggagaactacaaaccactgctcaaggaaataaaagaggacacaaacaaatggaagaacattccatgctcgtggataggaagaatcaatatcatgaaaatggccatactgcccaaggtaatttacagattcaatgccatccccatcaagctaccaatgactttcttcacagaattggaaaaaactactttaaacttcatatggaaccaaaaagagcccgcatcaccaagtcaatcctaaaccaaaagaacaaagctggaggcatcacgctacctgacttcaagctatactacaagggtacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattccctatttaataaatggtgctgggaaaactggctagccatatggagaaagctgaaactagattccttccttacaccttatacaaaaatcaattcaagatggattaaagacttaaacgttagacctaaaaccataaaaatcctagaggaaaacctaggcattaccattcagaacataggcatgggcaaggacttcatgtctaaaacaccaaaagcaatggcaacaaaagccaaaattgacaaatgggatctcattaaactaaagagcttctgcacagcaaaagaaactaccatcagactgaacaggcaacctacaaaatgggagaaaattttcacaacctgctcatctgacaaagggctaatatccagaatctacaatgaactcaaacaaatttacgagaaaaaaacaaccccatgaaaaagtgggcgagggacataaacagacacttctcaaaagaagacatttatgcagccaaaacacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttgaaccattgtggaagtcagcgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgttagggacatggatgaaattggaaatcatcattctcagtaaactatagcaagaacaaaaaaccaaataccgcatattctcactcataggtgggaattgaacaatgagaacacatggacacaggaaggggaacatcacactttggggactgttgtggggtggggggaggggggagggatagcattgggagatatacctaatgctagatgaggagttagtacgtgcagcgcaccaacatggcacgtatatgcatatgtaactaacctgcacattgtgcacatgtaccctaaaacttaaagtataataataataaaataaataaaaatgtttaaatagcatgatttacaataaaataaaaatattaagtacctaggaaggaagatgtgtaagacatctatgcagaaaggtataaaacattgagagtaactaaagaagtcataaataaatcgagggatatatgatgttcattgattggaaaacagtattataaatgtgacagtttcttcccggttgttctatagattcagtgtacttcagttcagcattctagcagatttgtgtgtaagaggatggaaattggtagacatcctaaaacttagatggaaaggatcaataataagacagtcttgaaaaagaacaaagttgggaaaactccataatgccagatagcagaacatattacgaagtaattaagaatggtattgagggaaggacagacaacccagaggaaaacagattaaggagcccagaaacaaactcacacatgtatggacagttaatttgtggcaaagatgccgttgccagagctgtaaggaagcaatgtatttttcagtgaaatagtaccctgccgattggttatcactatggcagaaattgaattttggcccttctccttatactatgcatacaaatacattccaaacagattaaaaacttaagtatgaaatttaaaaaaataaagttcctaaaagacaaggtcttcatgactttgagatagacaattttcctaaataggacattaatgtaagtacaaccataaagaaaaggattggtaaataagactatgttaaaataagaaacttcttttcatcaaaagcttccattaaaagagtgaaaatgcaagccacaaagtggaaggaaatagttgcaatgcatataacaaaagatgtgtatccagagtatgtaaagaatgtctacacattaatgagaaaagaacaattattttgacagaacaatggttaaatgtgtataaatgtgtgcatatatacatttgagcagctttgcagaaaagaggatatacaaatggacaataagatacgaaaaattgtccagccttgttagtcattaggaaagtccaaattaaaaccatactatgatatcactacacaccctgcaggttggctaaaatcaaacggtttgataatgccaagtattgatggggatatcaaacacctgaaatgctcaagcattgatgtggaaatatgaccacactttgggaaagagtttggcagtatcatgataggctatgattcagcagtcctattcttagacatatatccaacagaaatgtgtaccagaaaaaatacgtatatagtaatacatgtaaaaccattatttgcaataggcaaaaactgcaaacccccagttcccatcaataatagaattcatcaatgtttggtatattcgtggagtaaaggattttatggcaacaaaaatgtacaaaatattgctacatgcagcagtgtggttgaatctcacaaacatgggtgactgaagctggcacaaagaaaatacaccgaatggtttaaaaattaagcaaatcctgtggtgtagacatctggacagtggttatctctggcaaggcatggtatttggaaaaggacatgaggtttatttcttgatctggataggtgtgtttactttgtaagactccactaaattctatacttaaaatctgtagctttttaatgtaggttatacttcattgataaggtttattaaaaatatcaaaggctctgggccgccctgtgctaggcactgggaatgcagacatgagtatgaaataacctggctctgaagaacggagaggaggaggtgagtggtaattaataaacaattagagaaggagtttgttagaagtgaagtcagggtgtgtcactttatatgtcagcacacaaaggagcaactcccaactcaacacacttcctgcctgtattaggtgcttcataaatgttaaattctactcccaccttgctatactcataatcatgagtaatcaagtaagggaaaaattatgttatgaatcctcttttttagtgcacaatccatgttagtgatagtggtggcaagtaggcttttttatttgtctgtttgtttgtttgttttttgatgtctttaacagtgagccttcctcaaacaatgtattagatagaattgcaacttcctcagctgaaattatttcatcagtgattactttctccatggaatgttaatacattgagtttctcttgtatatataaccagggattctgagcctctttcatctctgccttgggccacacagccccatagaaagatgatggaagggagaagaagggaagaacacctgccagcctgccagaatttcggctatagattggcaagcagacagctgaatggagggaggatatggacaatgaaaaggaccatctaacttgagggcacagtgcccaccgacagcacagcaggtgctgccaggcctgtacagagctggaaatcctggcaagatggtagctgctccatcttgtctggcctagttactgcctctggcccatgctgaagggagtctggggagttaccattccaaagaactcacaagaaaacagaactgacttggatatattccaggtttgcctagtggtacttcaaaatggtagattgaatgttattttaaaagtcattttaaaattatttcctttgaaatacagaatttaataggagaaaaatcagaaggagaatgaaaaataatatggatatgcagaatatatccgaaagaaatgtgtacttcaatgtaccaaaaatatgtacagggatacagataacaccatttcaacagcttaatggttagaaagaagtatgatttctggagccagactacctaagtttatattccatgctgtcacctactgtctttgtgatcatgtgtcagttactgaacgtgctgagtctaaatatttcatctccaaaatgggcatcatcatagcagttgtaagaattaaataagttaatttacctaaaacactcaaaacagcacctgtcctgcgtaaatactacacaactactagctgctgctgatgataacagctaagccatttttgtggctgagagtcagcagccacagccagggtggaggagatccttgtaatcataaggtcagaggaaagagggcctcagtaaagaaggcttcttaggcccatacagcgggaattacttcttgccaaaaggcttgtttgtcctctcttgaagccatgattagtctgcctctgccatgtcgttggctcctcaggagattacaagctctctgaggacagagattacattttttttcaagtattatttccccagcagtgctgagcacagtacctgatgtaaagttgtgctctgtaaatgtttactgaattgaatccttctaaacagaggagggagatactattaatcagggctgaacgtgtgacagcactgttctttcaagccaagactatatgtatgttctttactttttttttttttttttttttttttttttttgagatggagtttcactcttgttgcccaggctggagtgcgatggcacgatcttggctcactgcaacctccgcctcccgggttcaagcatttctgtctcagcgtcccgagtacctgggattacaggcatgcaccaccacgcccggctaattttgtatttttagtagagatggggtttctccatgttggtcaggctggtctcgagctcccaatctcaggtgatctgcctgccttggcctcccaaagtgccgggattacaggcatgagccaacacacctggctttttttacttttaaatcatcatttcccttttagagatgggatgtcagaggcccaaaaaactcagttcatttgcgtgaggtcatgtaaatggtgatatctggaagtgtctccctcaaagtcagtgccctccctcacaggcactcattccctaaggcacctaggatgggcacagagaaaggagaaccaagcttggctggggctgctgtccagagaaggtgggcaggtgtcaagagcaggtgcagaggtggagaggagagctaaatcttgtcctcagtagaagcagagatgtcatttcaactgcaggttttgaaaaatgtcagtgcatacttcatgagattttctgaattcatttttactctcatcttctacactatttatctaagctgttgttctctttgaaactatgtcagccacatgtcattcattgtgccacaaccctgggctttttatcctgcttagggttttgttttgttttgcttgttttttctccccagctgctctgcctatcacttaattctctgagccctctggcctgagtcttatccggtggtgtgggtcaccttacaatcccgtttctagtctcctgggagtagtggtggcaggcgagggatagaatcaacatccaggttcagaatctatttgtcttttttggtcttattgtccgaagcttgagtcaaggataaattaatcagtctagaggtgggagagccctctaaccctccccagggaaaatcctagcctttatagaaacttggcctggttttggctctcagatttaattccaagctgtgaagaatctgtcaatgttcaactaaccctgacaaaacctttggaagtttctgttgcaaccgaaactcttatcacaggaggtggtactgagcttggcatcagaggttggagagagaagagagctagcctgctaattaatattttttttccttaaatttcaggcttttttttttagtttaaatgttctaaagaacctgtcctgtcacttcccatctgtttcctggtgttttcctcaagcatctcactggtttgttttatgtttttgaggggattatctggggtgctgattactttccctaccttcaaggagcctttgaataattttataaatgagaccatttgtctaggggcaagagaaggttgctgaaggcaacctagtcctgctttctcccaagagaaattgtacactaacatttgtttagtagtgcctatatcccaagtacaaggctcttgccttatacctaggatgagcaactattccagtttgccccaagataagctggggggtttccttgggtcctggaccttaaatagagtgtagacgaggagagttatcttttcttctgtctatcctaggttcatagctggggcccttttaacaaaagatagattaacaagagagaagcatacacatttatgtaatatgttttatgtgatatgggaggtatcatacagaaatgtagacccagaggaacagttaaacatgagtatttttatgttaggcttgatgaagagtagacagacatggaaaaatatgatagggcaagaagggcatgatttaatggtaataaactggggaacttagcaaagcctgttagtgcagtttcatccgtgtgatccttcatctccagatacaaggatggtgctttcctttgagtacagggagggcacctctcacatgagggtcttatgacctgcttcaggggacagtcagaaaatcctaggtttaatgacctgctttaggggagaatggtgggggaaaggtaagagtgacctctatgcctctatgattttctcagataccttcagcttaaactattcaaaatactaacatgccatattttgggatagcatgtcctgaaccccatcaagtgcagataccaggaaaaatgaccctgtaaaggaaatgccattatttccaccttacaagtgagaaaagtgagtttcgaagaggtgtgttcacttacagaagtttgcacaggaaactggtggtgagaaagaatcaaatatacatctgtcagacttcagacccagaactttacactaaccaacttcttcagaatgcagagttccatctccttcagactgtgtagctcaacagttttgtaccatctggctatttttctctactgtgtatttgactttgtctcttttgtctcagggtgtacttgaaagcctttacctccccatcttccttccctgatggctgatatacttctgcctcacctgctttaggagcccctgcctccaaccatccaaactaggtcaggggctggggctccttccttctgttagactattcagatctgagtcactggtcattcgcatagtgtcttataaatgtctgcctgtgtatttttccaccactgctagactgggatcttgtagaatacaaggaaacaactttcatctttagatttctagcacccagcatagttcctggcttataattggggatcagtaaatagctgttgaattaatcaatttataaattttcaggaagcatttgtgtgccttcgagtcacagtatttgatctatttaaggacttattccataagatgcatttgtgatgcttaggccagttctcttaatttttttttctatttttaatttttacaaagtaatttttgtgagttaacttggctgtttggattagatttcaacctgatactttaccatgcctaatgtctgagaatgagaaattgtcttttctgaagtcatagatgataatgtccaagtaatctagaggctgtgttgaagttaggaagaaaggaatttctgacatcaagtttttgctttgtcttcactgtggatttttctagttttctctaagtctcaaatttccaagctatacatattagcctacctttgagatttgatctttctgggtaggaaggagaaacaggagtgagacccagttatcagaaggtctgttctttgttctctccactcctcgcaatacaaccagcctcttgaattggtttctgattgctctaagtcatggaggagtgtggcatgaagacagaaatgatgaatgccatcccaagttaaactgcagtatgcatggtgctacatgtaattgtggcttttcatgaaataagcagattttggtttattcttaatgtttaaaatgctagcctgggttatacctactacctggtacctcattttccttattcctttgggcccgcaattattttgtcatcagttgtatagtcaaggacagaaaacagatgttccaatcaatctaagtaaacccaaataactctggcaaagcacacaccgtgctgaaatcaaatgaactgttatgccaagccttgctattaacaccaaagattggaagttgttggtagtaacatcaaaaatggtgaaaatatattgagtaaactgtcccagacattgttcccctcagttaatctccatgatagccctataagccacattctatcatcattccaattttatagatcaggagactgagacataggaaacttaagtgatttgacctacttgccagacttgaaaccaagcagtcgagttccagtgcccttgctttgaaccattacgccctaactagttcatatatctagtaaatgtctgtttacatctcatgtagaaaaagaccttccctattatcttgctctgcagagggtgggagggttggggtggggagggggcagtggcagtgtcaaggtgtgtaaaatttctctgttgacttaaagcataggatgatgatgatgatgatgatgatgatgatgatgatgatgatgattattattattattatttgagacggagtctggctctgtttcccagtgcaatggcgcgatctcggctcactgcaatctccggctcagtgcaagctctgcttcccaggttcacgccattctcctgcctcagcctcccaagtagctgggactataggtgccgccaccacgcccggctaattttttgtatttttagtagagacagggtttcactgtgttagccaggatggtctcgatctcctgacctcgtgatccaccctccttggcctcccaaagtgctgggattacaggcgtgagctaccacacccagtgcagtaaaagtaaacctactttaggatttagttggggtaagttctagaccacatttctttcaaggtcaaagcaatacttcatgaaacattgggattacctttttgacttttttttttttttttttttgagatggagtctcgctctgtggcccaggcttgaatgcagtggcgcgatctcgattcactgcatcctccacctcctgcattcaagcaattctcctgcctcagccccctgagcagcttggactacaggcgcgtgccaccatgcctagctaatttttatatttgtagtaaagacggggtttcaccatattagccaggctggtcttgaactcctgacctcatgatccacctgcctcggcctcccaaagtgctgagattacgggcataagccaccatgcccggccacctttttgactgttttactccccttcatttgctaggcttgaggttaaccctttgggtttgctttagtggcattttgacagtaagtcctgaaagagatctgagttcagctatcctattgtctaggaatagttggagttcttgtaagtagttgaaaagaaaggaactagcttctgtgaactccacgagataatgtaggataaggtagaattagagtcaggtagatctgggtgtgatatagtcccaccccgaggtcccccacaatttagtagtgtgggaccttgtagaagttgcttggaaaactttactctccttttctctatttgtaaatcaaagtgataataactaccttgcagtatcactgtgggaatcaaatatgataatatttgcaaagtgtcaagcacaaagcaatctcccaataatcaaggatcttagaacctttagtctttaccagtgatttttgacaaggtatgttgtgaggctccagtaattacattattacccatgagttgtcactcaaaaccaatcaatatttttcacctttattcatatttaagacacggagcctttgtccgtgattaaatgtgctattgttacctagaaaatgtcttgtgctttactagtatgtgacttctgccacacacattcatttattcattcattcattcatcaacaataacaacaaaaaatagtgagctactgcagtgtgaagacttgccctggcctccgtttgcttatagtgtagtagagggatttgtttgtgttgtctgtgcagacacataaactaaagttacagtgacagaatctgtagagagtcagaagatgggctacaaaggaaggaggcttggtcggttctgctggtctggggtgttttggggatgtggggagatgtgatcaggaaaggcttctgatgctgcaactgagtcttcaaaatggagttggtgttccccaggattgttatgggatgaggtgtattggtggaaaggatatcctaggcagagggagcaaagtaaacaaatgcttagtggcaaggaccaccaaatcacattcaggaataaggagaaaaggtcccaaccatatggaaccctgctcatgccaggcaattctgcaggtcgtggatggcgtatctcccatttattgagtactggtgtgttccacctaaatctcatttaattctcacagcaactttgtgggtgagtattgctatccaaattcttcagatatggaaattgaagttctaaggggtcaaggcatctttgcccaaggggatgaaagagggattcaagtctaactctgaagaagtagataaacaacaaaaacagcaataacaataataaaagtaataaaaacagcaaaggttcatatagtactaggcatgttttaacctgtaccgttcaatataatatccactagctatatgttgctacttaaatgtgaattaattaggatagaataaaaaattcagtcctcagttgtactagccacattttcagggctcaattgccacatgtgtctggtatctattgtatcagacagtgcaaatatagaacatttccatcatcacagaatgctcttattagcactgttatgggtactttacacctatattaacatatataatttttataatctgtgaggaggatactattcatattgtagagatgtggaaattgaggcataaggaagataagaaacataaagaagataagaaatcacatgatgaatgagtccttatttttaagcactgtgccataatactaactcaatatattgtgttctgtttaacataaatgaatgttagtcaaaataatggacttcagtgtctgcgtgtatgtagtctggtgttaagtcttctgcagagaacacgtctttgatatgattcttatccttccagaagcatacagttgtcaatttgcatgtataaagctggtggtcactagagagtcttctctggagcccttcctctccaggaactccagaaacctcccagccagctttggcaagaaactcactggatgggattcatcagtcagttcattcatccaaatgactgaatcaagagtctcaaacagatgtagtcttaaataatgttcaaaacccttcttatcctttttgatacttcagagaaggtgcctgaggttattaaaagagaatctttttcaagatgccaacacatcagactcaaagactgaaaatcctagttgagtccaacttctacctctaagttactaaataaactcgactaaattacttcacctttctgaaattcaatttcttcaactgtgaactggaaataaaatacacatatcacaggattttctaaggactaattgaaggttacagtgtttgaggatactttgcaagctataaagtactttatatggctataaagtgggagataattataacacaaatgcgagaactcaggatgtttttcttctatataaccttgtaagctttcaaaactgccacagcgtgataaattataggaaaatgtactcttaatcataacatttgcaaagtctcttttttattttacataaatatagtagggactcaatgcttgggtggaagtattgttggttggatgaatgggagagatgaagggagacagcatattaaataagagagctgttcatgaagttttaaatgttccttttttaacattctttttaaacattgcttgatatgaactatgtgtgttacatggagggttgggagacatttaattcattgagttagcctgtttttctgctatttgttttttagttcaacaaacatttattgagcaactgccatcagttgggcattgtgcaagtttcagggaaaacacagttgatgatgtcactgtttttttatgcctgtttcttcatctgctaatttttctccttaaacattttgaggattgcagaataaactgacactggtatggtcatatgaagggccccagcggtaccgagggctgcacttgtgtcaaattgtttcctgatgtacacatgcagcctgtgagttctctgtggatggcaaaatatgtttctccggaaagaagaaagctcctcccaccttttcttgcttttccctgcttatctctgaacctcttttctcggggatagcccatcaaagcactgtgtggccaaaggaaaaataagatgtcagctctccgactcatgtggtcttgcagtgaacatcagctatgcatggctgctgaattggggtggacattaggcagagtgtagagaacctcttgaggggaaatgaggccagtcctgcccaatatatataattttaggtaaggagatacctcagcttgtattttaggagaagcactgtgtatatactgagaatggctgaggaaggacctccatttgtaattcatttctctcattgtggggatgagagaaccagttcaaacttttaggccatttgtggcagaattggggctgaaactcttgtttttctaactcttagcccatggctctcactgagtttcatggtgaactagcacttccaagtatgttttcattatgtaagacaattataacatcataaagtgaggagtatagaaagaacataagctttggagtcagacagaacaaggtcaaatcctggcactgcttcttaaatccatgtggccttgggcaagttacctgaacactctgctctgttcttctacttctgcatctattaagaggaagaaagaatgtttaccttttatggatgttgcaaagattaaatgagagaacattcaaggagctcagcacagtacccagcctatctttgatgttgatatgtttactagaaaggaagaatccagttgtctcttgagagggggttcagatgatgatgatggtgatgatggtggtggtggagagagtgatggtagtgatgatggtgacagagctaccattaaacatctctttttaagcatttctgcaatatcacaacaaccatgtgatgttgtgattttcctcattttatagcagatccttctgtctccaaattccatccttttctcataatagcacactagttctcaggttctaagtctagatatagcagcagtgaatctgccaacccaagaagaaacaaataaatatttcctacacatttctttttccttcattttaattcccttttcgtattgactgaccctgtaacattaactttgcctgtactttatgtttatgcaaccagtaaatgtgggtgattctcaggaattccttgaacctatttatgatactgtggagcagcgtggccaactccttttctgtcaaggatctcagaatcaatatatttaagatcccaagattttgagatgtacagataagtgaacattggttgcctggctattggatttttatcttagagaaaaacctgtgagtcttggtggggaagaaccagcactttggaatcagattacctgaatgtgaatcacagcccagttccttgtgagctgcatgaccctggtgaagttactactcatttctaagcttcgattttcttatccataaaatgaggataatactaataccaatgacattagtttgttgtaagaataaaatgagacatgtatagaaagagcatgtaaaaagagctcagttaaaatgagctcatatcttgggttattcctgtacaaaagcctttgtgccctgaatggagaatcgtgtcactcaggattcactcagcaaaacacaaaccactctaattgtttaaaaaaccagtaacttaatacccaaaaatggcgatcctgatgatggaggagctgagaagggctacattccctgtgaagcaaatcagagatcagtgaaatggaagcagctaccatccccaggctggagggactaaggagggaggagggaggtggtgttctcatagtctgagggcaggggacaccagccgatgctggagccatggcagccctgtcaacagagcccgagtggtggaggggaagcagctgctgcctggcacagaagagaagtagataggctcttgcttccccttgcctgcaggggtagccccacaatactgagcagagcagcggacttgatctgaaaacacataggccaaggattcttgcaggctaaagtctcagacttctattgcctggttgtggatatgtaactactgtgataactaacacagaaagtttggaagagtcttacttccccctgttgctagacctctgaacaatagcagagattcacaggttgctgtgccccagaaggtagaatttggaaaaagcagtggaaaaccctcgaaagctgtaagaggcctgtctctggcctttttctcacattactttctagcaagtatctgagcagccagtgccttcagtatctggggatttgtggtctgatgagacattcccaccctgccgtttacctggctaacttctgcagaattgagtatagactgaacttccttgggcccctataggtgggttagctgcctttgtggcccctcctgtgatacactgatttccctgcactgaaatactccatttaggcttccatctccttcccaccagactgtgagcagggacttgtcttcttcatccttgcatccccaagcatttgtactcttacttcctgtattgagctagctactgtggtaggtcctgggctatgcatgtaagtaagagtgccagctactagcaacttttattatagaagggaggcagatgggatatatgatgttttaaaattacccatgtcttttgtgctagggaagtccattgcatgagactatttaacagggagaatcgtctgtcctagagggtcagggaagccctataattaggagtcggcctgacagcgaggttgggggaatggcattccaggcagagggaagagcaaatgtgaaggtcttgaggtgggaaacagcattaaggattagagattgagagcaaacgtggcattgcctgggagctgatgaggtcagcaggacctgttctctcctgtgtccaagtctctgcgtcctgcctgagcactttccacccccagctttgtgttgtagtcctgcaagtctgcgtgtttgtggcttccacatcacacctagtatatatcgttttgtgcatagaaggggcttattggatatttgaacaaatgaatacaattccaggccctaaagagtctttctagctttcttgtcatatttataactttagttgccctgcaagtatcaaggaatacgagctctatggggaagaagcctgaatttataccatttatgggaaaccctctgctatttggcattctgttactaggaactcgctctcagtcattctctccttcacaattggagttctgcgataagtagtagtaagaatggtgacctagggatgccagaaagattcagtcatcagaccatcctttgcttttgcttctttgggactgagatgtgatgtgttaaaccagattccatttggctccgctccttcttagcagtgaccttgggcaagtcagttaacctctgcagaccttagtttctcctctgatgtctaacattaataatatctatgatagtgttaaaatgagaccatgtatgcaaatatgtagcatagtgcctggtatttagtgagcagaaaataactgatagctgctgcttttattatgacaatcacaattactgccattattataacgttgggtgccatacattgaccagaacaaagcaaaatctgagcaggcttccgaggtttcctatgcaggcaagtatgccctttgggtttctccttgagactgccctacacacaggacccttcctccatgttgtttgactattaaaaagaagatttgttaatgcttgtttttagctttctctccctctttttttatgtgttaaagaggatttgtttttgttttcctttctcacaggagtgattggggcagatgtgagagggcacggcctcatctgtgaggggcagccagtgacgtcacggctggctgtcatctgtggaacgtcttcttgtcacatgggggtgagtccactgagcacaaaggcaaggccaccacacagcaggaggtagcctggaaggagaccctgagtgctggcttcttcaccctttcacttctttcctcttttccctgcctgccccttgtgctttgtctagccagaagcccagctccccactctacctcccttgcttaacatttgctggatctttttccaggggccaaattcttagtaagcatgaaaaggattgagtgctccctttgacgtcaccctggccagagagcccaggcatgaatggtgacatctgatcctaaggtgacaaagtctagctcccccagactgatctgtccctaatgggtagcggggtcttctcggcaaagagtgtctgttttccttggccagggaactctctctcaatcaatataaatccatctccctgggagcgtcctgatgatctatagaattagcctgcgtatcatgacttcaaaagaacactgataagcaattttcactttgttaatttttctccatgaattagtgaaaaggctttctccaagattgcagttaaaatttagtgcctgccctaaaatttatatcttctttaaatgcatgagtctgaaagcattccattccgataagtacccatttctaccatatttttatttaaaagtcattactctgttaaacttaaatcgacgactctttggaattttcccagataagtataatagagggcagagtgggggaggagcagggagatgagcagagattagagcgggacacagcccagggcagaaccaaagcagctatggaggaaattaagtgggatgtgagactgttttgcaactgtagggacccctgagcctttttaccatcagatattctagttcagttgatataaatacatgtacttacttatcaatccctgctcttgtgctaaactgtggatataagaatgacatcggctcagtgggatgagatgaagttataacaggtattagaatataatgtgaggccccccaatgtagatacaaattgaactcatgatactaagcatctgttatgtgccaagcaatatgcgaggtattcttgcacatggcatcccattttctatggctgagggagccagcccgagtggtttccagtcccacttcctcagtttactaagtgtgggcctttgggcaaggtacttaaactctctgggtcccagattcctcatctacaatatgtagagagtgacagcacctgtcagagtgctgcaagaattaaatgaggtgatactaagtgctccacatgcagtaagcacatcacaagggctcactcttaatcactaggactgttgttgttactgagcagaaagcaaacagtggctgactctgcctgggagggtgcagggtgatagaatcttcttgaggtgacatttgtgctggactttaaggaaatagatttccttctgtttgggctctgggcagtcttgaatggaatttttctaagtttaaaaattgcagcatatttggccagacacagtggctcacgcctgtaatcccagcactttgggaggccgaggtgggtggatcacctgaggtcaagagttcaagaccagcctggccaacatggtgaaaccccgtctctactacaaatacaaaaaattagccgggcgtggtggcaggcacctgtaattccagctgcttgggaggctgaggcaggagaattgcttgaacccagaaggcagaggttgcagcaagccgagatagtgccattgcactccagcctgggcaacaagagcgacactccatctcaaaaataataataataatttcagcatatttcttctgctcagcagcccttttgtaaggctcagctgtccctgaagggagagatctgcagaggcctgaggcctctttaagccagaaggcaccagcccaggagccagcccttctttcccttgatatgagtctacacttgttagattgtcttcactgaatactgatttaatcctgtttaaattatctcttattttcacagggatacatctaatcaggcttctcctgggagatctgaatctcaggcatttttaccccactcaattcagatttctgaacagaagcaaatctaaatggatgcaagtgtctctgtgatggcctgcttcttagtcttactgtctcttaatggagatgaggctggctttccctacccatttaatgtacacatttgggacctaaagcgtagaaaagtccagtaattttcccaaagtcacaaagctttgaagttcttgagctaagaactgaaatctaactctgattccaaagctcatactcctccttgcctccctgaattgtgcatgaagatgatgtacccatagaggaatggtgagaacatgggcttttacattgtccagaggcaagcttgaacatctgctcatgcatgttttggccctctgacctgagtgagctacttaacttctctaagcttcagattcttcatccatcaaattggggataatgatgccagtctcacagggttgttgagtaacatgcattatgtaggtttgtacctagcacacagcagacactcaaaaatggtggagattgttattaaactttcctagtgatgtaaacggctcacatgaagcaactgtttgggctttaacgagtttgatgggcagctgcagttggttgcgatgaatgagggccataaaaggccagtttatgatggctgtgttgtgctggaaataaagtccccacccccatcctgctttgtacttgggagtgggaagggaccctctgggccaaggggattaatcatcagctttaatgttatgtcatgagggtgagactgtggtcatgctggcatgggaaagtgcctttgatctcctcaggtgctgggaacccagcaacaataacacctttgtgaggtctaggagaggtgcaggtctgaggaaacactcccagggagactcaaggaccccctttgttgtggttctggcaaataaaaccgccactgtgaggaaaaattaaccaaacagaacacagggaccaaagggtgatgcgggcttttcaaaaagtggttttcagcatgatctgaaggatcctctttcttcctgtctgcttacttctgatgtttccaatttagtagattgagacaaaattcccaggaacgttttgtgcttgatccaggttgcctctttctagatcacccaaaaagaataaatgaatgaacgaatgaccacataagtgagtattggtaaatacttagaagcttcgtacctccaggttcctgttgcttccaggaatctggagaaaaagcctgaggttgaacataagacatgttaataaggcctttgatattttagaagatacaagcatgggctgcacatttatcttccttgtgggtgatttaattaacaggggaaaaatgccattctttttttaactccatgaaagcagagctgcttgttcagagttaattactaccaagtcaccaaaaccccagataatacacagcaggggttagccagaggttgaaaagtcatggggtaagatggagctgatccttgccattgtactgacatccttttcttgagctgtcaggttgggttgtaacttggcaacttgtcttccagttagcatgtcagatggggacaggaccctgggggggtcggggtagggagaaacactgaggaggtaagatttgagcagaacaatacctgaagagagctgggaactacatctgcatcttaaatcgctcagaactgaagttttttcagtcttaatattgagatagtggttctctatcattgaagggatgtggagactcaaagacataggctcatacgctgcccccaccacttactgtgtgaatttaggcaggatgcttcatctttcagtgcctcagtttctgcatctgttaaatgtgagtgatagtatttacccataaagttttgttcaggttcaaattaggccatctttgtaaatgacttggcactgtacctggcacaaaataccaaatatgatattgttattaaaaatgagttgttaatcacatgaacaatccatgtggttatggactagaattagagacatcagtatgaactcatattgggggaacccacccccaatatttcaacgtaggttctttctattttccgtaagtgtcagccggctgagaaataaagagaaagagtacaacgagaggaattttacagctgggctgctgggggtgacatcacatatcagtaggaccatgatgcccacctgagccttaaatccagcaagttttattaaggatttcaaaaggggagggggtgcaagaacagggagtaggtcacaagatcacatgcttcaaaggcaaaaaggagaacagagatcacatacttctgaggaaacagtacaagggcaaattcagaactactgataagtgtctatgttcagctgtgcatgtattgtcttgataaacatcttaaacaacagaaaacagggttcaagagcagagaaccgatctgacctcaaatttaccagggtgggttttttccccaccctaataagcctagggtactgcaggagaccagggcatatttcagtccttatctcaacctcataagacagacactcccagagtggcttttatagacctccccccaggaatgcattccttccccagggtattaattattaatattctttgctgggaaaataatttagcgatatcttccctacctgcacatctgttttaggctgtctgcaagaagaaaaatatggctctttttgcccgaccccacaggcagtcagaccttatggttgtcttcctatgttccctaaaatcactgttattctgttctttttccaggtgcactgatttcatattgttcaaacacacatcttttacaatcaatttgtacagttaacacaatagtggtcctgaggtgaagtacattctcagcttatgaagataacagggttaagagattaaagtaaagacaggcataagaaattattaaagtattaattttgggaactgataaatgtccatattaaaatgaaatcttcacaatttatgttcagagattgaagtaaagattggcgtaagaaattataaaagtattatttgggaactgatatatgtccatattaaaatgaaatcttcacaatttatgttcctctgctgcagctccagccagtcccactgtttgaggtccctgacttcctgaaacaaactcatatttagtttaacatagatgcagatggatgcatatagaaatagttatggatatatatacatatacaggttagtaaacacatatttatttcctggctctgttagctgagatggtctagaaataaggatacctcaagagctagtttttacaagcacatagtgtccagatcatggtatctaataccattatccaatacaaagaaccaggactccttggagaaatagttgattttaggattggaataggaaatatacaagatgagcttggagcatttgcagtgccagaaagttaggaagttctcaacaaaaaagatgagaatatgtcacagggagccaactgtgggagctcccactagccaaaactggaacaatttaagcagtaaaatgaagtattatgaattataactcaaagtataacataaatatccataagaccatactgacataaattattttgaataaataaatcaatgaaaagaagagagacatctcccatgcagaaagattccaaataatttatataaatgttccaccatcaaggaggtggagcataactttccactccttaagtgtgggctgcacatagcgatttccttccacaaaatatggtatggaaaacgggggaagagtaattttacattggagaaatatgagaaacagcatccacgtgacaaggtcaacatcaacaatgataagtcatgttgatagtacgtacccttgatatgatgtaatgaaaatgacactttgtctctgttgtgttcatcccccaatcctataagcccagtctaattaccaggaaaacaccaaacagatcttagttaagggacatcctataaaatacttgaccagtatttctcaaagctgtcatccaggtcatcaaaaaacagggaaagtcagagaaactatcacagccaagaggaacctaaagagccatgataactaaatgtaatatggtatcctggatgggatcctggagcagagaaagaacattaggtaaaatctaaggaaatctgaataaagtatggtcttcagttcatgataatatatcagtgtcattcactgtgacatatatacttgacaagatagtaatgataggggaaatgtaactggatgtgaggtatatatgatctttacaaccatcttatattgtaaaactattctaaaatttaaaatttatttttaaaatattcattaactattcactcataaagaaaacttttttttttaatttacctggctaagtgctaaaagtcttcataagataaaatgtcatgcctgccttcaaagagctcaggcacattgagaaagacagacagaaaaaggagatactacaatacaaaatggtaactactatagttaatgcatggctggagtgtggtggaagtaggaagaaggggctgtcccaagtcttgggtagatgaggaggttttcctataggaagagatatttgcaggatcatggcttccccgcccccactgagacactgttcctgccagcccaatttctgtagtaggccctttcctcagtcttctccactttgtttttctttgctgtgtccacaaagcctcacagctgacttcccctgaggcctgagcaggatgtgggtgtgtatgagccctttgggagggcaccacagggagacagcacagtcatgtattatgaactgatggtcttctgttactagctgagaagagtgggcaagtgggaccagtttctctgtcatggtctctttaacaagtgacattggcagaagttaccagaggggtggagtgggatgggattccacacggtacagtagaccactgttacacctaacaatgaaagtgctgaggtgctgctcagaaggtgcctcgcttcctctttgtttaccaggacctgttgtcgtcagccctctaggaaccagcattctcaggacactctctgtgtcaagactagctctcagactgcatgttttgaaaacaaagtatatgctaggcattgattcggcgaggagagggttgatgtggttcagtggacaatgagagacagactgtgcactcaagaagctcaaggtagcttgtttttcaagacatttgagaaacatagaaacattatgctggactgagtatgtttaatatctctgaacccaggcagtagcaccctttcctcaatcctcatgaggagataagcagtaatactacttgctaccatctgttgaccacggaccatgtactaagcaccttactaaaactttgtatcatgtaaatagctcaacaatcctaccaagtaggcaccatactgtccctcattttacaagttaggagactgaggcaaagagtggttaagtgggtcacacaatgtgtaggaatgcaacactttgagccctctggaagactgaccagagagtccttcctcctccctttcagctgtatagcttccctcaaaggcctagaggaaagggagaacagactcaattaaaagggccaaacatgagcaaatgtttgaacagacatttcaccaaaggagaaatttgaatgaaaagcactggtcattagggaaatgcaaattaaaaccacagtaagattctctactactcctactcatcttagaatggctgaagatgtgaggaactgtagctctcacacaccactggtgggaatgtaaaatgatgcaaccattttggaaaatggtttagcagttacaaagttaacatattcctactacgtgatctagccattccactcttacaaaagcatgtattcatacaaaaatttgtacagtaatgttcataccaacaaataaagctttgtaatagtccagcactggaaacaaccgagatatctttcaagagtgaatagatcaactcttggtgtatcaagagaacaaaatactactaagcagtaaaagggaatgaaccataatataaggtacaacatggattaatcacacaaaataattatgctgagtgacagaagccattaattcttccaggcaacttgcagtcttttgtggaaaagtgggctcaggccagctgataggtagattccccctaaaggcttttgttcctggccttctgagatgctttgtttcacctgactttgccatgttcctggtggactttcagaaacatgaggccagatatccctgcccagcttttatagaaatggaatgtctggatcacagggtagatgtaagttttaagaaactgccaaactgttttccaaagtcactgtaccagaaacgaatgcaaactttcttgaataaaaaatagttccattatttaaattcttgcaaaagcaaactaatatatagtgacaaaaagcagatcagtagttgcctggaatcatgaaatgggcacaacaagggccaggaaagtaggatcaaaaaggggcacaaggaaagatttgggtatgtttatcttgattgtggtaataacttcactgatctatgctatgtcaaaactttccaaatcagacatcttaaatatgtacagtttattgaaagctattagctcaataatgctttttaaaaacagaaaaaagatcgattttgtatctggagactttactgaagttgcttatacacctaaggaattttaaggctgagatgatggggttttctaaatatacaattatgtcatctgcaaaccgagataatttgacttcctctcttcttatttgaataccctttatttctttctcttgcctgattgccctggccagaacttccaatagtatgttgaataggagtggtgagagagggcatccttgtcttgtgccggttttcaaagggaatgcttccagcttttgcccactcactatgatattggctgcgggtttgtcataaatagctcttcttgttttgagatatgttcattcaatacctagtttatggattgtttttagcatgaaggggtgttgaattttattggaggccttttctgcatctattgagataatcatgtggtttttgtcattggttctgtttatgtgacgggttacaccaataatagagagtcaaatcatgagtgaactcccattcacaattgctacaaagagaataaaatacctaggtatacaacttacaggggatatgaaggacctcttcaaggagaactacaaaccactgctcaaggaaataagagaggacacaaacaaatggaaaaacattccatgctcatggataggaagaatcaatatcgtgaaaatggccatactgctcaaaataatttatagattcaatgctattcccatcaaactaccattgactttcttcacacaattagaaaaaactactttaaatttcatatggaaccaaaaaagagcctgtatagccaagacaatcctaagccaaaagaacaaagctagaggcatcatgctccctgacttcaaactctactacaaggctacagtaaccaaaacagtatggtactggtaccaaaacagatatgtagacccatggaacagaagagaggcctcagaaataacaccacacatctacaaccatctgatcattgacaaacctgacaaaaacaaggaatggggaaagattccctatttaataaatggtgttgggaaaactggctagccatatgcagaaaactgaaactggaccccttccttacaccttatacaaaaattaactcaagatggattaaagatttaaacataagacctgaaaccgtaaaaaacctagaagaaaacctaggcagtaccattcaggatgtaggcatggacaaagacttcatgactaaaacaccaaaagcaatggcaacaaaagccaaaatagacaaatgggatctaattaaactaaagagcatctgcacagtcaaaaaagctgtcatcagagtgaacgggcaacctacaaattgggagaaaaattttgcagtatctccatctaacaactgttcagaaatcagttagagagcctctggccttagtgtctttgggctctaaccacagaaaagccacccttcagaccatgctacgtttttagagctgtgttctctgggtgatgtctataacagcactttacagcttcctcagaacaccaaagaaaacgttccccagaggcaaagggtgtggcctgggcctggggggcccatgtttcatccaggaccatgaggcactgcacagtgtttgtttgttagaggagcagaggatgctcaaaatcattagtcgttagggaaatgcaagtgaaagacacagtgagatccactccacacttactagaatggctgaagttgtggtgataatgtggggaactggaactcacatgccactggcaggaatgtcaaatgatgcaacgactttggaaaacattttagcagtttcataaaacctactctaccctgtgatccagacattccatttctataaaagccaggcagggatatctggccccatgtttctggaaacccactaggaacacggcaaagtcaggtgaaacaaggcatctcagaaggtcaggaacaaaagcctttagggggaatctatctatcagatggcctgagcccagttttccacaaaagactgcaagttgcctggaagaatggtgtaagttcttcctctagaagtagaggacgaaaatggtgcagctgtgttttagctccctcctgattggcagcatgggttcttctcccaagggtacaagggaatggggtgggatgggggtggtatatgggagtggaaagttctggaggactgccttgattagcagcaatgacaataacagctaatatttattatatgtttatcatggtctatttggatttttttaaccctcataataaccttatacagttgtcagaattatcttaccaatttatggggactgaaactgaggctcagagagacaagtgacttatccaaggctgtctagctagtaagtcctttctttttttttaagacagagtcttgtcgcactcttgctcaggctggggtgcaggtgcgccatctcggctcactgcaagctctgcctcccgggttcacgccagtctcctgcctcagcctcctgagtagctgggactataggcacccgccaccatgcccggctaattttttgtatttttagtagagacggggtttcaccgcgttagccaggatggtctcgatctcctgacattgtgatccacccgcctaagcctcccaaagtgctgggattacaggcgtgagccaccgcgcctggccgtaagtcttacagataggtttgccactcaggcagttggattccagagctcagactctcaacaataagcagaatgatgagacacaggctgtgggatgggttgaccataaacacacgtgttttgtgggaatgaggtagagtgattacacagcagatctttcccagagcctgatgagaactgcacagttaaggctggatcacagctagaccgcagtgctttcattttccctttttcccagtcttccaaatcacttcctttcaagaagccaccagcctaatgataacaataaaaataaacaacatcacttgtcaccatcatcccctgggaagagagtatttatgagactccctatttaatcttcccctgttccctgctgcgctgtggtcaagtaccaaatttggcaatgtgaagacatgcggctgacttcccaactcatgaagatgtttttctatttgtttggagagcatgatgaaaaccacattgattttttttttccttttcctatttaccacacatctgttgtgtgggtgattctgatattgtggctgctgagggttacctggcagtaaccctcagtaagaggagagggtttgtccttttccagaagtttggtgtggatgaaatagatgatgaggcagtcatggtggagccctaaccaagcattgggtcccgtgccaagtgcctgcatgcatgagctcatttagttctacatacatttagttcagaggctttagtatttatgccttgtttttctcttagtttttcatcctcttctcctattctgtttgtgtgttccaaatgtctgttttttcatacattacatttttatatcttttgaaagtactcttaagagctgtcagaagtttgaggtagtttctactctttcacttaaccaatggttagagccccaggagaaataacagtgagatcaaagaactcagaagaaccaatgggaagctttttgagcaatcagcactgaaggaatgaaattgaaagtccctacgtaattaaccatcagtggctccctactgccaatagaaaaaaaaaagttcagatgagacaatgagtggaccttctggctgtgttcttatgggtttgggatatattgcattagaataaaaccgaagtcttaaatcctaaatgaaagttactgtcagttatactgacagtgatactgtcatgtatgttgtaaatctttttgttgaaagataatttacataccatgaaatttatccccttgtatttttaaaacatctagagaactgagtatagtgatgtttgagaaagaggagacttactgcccattttttaggttacattatgggatgatactagtgtgtggtctttattacttagggagataacagaaggatatcatacaatagtacattgccatttacttgtatgtacctgacacataataggtgtccgttaaataatagatatatacatgagcataaggacagacagaaaaataccagttagcaactgtaaaggtttgttggagaagaaatcgtgccatacctatttgatttctgttctctgatggagtgaaaggctgggcagagaaagggagatacagcatataaaccaccaagttattggtcaggccttaggttctttccttgattaactgacccttcccacatgccacagcagcattggttaagtcagtcacacaattttatctgtgcacaaccgagttgtccactgaattatacctcaaagcaggccaaaaatatatatatatatgtaaaactgattgaaaagcattaagaacaactaattgccaatttgtatttgggctgtttagttgatcgttgtagccttgtgtggcaccaggcaaagactaagccacaattctgttggttgaggaaatatttaactggaagatgcttttgaatgaatgatcagctacccaggtactatttgacatacagcagtcttggggcttccatgacttattctcctatcatctgtttgcatgataaaattacaggtttccatgtaatctttagcagatgtatttgctatgatcttggaagacagggcatagcttctctggaattaagggaatggcccaggaaaaagaagaggtgcccacagataaaatggtcagttatttttatatatgtgtgcattcttctgtggtgtgcagaacaccaaattgcttggacctgtttattcccacagactcacagtcaaactggtcctgaatattaaatctgatggtttcattctcctgataaaaatcctttgtcgataaaaaatcctttgtcaagtctcctgaatgctagctaggcatacgagatccagcattattgcccctgtctacctctgataccattccgtgctatccctcaccattcatcctgtgttctagcaggtgcatctgcacacgcttgtttgaattctatggaaccagagatgtttgagcatagagaatgaccagattttaggcagttaatactgtatatatacaatataatgcataacactgccagtgaagtttggagcagcacctgtaatcgtgcatactaatatctctacagtaaaacatatgaatattcacaccaaacaggttaagtcagctttaaatggcttgatccattcagatcagattttaccatcaaatgaattgtgaaaagacttttggtatttgaaatgctttgggttgaagaagtgtggtagacctgtacttgcttttcttgaaaagagcctgtgctctcttattcatctggcctttgggcatgttgttttccctgcctggaatggccacatctccctctgcctgttgagtagcatcattactagaatcatcattgcatatactgaggatttactatgttgttactcccagcaaattctatggtcgggggggcgggggggggtgttcttattgtattacatccccccagtgtttagatgaggaaactgaagcttggagaggtcacagagctaggaagaggtagagctgaggttgaaccaaaaagtatggagacaacaaaccttgggttcttagttactacactgtccgtgtgtgcgtcttccccaaaggtccagttcaggtgtcaccttcctaaggccctcttcccttcctccaccacgtttaatagattatgactcctctgggccttcacagctgtttatgcatagctgtggtgcactgcttctcattctctgtctttcccatgagcctaaactccttgagtagttggggaaaaatgtctacttcagtgttctatctctagggcatacagtaggtagtcaacacatagtttataattaagttagtttaaagtgatacggtaacagataacaatttgtatcatcattaaaataaatagtaaacaccaaatcacaagttcaaggatataaaatttggatttacaaaagaaaaaaatactcagaaaaaaaaaggctgctcatttttatgcatggtatgtaaagaagaggaatttggggacaacagttcaagaatgggcaaggaacacatttatacttaaaaattatgacagctaggatttattaaatacttcacatgtgacagtttctctgctaggcattctgtgtataaactttctaatcctcacaacaaatatgtaaggctaattgtcgaatccctgaatggacaaaaattatagctatataagaaagagaaagatatggtaaccatgtcttagatcagaataaaaagaacaaaaggtaatgatcctaatatattcagatttaacataaattaagcatcattagaggacagtcacataaaattgcacaatagaatatatttccacatctgagagatgatggaattgaggtcaaagagattacaggctagtatgtggtattttatacccattccttgaattatgttaacatggtaccagaagtatatcttgctgtcctcctcagaactgggtgcagttttgagctctgcttttgtaaaaagctgttagaacctgaaagaaccacataacacagctgtaatattcaagagaaagtgggtcccacgaacaaagattgagattgttcagagaaatggggtggttctgattgcttaatagaaacctcacaggttggctctattattttcttgtttatggaagtttttgtgaccgtaagagctaacttttccttggtgctttagagtttattaaacgtcttatggaatttgatgctcagaataactaagtgaatcagtcagagcagatgttttctttttttcaaatgagactcaaagaaattaagtgatttgttcagtgtcccacagctaataaatgatagggccaagactcagatatgtatctgagcagacccctgagccatgtccactgcaatcttgcaatccttggttcatcttcatttactcaaattgaaggatcctgcggctggtgaatgtctggttcattgcagaagagttcctggttccttgtctctaatttccattgtgactgtgaattctccattgagctgcaagccagtgactgtcaattaatgtgcacaaaatatacctgggtaactgttttaaaaatgcaattcctcaggcccctctcccacagggtctgattctctaagtcttgctggaagggatatatgagaatctgtaattttaacatgtgcccaggtgattctaatggaaaactttcaaaaaaactgctttaagctctttcagagtagcaattatatctttacttcattgtttccgtagtgcctagcagagcaccttgtacatagacagtactctaaatttacacttgatgaatataagagtgaagtaaataaatgtaaaattaatgtaaaatgaaggaaaacaagtttgagaatcagtcagttcctgccagatttggagcacactgaggaatccctttatctccatcctttcaaataaaatatctcttggtaggtctgggtaagacatactgagaagtcatgacttggacaaagtacctggtagaatctgccaacaattagagattgtggaattcttattttctcatggaaagcaggatggagtgaaacagtgagagatcctgtttgtagttctgtgcagacaaacccagaaaccagaacgcagacacaccaggacgcaacaggaaaccacaaaggcctgagatctttcaatgtaaataggaagtcagagtttacttccgaacccacagtgccaagctgaagtgcagtgtttaatccagctctctacccagcccttccttgagcctgggcacagatgaaagatgatgatgccacctgggtaaaagcattcaaaaatgtttgttctgatcaggtcttggagtgagcttcttttgtttgtgctagtgaataatttgggacacaggtgcactttgcatttgaaagcgttaattggtctccttggttttccctgccatgatatttgaagccacatcttcctccacaaagtaattttaatccatatacattcaaaaagcacttgtcatggacagccgtctttcatataccccatctgtggacccctgggtccaggtgcagagtagtggaacattggtgatgcttaatatgtactctgtgttcattgcattgacatctgtaatctcatttgattactactattacactgggaaataattaataggatacgatcatcaccattttgaaataaggaaaatgtagtctggtagaaaacacatggatgttaaagttaggcagatctgtgttcatgtccaaaagacttaagctttcttaccagactgctttattttatgtagccagttgtttagagcattcactctgtgccaggtactggagagaaaatggtgagcagtagacctagactgtacagtgtagtggaggagatgaatactcagcaaacaattacaaaaatgtataattacagaccttgataagtgctttgctttcataccctgctgggggaagtataaattgggcagtcactttggaaaacagtgaggcattgtctgatcaatttgactgtgcacatgccctgtactctaccaattccattcctaggtaggaagctggagaaacaattgtacttgtgtaccagtaagtgcccagagacaagtaagtacaagagtattcatagcattattttttataatagctacaaatttgaatcaactcaaatttcatcaataatagcatgaataactaagttgtattatattcatacagtggtagacatacttaaaatgtaggaactacagctacatatgacaacatagatggatcaaacaattttaagtggaagaaacaagacatgaaagagatacatacagaattatttcattcatagaaaattcaaaaagaagcaaaaaagacaatgtcttttaaaaaatgcctacaaaagcactaagcttagaaaagacaagcaagggaataattaccacaaatatcaggacactggtgaattagatggcttggaattgcaggttgttgaggttaaaagatgctttcaggaagagcttgagggaactagcatttgcttctgaaggatacatgagtacttaacagtttttttaatgttcacataagttttatacactcctctgtatgtatgatatgtaagtgctagaaagcagagaagctatcagaacatagagccaagtgccatataatttgggtggtctagaaggcaaggcagtgatgtttgagctgggagattttgattaggtaactaagcagagagcctgacggggagggagtagggttgtgcatggcagtggtcaagagaaaaaatttgttcagaaagagagtacagaagaataagcagaaggaaattggcagctttggtgtggggcaagagagaagaatgctacaagtaaaggctggagaagcaaaaaggggtagcatatgctgggcttgtaagccttctgagggattttagtcttttatgtaagagaaactgaaaggttttaagcacagtggataagataattgaattacaaaggatggaaataattccagtttggagaacaaattggcaagagacctgagtggtactaggatactaggaaaccagaagaagactgggagtctgtgtgagagatgatatcatactaacttgtctcagattatggtgggggagatgagatgtcgatatattggaaagatgtttagaagataaaatcagcagcacttccttggtgtgaaaactgttgaggctgcagggcaaacacaatagaggcttattaggtatctcacccaaactcctaagatgagctgctccccagtgagtagagatatctggagagagagcagtagtcgttcaggcattccttggacagactggattcactagagagaaacatttttggtttgcactgtcagctttgtttttaggttgttttaaatattttacccttgtctcttatgaaaggtcttctcaagaagtagccatgtggacacgatattgctttggtagtaattctgccaaaaatgcctgacttgaatctgatcatgaggaaatatcagaaacccaaattgagggagattctataaaataacttgcctctagtcttcaaaaatgccaaggtcataaaagaaaaactacaggaagatcaaaggagacgaaagagacatgatatctgaaggacatgtgtgatgctgaattgaattggagaaacttttttaaaagttttattgtaaaggacatttagtggataatagatgacattctaataagatcagtagattagataatagaattgtatctatgtatacttcctgataattgtattatggatatataagagaatatccttgttattataaaatacacactgaattattgaatattttggagtaaaaggacattatgtctgccactttcaaatggttcagaaaaactacatacatatacacatatgtgtgtgtgtatatatatgttcatatatatacacacatgtatgttcatatatatatgtttatgaacaatatgtgaacaatatgtttatgtaaaacattgggaaaatctaggtgaatattatacaataattctttgttctatttttacaactatttcataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggtagataaaatatctcaaactctttgtattagtttcctatggctgctattgtagcaagttgccatacacttggtggcttaaaacaacacacatatattttcttatggttctcgagactagaagttcaaaaccagtttcactcagccaagatcaagtgtcaacagggccgtactccctctggaggttccaggggaaaacctgttccttgcttcttccagcatctggtggctgctggcattccttggcttgtggccacatcattccagccttgccttctgtggtttcattgcctcctcctcatctgtggtcacatctgcctctccctgtctcttacaagaacagttatgattgcatttaggccaactcaaataatccaagattgtctcctcatgtcaggatccttaatcacatttgtgggtcctttttttttctttcttttttatttttttgccatatgagtaacattcataggttccagggatttgaacatggtgatcttttcaggagccattattcagcctaccataccctttatggaaagaagtgacatttaaatgtgttttttaaggtacataaaaataaagtattaatttatttggaaaatataaagtacttctgcactctgtgtatagtgaaggaacaaagataaaagaaatcaaatttctgtttagtgatttttcattgcttttatgaattacattgaattttctattatatttcctatttggttatttctggaatagagaaatatatttgactttttttagaaagtaaattatttgttaatatgaatgaataatacctgtgagatttccaatgaaaagaagcaaagttttatacatcaaatttgcttccaaatgctaatatactaaaatcagtgctagttatgtttaatataggttgctgagaaaaatagttatcttttatggtttttaaaaagtgtatgttaatttatttttatcgtttatttcttactgacaaatgcaaattgtatatatttatggggttcaatgtgaattttgatatactatatattgtaaaatgattaaatcaagcttattgacatattcattacctcacatacttttttgtggtgagaacatttaaaatctactctcttagtaattttcaaatatacaatacatttttattaactatagtcaccatgctgtgcaacagatcttcaaaacttattcctcctgtctaacccaagcttagtacaatttggccaacatctctgctttaccccttggcaaccccaccctaataaccaacattctactctctacttctatgagttcaactttattaagctttacatataagtgaaatcgtgcagtatttatccctctgtgtgtggtttattttacttagcataatgttctccaggatcgtctgtgtcactgcaaatgacagaatttccttcttttttaagactgaatagtattttgttttgaatctatggcacattttcttgatctgttgatggacatttaggttgatttcatatcttggcaattgtgaataatggtgcagtgaacatgagagtgcagacatctcttcaacatattgtttgcatttcgtttagatacacccagaagtagaattgcctgatcacatggtaatttgtcatttttttgaggaaactccatactgttttacaaaatgcctgtactagtttacattcccacagatttttaaaaagttaatcttctacccactaaccttgctaaactttcttatttttttaaaatgtgcatgtattatatatgctctgcatgcattataaatgttacagtaatttttaggtacaacactaaatattctcatatggtttggatggtcagtgaaggcttctgtaaggaagtgatatctgtgatattttggttaggaaaaaagtggtccaaacatagaggacagtatgagctatatatacaagatcatatcatctgcaaattttgcttctctcttcccttctttatatcttcttttgctgttaatttttgtctaattgtgtttgctagggcctctggtattatgctgaacagttgtggtgataaaaagcattctcacatgcacacatatgtttattgcagcactgtttacaatagcaaagatttggaaccaacccaaatgcccctcaatgatagactggataaggaaaatgtggcacatatttaccatggaatactatgcagccataaaaaagaatgagttcatgtcctttgcagggacatggatgaatctgggagccatcattctcagcaaactaacacaggaacagaaaaacaaacactgcatgttctcactcataagcaggagttgaacagtgagaacacatggacacagggaggggaacatcacacactgaggccagtcggggggtagggggaaaggggaagggagagcattaggacaaatgcctaatgcatgcagggcttaaagcctagatgacgggttgataggtgcagcaaaccaccatggcacatgtatacttatgtaacaaacctgcacgttctgcacacgtatcccagaacttaaagtaaaataataaataagcattctcatcttatttctaatcttagagggaatgtatataaaatttttccagtgagagtgatatttgctagagattacagacagacagacagacagacagacacacacacacacacacacacacacacacacacacatttccttatgaaattgagtaaatgatcttccaaagcattcagggcaaatagcagcccatgttttaataaccctaagaattattttatatgatagtcccattccatggccatggagctctgtcactatactgtgaacttctctatggcaggaactattcattcaccattgtatccttactctgaacttctctagggcaggaaactgttcacttgccattggatactcagtatctagcacaatgcctgtaagttaggcattcactatccattcaatgaatgaatggatggatgaacgatagttaatatctgtttcattctcaaagctagcaaattctttttaagcatgagccaaaaatatcactactttccattttctttattcaatgagttgagctcattttgccgccatccttacctcctcccagcacctggtacagtcagtagtcatttgacatatgaaggaataaatgaatgagtcaatcacagagcattctgctgccagttgatagactttgcccctaaagattctgaactttatttgaactgaagccaggtggttaaagatgatttaatcaggacaaaaataaaattctactctctttaatggaataattgcttattgcattttcttcttaaagttggccattcatctccttaaagttggccactgtctttcaatttatatatgttgtccatgaattattgaaagtgattattctgaattaagccaaaattattcacaaagaattgtcttggtgtgtgactagagggttcagaattccagtattacttggagagaggggttgggtatagtggtaaacttaaagtttacctgcaaaaaaacagtgttgaatgcctgagtatggcaaatccaaaaagtaagtatttggatttattggtgaataagggagagaggttggttatcaaaaaaagagcagttaagtaggaatatgttagtagttttaaatactttatgatggctctaatcatatatgtacttcctatttcaaaaggtatttcatttcataagttagagtaacacccaatattagaatttcagtgtccagaaattgattaccttctcctgacttggaactctctgctcaaaagcctttgatgactcttcgttgcctggagagtaaaaatttatttagccctagccagcgctgtccacctgcactcctaccatacacactctctgtttcagccacatgtaacagaatgttaccatagggctcttcctatcttggaggtttcgaacaggccccagagcccagaccacctatgcagagcttgctaaaagattgtgaaacttgtgctaaacgtcaccctgaggatataaaagaggtggaagaagtcagaggtcaagactaaggaaagaggctgaggttgatgattgtatctgagagagtagagcaaaaagtgaagacaaggaaaaggtgtgtgggtccagcacaagggagccagctggggatatcttaaaaggaatcccatccataaggttcaactagaggagcagaatgatcccagagcaggacttgatcacctgaaggccaggactgaaagggagttgtgggcagaccactggacggagagatagccagctttggacaggcaccacaccctgaggacataatgaagccagataacaacgtatatgcatcaagtgagaccttccccaggcaccttgacccctgtatggaggaaccccaaaacacccagctgtccagcaggaaaaagtagaaggaggagagagagaagccagcaagtccccttcttgaagtgtgtatacgctaagcctgaaatatactgtagctgcagaagggagaattttcaattagccaaaatgggagttttaattattataatagagtgtacatatttactgctagaagctggcctgaggacttttataattgaagagtgtaggaatacagtggatccccctgaaatttcatcccaggaatgaggaagaacagttcgtggaacaaatttaccaaggagaagagaatagagctgttttttcctgcacacccataatggtactacagatccttcaataaaccagaacacacacaaggctggggttgtcctctcgtccctctcctacatcagcaaatctgtctctacgtaatcatgtaagactacagcttgctttaatagctcccatcttaagaatgggagggggagagcgaggtagaagaaaaaccttgaccttatatttcgccctcctgttcccccatttattgtctttgccacacagcttctcaagtgctgtataatcccattcctcccctcccactctctcttgagcccaatcagacatttgtacaaacttctccatgaaaataacccttgaccatttgtttcgggctcctgtgaccagggtctgtgttcctaaatccagtagtcctcattcagatcgttctgttggcagcattgggcacagctgcgccctcccttctcaaaacccctcacttgcatgtagttgactctttggtcccattgtctaattgctctccatcaccagtttctaaattttggaaggcgttaagcctctgcccaagacctcttccctgcccatttccccttgcttcttcagtgacctcattaagactcaaagctttaagacaccatctgtagagtatgacctccaaacatatatctccagcctgaccctgatatcctaatatatttaatcacctactcagcatttcttcttggctttctaatagatacctaaaatttagcatgtcaaaagcctaattcctctcagcccccaggaaatctcctctcactgtctttcctagaacatgaaagaacaattctattcatacacttgcctatgtcaaaacaccttgaaaacatccttcatccctctctttttctcatattgtgctccagtaaatgctgtcagttctactgatggaatccaccaatgtggaccacctagttcaagcagttgtgctccctctcttggtttattgacacagtctcctgactgtctccctgtttttaccactgggccctggattctgttctcacagcagccagggtggcctcttgaaaacttgcctcagattatgtcattcctctgctcaaaacctttcaataattttgcatttcactgagaattaaagccaatgtccttaaaaataaaagatctgttcctcttacttttcagctctcatcttctgtcccctttctcactgttcacaccactgcagctgccctgattctttgctgttcatgtaagatagcaagcacacctctgccacagggcctttgtacttgctcttatctctccacctgcatcactcttaactgcatgcttcactcactcactcccttccagtctctgctgtaatgtaacctcatcattaaggtctatccagaccaccctatattaaaataacaacacttgccttcactcactgcttaacctctctatccttctttatttttctacacacagttatcgtcctacgctccactggactgtaagttccatgaagacagaactttgttttttcaccactgaatccccagccccttcaaagtgccttgcatgtaatagactctcacaaatagttctcaaatggagggtgcttcctaacttgctttagcctttccacatgctgttctttctggcaagagttgcttccctttaccccccgccttgttacaccccagccccaagtgagcctgttagaatcctgtgcatcctctcagactccagtttcatacaacctcctctgtgacaccgcgtgagtcagatttaattcctctttccccagaactcaaagttttcagttttattttgctttaatcaagtttgtacccttaaccactacattgtgtgtctttcagactcttgttctttcttgattttaaggctttagagatgacaaattcagcaaccgcaggtccttctcatgttgtagaattgtaaagtagctgttttttaactgcatgcaactgtatgaatcctaaacctagaattttcaatccctctattctaccgcatgtattttcatttctccttctttttctactacttcctcttcatcacaaaaaaagtcccaagcacatattatatgttattcattttcttcaaacatctttcacttaatagtttagagaaaagcccatctattccattgagtgacctttcctatgactatagaaagtggtcagtttttctgtcccttggcctgtttagcagttgaaatgcacctgacagtttgtattacaaagctaaatggtggtggccagtaaggagtttgataaacttttcatgtaatttatacataggggaaatgacactggctgttgagcacatgaagtcattttctttcttccctgaaatgctttgggggagaagaccaatcagtcatcttagtgctgcacctccatagtgagatctgcattaggtttttgaccaagaagacagtaatattttatgacaaaacttggaaaagttaaaaattcacagatgaacaaatgctttttctcattatttatctttttattctttcctatttttattccctgagaccatttgcatgaggggaaatttaatcaggatccctagttgagaacatttctattggagaaaatggaacctggatatcaaattatctcacaacttcttctgagtgacatacactgaattttatcttaaatagcttgtttagaagctattggtcaccagcttaaatagcaccttttcattataacattgcttctgttgttgcattcataacattttatttgctaaaaatgtattaactgtgtctctcccatcagttcttgagctttggagggctgtggctgtggcttattcatctctccatacccaaagactagcatataatagacatacagtaaaaatggaaagactatattgagctgcagtctaccctgtccaattaaaagtcagtggacatttgttgaataactgctatgtgccaggtattttgaaatatttggtgttatttaatctttatagtgaccctaaaatgcattgttatcccttagttatagatgagagaaagtacataagtggtttacccagctagtaagtagcagacctgtctttgaatgtaacccatgtaaagcaaaattttctgtcctttctcctttattagagcttaagtgatctttcagggaccgatatgtttagctatcaactctgtaataacatgaaaaatatttatttagctgtgatcatctatttgataaattgtcagagtgataaacccaaaaggagctttaaagatcattcagcctgtaatcccaaggtggaaagatcacttgaggccaggagtttgagaccagcctgggcaacatagtgagacccttctctcttaaaaagaaaaaaaagctggatgtggtggtggtgggtacctgtagtcccagctacttgggaggctaaggcaggaggatcacttgaacccaggaatttgaggctgcagtgagccatgatcatgcccactgcattccagcctgagaacagagcaagaacttgtctcaaaaaaacccccagaaatcatccaattcagtattctaatttcagatgcaaaaattgagtcccagaagggaaaaggtcttggccattatttcttctgtcagttggaatcatgttattcttctccttttgcactgtccttacagtaattacttttaaatccttagcaagtctgattatcccctgcatggtatggcctgtgatgacctctccagcctcacgttgcactactacccctcacagtttctgtccttcatctgtggcatagaacacactctattctctgcttcctgtccctctgcctatagcacccttccctctactccttctcctaagtcctacttacccttcacatttagctcaggcatctaatatcctctcgctggaagctttcagactagattaggtggtgtatctatgtgcatccatggtacatacctgtcatggtgcgtatccttctgtgtttgttgttagttaactggcttatgtcttccttgctgtgaattccttgaggacagatattgcggagcattcatttctatatcaccacggcctcataaagctcctcacacaaagtcagctttcaggaaattttgaaagaaataatcactcacttggattcaggtctgaagtgaggcaaacattagagatgtgatggtgttgaatactcatcgtttttgatattttgaaggctctcccatgcttgaggatccaaaggagtttaccattttgtaatgccacagatgtgtactggtgtctgtaatgctcaggtcccatccttgagcttcaccaggaacatcagtaggaagatctggcacaggctatgtggagagcctcctcaccccatgctgatgatctcatagtatctggtcactgccactaaggaaaaataaatgcctgcaggtccttttataccatgatgtaactaactataggaagtgtccctatgcaacatctttcatcttacctgaatcaaagcttcaatgaatgaagttctcttcggcccatcatcctgcaagaaactggtaggatgatggcattgggaagctataagggtgattctgacttctctgaaatgacatacattccttgtcaatattatgtcagcggaaaacttgctagccttagaaataaaaataaaggtcttatttttacattgacactttcaatctaggtaaacttgaataattcatttgatatttcagaggcttcatttcttcatctaagaacatgaggatcttttctatttatggaggtatcttgaggattggttgaagtagtgagcatgaaaggtctctagaaaaccttggttgtttagacatgttttagggacattgaaatggactgcgcatggaggaagcttcatggggggcacacctgaggggcatttcctcaatgggagagcacctttgcccttcacaacattcacacacccctcctgggtattggtgccaggctagtgccctgatctgagtccacctctgaacagtcaccctcaccaagataccccgagccaggagagccagtggagcacatctaagccaaagatgtcaaagagagtgaggagtgagaggtccaaattcaactggagaccctcaagatgagacctgttttgaatgagagagagatgaccgtgcagggtggaagcaggtctgatgcagctgacagctaaccactgctgctcggaagtgtcgacggctcaccacttatgtgttggcttttgttcctggactactcaggtggtttaaaagaccaggtgaaattgaggcaataatgaatagcttaccaaccaaaaaaagtccaggaccggatggattcacagccgaattctaccagaggtacaaggaggaattggtaccattccttctgaaactattccagccaatagaaaaagagggaatcctccctaactcattttatgaggccagcaacatcctgataccaaagcctggcagagacacaacaacaaaaaaaaagagaattttagaccaatatccctgatgaacatcgatgcaaaaatcctcaataaaatactggcaaaccgaattcagcagcacatcaaaaagcttatccaccatgatcaagtgggcttcatccctgggatgcaaggcttgttcagcatacacaaatcaataaacataatccagcatataaacagaacaaacaacaaaaaccatatgattatctcaatagatgcagaaaaggcctttgacaaaattcaacaacgcttcatgctaaaaactctcaataaattaggtattgatgggacgtatctcaaaataataagacctatctatgacaaacccacagccaatatcatactgaatgggcaaaaactggaagcattccctttgaaaactggcacaagacaaggatgccctctctcaccactgctattcaacgtagtgttggaagttctggccagggcaatcaggcaggagaaggaaataaagggtattcaattaggaaaagaggaagtcaaattgtccctgtttgcagatgacatgaatgtatatctagaaaaccccatcatctcagcccaaaatctccttaagctgataggcaacttcagcaaagtttcaggatacaaaatcaatgtgcaaaaatcacaagcattcttatacaccagtacagacaaagagagagccaaatcttgagtgaactcccattcacaattgcttcaaagagaataaaatagctaggaatccaacttacaagggacgtgaaggacctcatcaaggagaactacaaaccactgctcaatgaaataaaagaggataccaataaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagctcatatggaatcaaaaaagagcccacattgccaagtcaatcctaagccaaaagaacaaagctagaggcatcacgctacctgacttcaaactatactaccaggctacaggaaccaaaatagcatggtactggtaccaaaacagagatgcagaccaatggaacagaacagagccctcagaaataataccacacatctacaaccatctgatctttgacaaacctgacagaaacaagaaatggggaaaggattccctgtttaataaatggtgctgggaaaactggctagccatatggagaaagctgaaactggatcccttccttacaccctatacaaaaattaattcaaaatggattaaagacttaaatgttagacctgaaactataaaaatcctagaagaaaacctaggcatcaccattcaggacataggcatgggcaaggacttcatgtctaaaacaccaaaagcaatggcaacaaaagccaaaattgacaaatgggatctcattaaactaaagagcttctgcacagcaaaagaaactaccatcagggtgaacaggcaacctacagaatgggagaaaatattcacaacctactcatctgacaaagggctaatatccagaatctacaaagaactcaaacaaatttgcaagaaaaaaaccccatcaacaattgggtgaaggatatgaacagacacttctcaaaagaagacatttatgcagccaaaaggcacatgaaaaaatgctcatcatcactggccatcagaaaaatgcaaatcaaaaccacaatgagataccatctcacaccagttagaatgccaatcattaaacaggaaacaacagatgctggagaggatgtggagaaataggaacacttttacactgttgttgggactgtaaactagttgaaccattgtggaagtcagtgtggcgattcctcagggatctagaactagaaataccatttgacccagccatcccatcactgggtatatacgcaaaggattataaatcatgctactataaagacacatgcacacatatgtttattgtggcactattcacaatagcaaagacttggaaccaagccagatatccaacaatgatagactggattaagaaaatgtggcaaatatacaccatggaatactatgcagccataaaaaatgagttcatgtcctttgtagggacatggatgaagctggaaaccatcattcttagtaagctatcgcaaggacaaaaaaccaaacaccacatgttctcactcataggtgggaattgaacaatgagaacacatggacacaggaaggggaacatcacacaccggggcctgtggtggggtcgggggagtggggagggatagcattaggagatatacctaatgttaaatgacgagttaatggatgcagcacaccaacatggcacatgtatacatatgtaacaaacctgcacattgtgcacatgtaccctaaaacttaaagtataataataaaaaataaaagaccacgtgaaatgagcaggcttgggcaattcaaagcctggaaaaaaagtggtagagagggggatttggggaa

SEQ ID NO: 43 - DNA, 4814 bp, Homo sapiens
gtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcaga

SEQ ID NO: 44 - DNA, 7291 bp, Homo sapiens
gtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttat

SEQ ID NO: 45 - DNA, 24 bp, Homo sapiens
aaggtcacagttgaaaaaaatata

SEQ ID NO: 46 - DNA, 7543 bp, Homo sapiens
aaggtcacagttgaaaaaaatataccccctgttaaaagttactgtctcttctttattacatttaaatttattttaagcatttatacccttcactgggaaaactgactagccataagcagaaaactgaaactggaccccttccttacaccttatatgaaaattaactcaagatggagtaaagacttagatgtaaaacccaaagccataaaaactctagaagaaaacctaggcaacaccattcaggacatgggcatgcgcaaaaacttcatgactaaaacaccaaaagcaatggcaacaaaagccaaaattgacaaatgggatctaatcaaactaaagagcttctgcgcagcaaaagaaactagcatcagactgaacaggcaacctaaggaatgggagaacatatttgcaatctactcatctgacaaagggctaatatccagaatctacaaagaagttaaacaaatttacaaaaaaaaaaaaaaaaaaccaacccatcaaaaagtcggcaaaggatatgaaccgacacttctcaaaaaaagacatttatgcagccaacagacatatgaaaaaaagctcatcatcactgatcattaggtattatgattaggcaaatcaaaaccacaatgagataccatctcacactagtcagaatggcaatcattaaaaagtcaggaaaaaatagatgctggtgaggctgtggagaaatgggaatgcttttatgctgttggtgggagtgtaactcggttcaaccattgtggaggacagtgtggcgattcctcaaggatctagaacaagaaatatcatttgacccagcaatcccattactgggtatagacccaaaggattataaatcattttactataaagacacatgcacacctatgtttattgcagcactatttacaatagcaaagacatggaaccaacccaaatgcccatcaatgatagactggataaagaaaatgtggtacatatacaccatggaatactatgcagctataaaaaagaatgagatcatgttctttgcagggacatggatgaagctggaagccatcatcctcaacaaactaacacagaaacagaaaaccaaatactgcatgttctcattcataagtgggagctgaacaatgagaccacttggactcagggaggggaacatcacacaccggggcctgtccggggtgaggggcaaggggagggagagcatcaggacaaatacctaatgcatgtggggcttaaaacctagatgacaggttgataggtacagcaaatcatcatgacacatgtatgtatatgtaccaaacctgcacattctgcacatgtatcctggaacttaaagtaaaataaaaaataaaaataaaataggtgggtggagccaagatggctgaataggaacagctccagtctacagctcccagggtgagtgacgcagaagacaggtgatttctgcatttccatctgaggtaccaggttcatctcactagggagtgccagacagcgggcacaggacagcgggtgcagcataccgtgcgcgagctgaagcagggcgaggcattacctcactcgggaagtgcaaggggtcagggagttccctttcctagtcaaagaaaggggtgacacacggcacctggaaaatcgggtcactcccaccctaatactgcacttttcccacggccttaaaaaacagcgcaccaggagattatatcccacacctggctcggagggtcctacgcccacggagtctcgctgattgctagcacagcagtctaagatcaaactgcaaggctgcatcgaggctgggggaggggcgcccgccattgcccaggtttgattaggtaaacaaagcagctgggaagctcgaactgggtggagtccaccacagctcaaggaggccggcctgcctgcctctgtaggctccgcctctgggggcagggcacagacaaacaaaaagacagcagtaacctctgcagacttaaatgtccctgtctgacagctttgaagagagtagtggttctcccagcatgcagctggagatctgagaacaggcagactgcctcctcaagtgggtccctgacccccgagcagcttaactgggagacaccccccagtaggggcagactgacacctcacacggccgggtactcctctgagacaaaacttccagaggaacgatcaggcagcagcatttgtgggtcaccaatatccgctgttctgcagccaccactcctgatacccaggcaaacagggtctggagtggacctctagcaaagtccaacagaccttcaactgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaactggaaactctaaaaagcagagcgcctctcctcctccaaaggaatgcagctcctcaccagcaatggaacaaagctggacggagaatgactttgacgagttgagagaagaaggctttggacgatcaaactactctgagctacagaaggaaattcacaccaatggcaaagaagttaaaaactttgaaaaaaaaattagacgaatggataactagaataaccaatgcagagaagtccttaaaggagctgatggagctgaaagtcaagggtcgagaattacgtgaagaatgcagaagcctcaggagccgatgcgatcaactggaagaaagggtatctgtgatggaagacgaaatgaatgaaatgaagtgagaaaggaagtttagagaaaaaagtataaaaagaaatgaacaaagcttccaagaaatatgggactacgtgaaaagaccaaatctacatcagataggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaagctcgggttacccacaaagggaagcccatcatactaacagcggatctctcggcagaaactctacaagccagaggagagtgggggccaatattcaacattcttaaagaaaagaattttcaatgcagaatttcatgtccagccaaactaagcttcataagtgaaagagaaataaaatcctttacagacaaacaaatgctgagagattttgtcaccaccaggcctgccctaaaagagctcctgaaggaagcactaaacatggaaaggaacaaccggtaccagccactgcaaaaacatgccaaaatgtaaagaccatcaaggctaggaagaaactacatcaactaacgagcaaaataaccagctaacatcataatgacaggaccaaattcacacataacaatattaactttaaatgtaaatgggctaaatgctccaattaaaagacacagactggcaaattcgataaagagtcaagacccatcagtgtgctgtattcaggagaaccatctcatgtgcagagacacacataggctcaaaataaagggatggaggaagatctaccaagcaaatggaaaacaaaaaaaaagcaagggtcgcaatcctagtctctgataaaacagactttaaaccagcaaagatcaaaagagacaatgaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgttaacattagacaagtcaacgagacagaaatttaacaaggatatccaggaattgaactcagctctgcaccaagcggacctaatagacatctacagaactctccaccccaaatcaacagaatgtacattcttctcagcaccacatcacacttattccaaaattgaccacatagttggaagtaaagcactcctcagcaaatgtaaaagaacagaaattacaacaaactgtctctcagaccacagtgcaatcaaactagaactcaggattaaaaaactcactcaaaaccactcaactacatggaaattgaacaacgtgctcttgaatgaccactgggtacataacgaaatgaaggcagaaataaagatgttctctgaaaccaacgagaacaaagacacaacataccagaatctctgggacacattcaaagcagtgtgtagagggaaatttatagtactaaatgcccacaagagaaagcaagaaagatctaaaattgacaccctaacatcacaattaaagaactagagaagcaagagcaaacacattcaaaagctagcagaaggcaagaaataactaagatcagaacagaactgaaggagatcgagacacaaaaaaaaaactcttcaaaaaatcaatgaatctgggagctggtttcttgaaaagatcaacaaaattcattgaccactagcaagactaataaagaagaaaagagatgcaataaaaagtgataaaggcgatatcatcaccaatcccacagaaatacaaactaccatcagagaatattataaacacctctacgcaaataaactagaaaatctagaagaaatggataaattcctggacacatacaccgacccaagactaaaccaggaagaagttgagtccctgaatagaccaataacaggctctgaaattgaggcaataattaatagcctaccaaccaaaaaaagtccaggaccagatggattcacagccgaattctaccagaggtacaaagaggagctcgtatcattccttctgaaactattccaatgaatagaaaaagagggaatcctccctaactcattttatgaggccagcatcatagtgataccaaagcctggcagagacacaacaaaaaaagagaattttagaccaatatccctgatgaacatcgatgcaaaaatcctcaataaaatactggcaaaccaaatccagcagcacatcaaaactcttatccatcatgatcaagttggcttcatccctaggatgcaaggctggttcaatatatgcaaatcaataaacataatccatcatataaacagaaccaatgacaaaaaccacatgattatctcaatagatgcagaaaaggcctttgacaaaattaaacagcccttcatgctaaaaactctcaataaactaggtattgatgggctgtatctcaaaataataaaagctatttgtgacacacccacagccaatatcatactgaatgggcaaaaactggaagcattccctttgaaaactggcacaagacagggatgacctctctcaccactcctagtcaacatagtgttggaagttctggccagggcaattaggcaggagaaggaaataaagggtattcaattaggaaaagaggaagtcaaattgtccctgtttgcagatgacatgattgtatatctagaaaaccccactgtctcagcccaaaatctccttaagctgataaccaacttcagcagtctcaggatacaaaatcaatgtacaaaaatcacaagcagtcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgttacctgacttcaaactatactacaaggctacagtaaccaaaacagcatggtactggtaccaaaacagagatacagaacaatggaacagaacagagccctcagaaatagtgccacatatctacaaccatctgatctttaacaaacctgacaaaaacaagaaatggggaaaggattccctatttaataaatgctgctgggaaaactggctagccatatgtagaaagctgaaactggatcccttccttacaccttacacaaaaattaattcaagacggattaaagacttaaatgctacacctaaaaccataaaaaccctagaagaaaacctaggcaataccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaagcaacctacaaaatgggagaaaatttttgcaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccatctcataccagttagaatggcgatcattaaaaagtgaggaaacaacaggtgctggagaggatgtggagaaataggaacacttttgcactgttggtgagactgtaaactagttcaaccattgtggaagtcagtgtggcgattcctcagggatctagaactaggaataccgtttgacctagccatcccattactgggtatatacccaaaggattataaatcatgctgctataaagacacatgcacatgtatgtttattgtggcactattcacaatagcaaagacttggaaccaacccaaatgtccaacaacgatagactggattaagaaaatgtggcacatatacaccatggaatactatgtagccataaaaaatgatgagttcatgtcctttgtagggacatggatgaagctggaaaccatcattctcagcaaactattgcaagagcaaaaaaccaaacaccacatgttgtcactcataggtaggaattgaacaatgagaacacatggacacaggaaggggaacatcacactccggggactgttgtggggtggggggagggatagcattaggagatatacctaatgctaaatgatgagttaatgggtgcagcaacaccaacatggcacatgtatacatatgtaacaaacctgcacattgtgcacatgtaccctaaaacttaaagtataataacaataaaataaaaataaataaataaaaaataaaaataaaataaaaattc

SEQ ID NO: 47 - DNA, 1802 bp, Homo sapiens
tggaaatacatgtgtaaaaactacagtccctacagttttctgtgaattcataatccccagagaccagcagacctcagaaaccaaccaagcaatgggaggagctagaaactcaatggtatcagccaaaatgagcatggagtgttcactcagaatgaggaaccaccgaggaggtgtgcgtcatcagcctcactcacagagaaggaagcctacgtggtcacaagactgagctgtaagagggaggggcaatgcgtagtcagcccagatagagctcaaatgttttaaaatttaatacgttttttattataaggtctaaccaatccctagcaatgacacaatatcactctctcagctctcagttggcacctcctggtagggtgagtttagaaggatgaaggaggaaagtgagaggatagcaatcaagtggattcccttcaacagcacgaaccacacttctcatgagacccctggagggttatccaaagcacagattcccaagcttcgcccgcggagacgctgctttggtggcactaggggaacctcgcaatctggatgctaacctagtaccccaggtgattcttatctacagtggttctcatccccgatacataaataataaatgtcagcgcatcccaaaacttgctcaaagtcaaggtcacttatctaacgtgagtgccaaagcccaaacggaccacagactccagacactagtgacctttccattcaaccctgggaacgtatgagccaaaaaacatgctaaaaccagcgacagtagaatgcaatggtattcagctgctccatgccacacgtactcatgtctgcaaacccttgctagcgggcacctgccagaagcaactctgttacaggatggaatctcacaggttgttcccctacccagcacatatgcggctttcgctaaaccatctgctgctttgctgacaaggacagaccaaggaatttccatgctgcggtctgtcagcgtctgtcacagggccaccaccctttgattgggcgaggaacttggaactgagacctgtcctccaggagaccaatgtgaccctcccagggcagagggagtgctgccacttcacacgtcctctcacccgggcttatctaactggccacaggacaagttctgtgttttgtcggcctgggaaatctaatggaaaggactattattagaaatatttatcttatcaaggaaaatatgctcttaaaatgttcaagaaaggatgctgcctggttcccaaggaatagcctgaaagactatatatatatataatatacactcatacacatatacatattatacacacacatacacatacatgtatatatgtgtgtgtatttaaatgtaatatgcatatgaatattacttaggtaagcatatattcacaactgcagtagtatgttacctttatttttctttcagcagttttttgaagtaaacttcatcatctgactgcaggggttaatgaatattctagtgcttctcacactctgatgtgcacatacatgagtcattcaggaaccctgatgatatgcagattcctattcagcaggttggatggggcccgagagcctgcatttgtagccagctcccagggaatgcttgaggcccaggcaggagccactctgagcaatcagattccagcttgtgatgatgtttgcatcacacataaaacagcacctgtcaaagcttagaatatgtaaaacaaacaaaactaagttcaaattaaggcactctttcttagatgattcagaaggaacttcagaatttgggcaatgcctcttagccatcatta

SEQ ID NO: 48 - DNA, 1246 bp, Homo sapiens
acccacccataatatttgcgttttacagaggaaatttagagatgacaattttggcatgaaatgctggttttccaatggtgaaatttcaggcagtttcacaaatttatgctgtgtcagccattgcttgagtagccagatgtttttataaaatggccattcatcatcactccataaccagattgccaagtatgatcataaggaaagaaaagcagagttaagaaagaaaattagaactgtggagtattctaactaatgcttggtagaaatctagatccttttctttttttttttttttaaacaaaattcaccttttgttcaagaacaagtccttggtaccttagtctctaccattctattcgagtaaataagctttatctcctatgatgtgaaaggtagtttgaagtacagtccttaacctaagagaaagaaagatcttagtcttctattaggagcatatgaagcctattgaagtgtctgaacacttcccatttgctgctaaagtagccctgaaacagagctgaatattgccattctcttttaattgggtaaccttgcaaaggtgagagcagctaagagctagctgacctccttgatattggtcagtacctgaagaactgggctgtgactcttgtcaataactgtagggaagccacaaaaaccatcaagtaaaaggtagctgacctcctatggagggcactgtttgctgctgaggtggatgttacattgtataaaattgttttgaatgtacaggaaaagccacatactctattttcattatcttagattataaccctatgcagagcccctattttagagactggtaggaattcaatctttactgtattgaagggggttcttttctggagttttattaatatctgaggtctcatggggcacaaagcaattaagcatgtcatatagtctacctgtgtcagtgctgggaagctcatagaccaaaccttcagggactcttaaatctgaaggctttacaagtgacagaaatccaatccaacctatcttaaacaaaaatagtaactatttttcacattattgaaaagtcctggatagtagcctgatcttaggacacagctagataaaggtgctcaaacaacgttatgaccctgtctttcatatctggatgagtttcatgccccatggtgaaatgttggctgcctgccatcccaggcacccatccttacatcctggttcttctagtgaatataaaagacctctgtagctcttcaaa

SEQ ID NO: 49 - DNA, 5862 bp, Homo sapiens
ttgatgcaaacataatgattaaatactatacaatcattaaaaaggttctttttaaagaacttttctctatttttttatatgtttttttgagatggagtcttactctgttgcctgggctggagtgcaatgatgcaatctcagatcactgcaacctcctcctgggttcatgtgattctcccacctcagccttccgagtagctgggactacaggtccgcatcaccacaccctgctaatttttgtatttttatttatttttattttttgagacagagtctcgctttgttgcccaggctggaatgcagtggcacaatctcagctcactgcaacctccaactcctgagttcaagtgattctcctgcctcagcctcctaagtagacaggagtgtgccaccatgcctggctaatttttgtacgttgagtagaggcagggtttcaccatgtcggccaggctggtctcaaactcctgatctaaggtaatcctcctgtctcggcctcccaaagtgctaggattgcgggcatgagccaccatgctcggccctaatttctgtatttttagtagagatggggtttcaccatgttggccaggctggtcttgaactcctaacgtcaaataatctgcctgcctcagcctgccaaagtgctgagattacaggcatgagccactgcaaccagcctgttttctttttcttttcttttctttatttttttttttttgagacagagtttcactcttgtcacccaggctggagtgcagcagcacaatctcagttcactgcaaccccgtctcccaggttgaagcaattctcctgcctcagcctcctgagtagaaccagcctcagttttcagttgggatgtttctcttattatttagacataggagttctttatatattctagttacaagttctttatattatttggtgatattttttcccagtctgttgcctacctatcttttcatatttttaaaaatttaacttctatttttttttttgacacagggtcttgctccgttgcccagtctggagtgtggtggtgtgagcacagctcactgcagcctcgaactcctgggctgaagcatcctctggcttcagccttccaagtagctgggcctgcaagtgtgtgccaccacacccagctttttttttctttaagtgtttagagacagggtgtcactcacgctggtctcaaactcctggcctcaagcaatcctcccacctcagcctcctgaatagctggatttacaggtgcaaaccactgctcccagctcttttttttttttttttttttttgagacagagtctttctctgtcgccaggctggagtgcagtgccgcgatcttggctcactgcaagctccgcctcctgggttcacgccattctcctgcctcagccttctgagtagctgggactacaggtgcccgccactaattagtccggctaatttttttgtattttttagtagagacggggtttcaccatgttagccaggatggtcttgatatcctgaccttgtgagccgcctgcctcggcctcccaaagtgctgggattacaggcatgagccaccgcgcccagcctcttttcacattcttaatgatgtcctttgaagcacaaaagcttttaatttgatttagtccaatttatcaatattttcttttatggatcttgcttttgatgtcattttaagaagtctttgtccaactccagttacaaagattttcttgttttcttttagatgtttttacattgaagtctgtgatccattttgagttaatttttgtgtatgctatgaaacaagggtctaagttctttttgtttttatgtgactatcatgctgtcctagcaccatatacagactttcctcaatttacatgggttacatcccaataaacccatcataagttgaaagtatcagtaagtcaaaaacacatttaatacacctagcctattgaacatcatagcatagcatagcctactttaaatgtgctcagaacacttacattagcctacagttgggcaaaatcatctaacacaaagcaaattttatataaataacattttctatataatatacatatattatgagctgggcacagtggttcacacttgtagtcctagctccttgagaggctgaggcagtaggattacctgaagccatgagtttgagaccatctgggcaacaaagcaagactctgtctcttaaaaaaaaaagatatatatatatatcatttttgggggaggatctcttgaggccaggagttcaataccagcctgggcaatatggcgagactgcctttctacaacaaaaaaattcaaaaagtagccaggcatggtggtctatgcctctagtctcagctactcaggaggctaaggtgggagaatgcttgagcccaggaggtcaggctgtagtgggcaccactgcacttcagcctgggtgacagagagacaccctgtctcaaaaaaaaaggaaaccaaaatagaatggttgtatggatactcgccattaatgtacacagctgaaagcaccatagtaaagtcaaaaaactgtaacttgaaccatggtaagttggggactgtattggcaagaccatccttttctcactgaattgtctaggcacctttgttgaaagtgaattgaccataagtgtaaaagtttacttctagatcctcaattctgttccaataatctatatgtgtatctttatatcactgtcataccgtcttataattgtggctttgcagtaagtttcaaaatcagatagtggaagtcttccaactttgttcttcttttctaaaattgaattatttgcaattttgctaaattttaaactcagcttgtcaatgtctacgtaaaagtatgcatggacttttaaaaggattacattaaaattttctttaaattttttttttcttgtagagatgaggtctcactttgttgcccaggctggtctcctactcctagactgaagcaatccttctgcctcagcctcccaaagtgttgagattacaggaatgagccactgcacccaacccaaaactgttaattaatttagaaagaattgccatcttaacaatattgagtcttccaatccattaatatggaatatctattatttattttaaaatttatctcagcaatgttctttgtttttcagtgtacaagaattgcactttcattaaatttatgcttaaatatggccgggcgtggtggctcacacctgtaatcccagcactttgggaggccaaggcgggtggatcacctgaagtcaggagtttgagaccagcctgcccaacgtggcgaaaccctgtctctactaaaaatacaaaaaattagctgggcgtggtggtgggcgcctgtaatcccagctactcgggaggctgaagcaggagaatcgcttgaacccaggaggcagaggttgcagtgagttgagatcgggccactgcactccagcctgggtgacaagagcgaaactctgtctctaaaaaaaaaaaaaaaaaaaaaaaaaaaattgtgcctaaatattatattatttttaatgtcattgtgaatggaattttcctttttacagctttattgaagtattactcatgtacacaaaattgcacacaattaatgtatacaattttttctcaatatgggcaaatgttttattcatatattatataaagttcattatgccaatttatcaggtactaatcattaaacaaaaatttttttaatttttttttttttttgagacatggtcttgctctgttgcccaggctggagtgcagtggtgcgatctcggttcactgcaacctctgcctcctgggttcaagcaattctcctgcctcagcctcctgagtagctgggattacagatgcatgccactatgccaggctaatttttttttatttttagcagagatggggtttcactatgttggctagtctggtctcgaactcctgacctcaagtgatctgcccatgtcaggctcccaaagtgctgggattacaggcatgagccaccacccctggtcccccaaattttttttaacttataagtgtacttaaaatttctttttattttaaaagcatgtcatccttgcataggggccaagctaatcttctctgtatcgttccaattttagcatatgtgctgaagtgagcacaacaaattttttaatagataagaaatattgtatacatttattgtgtacatgttgttttgaaatatgtaaacactatggaaagacaaatcaagctaattaatatatgcattacctcaaatacttatctttttttgtggtgagaacacttaaaatctactgtcttagcaattttcaacaacacattattattaactatagtcaccatgttgaacttattcctactatcacaggaataagtatcctttgatcaacatttccatcccctactctctcttgcaagctcctggtggccaccattctactctccgagttcaagtttttttagattccacatataagtgagatcatgtgatatctgtctttctgtgcctggcttatttcacttaatataatgtcctccaggttcatccatgttgtcaaaaatgacagaatctcttcctttttaaggctgaatagtattacattgtgtatatacaccacattttctttatccattaacccactgatggacacttaggttgattccatatcttggttattgtgaataatgccacaatgaacattattgtggttcattggtgcaggtatctcttcaagatcctgattcaattctttcagatatatatatccagcagtgggattgttagatcatgtaacagttttatttttagtttcttgaggaacttccatactgtcttccatagtggcagcaccatttttaatctccaccaaatgtgtacaagcattccaatttccctatatgcttgccaatatttacctttttttcttttgataatagccatcctaacgtgtgaggtgatatctcaccgtggttttgatctgtatttccctgatgattagtgattttgagcacttttttttttttttttttttttttttttgagatggagtcttgttcttgttgcccaggctggggtgcaatggcgcgatcttggctcactgcaacctccacctcctgggttcaagtggttatcctgcctcagcctcccgagtagctgggattataggcacgtgccaccacacctggctaattttttgtattttttttttagtagagacagggcttcactttgttgaccaggttggtcttgaattcctgacctcaggtgatctgccagcctcggcctcccaaagagctgggattacaggcgtgagccaccacacccggccttaagcaccttttcatatacttgttggttatttgtatgtcttctttagaaaaatatctattcaagtcctttgcccattttttaattgggttatttaggggttttttggatattgatttgtaagagttccttatatattttagacattaaccccttatcagatacatggtttgcaaatattttcttccctggaattgttttcttaatttcattagtgaattattcatttatttatttattgagagggtctcactctgtcacccaagtgaagtacagcagcgcaaatgcagctcactgcggcctcgacctgctgggctcaagtgaatctcccacctcagcctcccaagtagctgggaccacaggtgtacaccaccacccccagctaatttttttatttttggtagagacagggtcttgccatattgcccaggctgctctcaaacttctgggctcaagcaatcctcctgcctctgcctcccaaagtgttgggattacaagtgttagccaccatgccaggcta

SEQ ID NO: 50 - DNA, 7014 bp, Homo sapiens
ttgatgcaaacataatgattaaatactatacaatcattaaaaaggttctttttaaagaacttttctctatttttttatatgtttttttgagatggagtcttactctgttgcctgggctggagtgcaatgatgcaatctcagatcactgcaacctcctcctgggttcatgtgattctcccacctcagccttccgagtagctgggactacaggtccgcatcaccacaccctgctaatttttgtatttttatttatttttattttttgagacagagtctcgctttgttgcccaggctggaatgcagtggcacaatctcagctcactgcaacctccaactcctgagttcaagtgattctcctgcctcagcctcctaagtagacaggagtgtgccaccatgcctggctaatttttgtacgttgagtagaggcagggtttcaccatgtcggccaggctggtctcaaactcctgatctaaggtaatcctcctgtctcggcctcccaaagtgctaggattgcgggcatgagccaccatgctcggccctaatttctgtatttttagtagagatggggtttcaccatgttggccaggctggtcttgaactcctaacgtcaaataatctgcctgcctcagcctgccaaagtgctgagattacaggcatgagccactgcaaccagcctgttttctttttcttttcttttctttatttttttttttttgagacagagtttcactcttgtcacccaggctggagtgcagcagcacaatctcagttcactgcaaccccgtctcccaggttgaagcaattctcctgcctcagcctcctgagtagaaccagcctcagttttcagttgggatgtttctcttattatttagacataggagttctttatatattctagttacaagttctttatattatttggtgatattttttcccagtctgttgcctacctatcttttcatatttttaaaaatttaacttctatttttttttttgacacagggtcttgctccgttgcccagtctggagtgtggtggtgtgagcacagctcactgcagcctcgaactcctgggctgaagcatcctctggcttcagccttccaagtagctgggcctgcaagtgtgtgccaccacacccagctttttttttctttaagtgtttagagacagggtgtcactcacgctggtctcaaactcctggcctcaagcaatcctcccacctcagcctcctgaatagctggatttacaggtgcaaaccactgctcccagctcttttttttttttttttttttttgagacagagtctttctctgtcgccaggctggagtgcagtgccgcgatcttggctcactgcaagctccgcctcctgggttcacgccattctcctgcctcagccttctgagtagctgggactacaggtgcccgccactaattagtccggctaatttttttgtattttttagtagagacggggtttcaccatgttagccaggatggtcttgatatcctgaccttgtgagccgcctgcctcggcctcccaaagtgctgggattacaggcatgagccaccgcgcccagcctcttttcacattcttaatgatgtcctttgaagcacaaaagcttttaatttgatttagtccaatttatcaatattttcttttatggatcttgcttttgatgtcattttaagaagtctttgtccaactccagttacaaagattttcttgttttcttttagatgtttttacattgaagtctgtgatccattttgagttaatttttgtgtatgctatgaaacaagggtctaagttctttttgtttttatgtgactatcatgctgtcctagcaccatatacagactttcctcaatttacatgggttacatcccaataaacccatcataagttgaaagtatcagtaagtcaaaaacacatttaatacacctagcctattgaacatcatagcatagcatagcctactttaaatgtgctcagaacacttacattagcctacagttgggcaaaatcatctaacacaaagcaaattttatataaataacattttctatataatatacatatattatgagctgggcacagtggttcacacttgtagtcctagctccttgagaggctgaggcagtaggattacctgaagccatgagtttgagaccatctgggcaacaaagcaagactctgtctcttaaaaaaaaaagatatatatatatatcatttttgggggaggatctcttgaggccaggagttcaataccagcctgggcaatatggcgagactgcctttctacaacaaaaaaattcaaaaagtagccaggcatggtggtctatgcctctagtctcagctactcaggaggctaaggtgggagaatgcttgagcccaggaggtcaggctgtagtgggcaccactgcacttcagcctgggtgacagagagacaccctgtctcaaaaaaaaaggaaaccaaaatagaatggttgtatggatactcgccattaatgtacacagctgaaagcaccatagtaaagtcaaaaaactgtaacttgaaccatggtaagttggggactgtattggcaagaccatccttttctcactgaattgtctaggcacctttgttgaaagtgaattgaccataagtgtaaaagtttacttctagatcctcaattctgttccaataatctatatgtgtatctttatatcactgtcataccgtcttataattgtggctttgcagtaagtttcaaaatcagatagtggaagtcttccaactttgttcttcttttctaaaattgaattatttgcaattttgctaaattttaaactcagcttgtcaatgtctacgtaaaagtatgcatggacttttaaaaggattacattaaaattttctttaaattttttttttcttgtagagatgaggtctcactttgttgcccaggctggtctcctactcctagactgaagcaatccttctgcctcagcctcccaaagtgttgagattacaggaatgagccactgcacccaacccaaaactgttaattaatttagaaagaattgccatcttaacaatattgagtcttccaatccattaatatggaatatctattatttattttaaaatttatctcagcaatgttctttgtttttcagtgtacaagaattgcactttcattaaatttatgcttaaatatggccgggcgtggtggctcacacctgtaatcccagcactttgggaggccaaggcgggtggatcacctgaagtcaggagtttgagaccagcctgcccaacgtggcgaaaccctgtctctactaaaaatacaaaaaattagctgggcgtggtggtgggcgcctgtaatcccagctactcgggaggctgaagcaggagaatcgcttgaacccaggaggcagaggttgcagtgagttgagatcgggccactgcactccagcctgggtgacaagagcgaaactctgtctctaaaaaaaaaaaaaaaaaaaaaaaaaaaattgtgcctaaatattatattatttttaatgtcattgtgaatggaattttcctttttacagctttattgaagtattactcatgtacacaaaattgcacacaattaatgtatacaattttttctcaatatgggcaaatgttttattcatatattatataaagttcattatgccaatttatcaggtactaatcattaaacaaaaatttttttaatttttttttttttttgagacatggtcttgctctgttgcccaggctggagtgcagtggtgcgatctcggttcactgcaacctctgcctcctgggttcaagcaattctcctgcctcagcctcctgagtagctgggattacagatgcatgccactatgccaggctaatttttttttatttttagcagagatggggtttcactatgttggctagtctggtctcgaactcctgacctcaagtgatctgcccatgtcaggctcccaaagtgctgggattacaggcatgagccaccacccctggtcccccaaattttttttaacttataagtgtacttaaaatttctttttattttaaaagcatgtcatccttgcataggggccaagctaatcttctctgtatcgttccaattttagcatatgtgctgaagtgagcacaacaaattttttaatagataagaaatattgtatacatttattgtgtacatgttgttttgaaatatgtaaacactatggaaagacaaatcaagctaattaatatatgcattacctcaaatacttatctttttttgtggtgagaacacttaaaatctactgtcttagcaattttcaacaacacattattattaactatagtcaccatgttgaacttattcctactatcacaggaataagtatcctttgatcaacatttccatcccctactctctcttgcaagctcctggtggccaccattctactctccgagttcaagtttttttagattccacatataagtgagatcatgtgatatctgtctttctgtgcctggcttatttcacttaatataatgtcctccaggttcatccatgttgtcaaaaatgacagaatctcttcctttttaaggctgaatagtattacattgtgtatatacaccacattttctttatccattaacccactgatggacacttaggttgattccatatcttggttattgtgaataatgccacaatgaacattattgtggttcattggtgcaggtatctcttcaagatcctgattcaattctttcagatatatatatccagcagtgggattgttagatcatgtaacagttttatttttagtttcttgaggaacttccatactgtcttccatagtggcagcaccatttttaatctccaccaaatgtgtacaagcattccaatttccctatatgcttgccaatatttacctttttttcttttgataatagccatcctaacgtgtgaggtgatatctcaccgtggttttgatctgtatttccctgatgattagtgattttgagcacttttttttttttttttttttttttttttgagatggagtcttgttcttgttgcccaggctggggtgcaatggcgcgatcttggctcactgcaacctccacctcctgggttcaagtggttatcctgcctcagcctcccgagtagctgggattataggcacgtgccaccacacctggctaattttttgtattttttttttagtagagacagggcttcactttgttgaccaggttggtcttgaattcctgacctcaggtgatctgccagcctcggcctcccaaagagctgggattacaggcgtgagccaccacacccggccttaagcaccttttcatatacttgttggttatttgtatgtcttctttagaaaaatatctattcaagtcctttgcccattttttaattgggttatttaggggttttttggatattgatttgtaagagttccttatatattttagacattaaccccttatcagatacatggtttgcaaatattttcttccctggaattgttttcttaatttcattagtgaattattcatttatttatttattgagagggtctcactctgtcacccaagtgaagtacagcagcgcaaatgcagctcactgcggcctcgacctgctgggctcaagtgaatctcccacctcagcctcccaagtagctgggaccacaggtgtacaccaccacccccagctaatttttttatttttggtagagacagggtcttgccatattgcccaggctgctctcaaacttctgggctcaagcaatcctcctgcctctgcctcccaaagtgttgggattacaagtgttagccaccatgccaggctagggctgaataaattaatgagagaataaaaagagtgttttcatgtttcttacatggatgaactttaagttttttaagttttctctcatccttgttttatttatttatttgtttgtttgtttgagacagggtctcactctgttgtccaggctggagcactctggtgccatcacagctcaaacagccttaacctcctaggctccagtgatcctcccactttagcctccagagtagctgggactacagacatgggccaccatgcccagctaattttttattttttgtagagatgagatcttgctatgttgcccaggctggtctccaactcctggactcaagtgattctcccgcctcagcctcacaaagtgttggaatcacaggtgtgagccaccacacccagactgtatatttattttcaaatataatcattttgatagcagggatatcttcttattcagctttgcatttatggcaaatagtaggcaacttaataaatttgttgaagaaatggaatatagcaaaactttgaattagccatttatattaaaagggaaaagagaccagcctgggtaatgtagtgagaccccatctctacaaaaaaattaaaaaattagccgagcatggtggtacacacctgtagtcccagctactcaaggggctgaggtaggaggattgcttgaggacaagagtttaaggttgtagtgagctatgattgcaccattgcattccatctggagtgacatggagagaccctgtgaccaccccccagaaaaaagggaaagaagagagcattacttttttcttttcttttctttcagacagtctcactctgtcacccaggctggagtacagtggtacaatctcggctcactgtaacctctgcctcccaggttcaagtaattctcctgcctcagccttctgagtagctgagattacaagcgtgcgccaccacgcctggctaattttgtatttttagtagagacagggttttaccatgctggccaggctggtcttgaactcccaacttcaagtgatccatccgcttcagcctcccaaagtgttgtgatcacagttgtgagccaccacgtccagccagcattacttttttcaagggttaagaacatgcctttaaatatcttgataacttgcttgag

SEQ ID NO: 51 - DNA, 1727 bp, Homo sapiens
gtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaat

SEQ ID NO: 52 - DNA, 5456 bp, Homo sapiens
ctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctg

SEQ ID NO: 53 - DNA, 7182 bp, Homo sapiens
ctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctgtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaat

SEQ ID NO: 54 - DNA, 16461 bp, Homo sapiens
ttcttgccactcatactgaagttttcatccatcagagaaaaaaaaatcttcatatggcctactatcactacaaatgatgacagcagtactaagaaggatagtgagcacttgtacagcacttggtatatgcccagtatgcactaagtgctctgcattcagtatctttttaactcttcataataaccccatgtcattggtactgttttcatctcgattttacagatgaggaatctgaggtgaattgagaggtaatagctcagggtctaatagttagtaggtagaacaaggatttaaactatgtctacttgtaatacattatttatatggcaatttgcttcactaataggatcgatccctctataatggatcctattagaatggaaaatgatgggcctagagatattttcacataaaatatggcttctatagaatgtattaataatgactatcaaacacccatttggaccataggtgttatgggatggaggaggacaggaaggaaataagaaatttagtccctgccctattgctctgagaagtatctgggaagccaggcatttcctggtctagataggattatgtttcaacattggctaggacctccagatttcacacacatccacccacatgtggacagcatgagaataataaccaggtaacctgtacagctaatcaaaatgttcttgctatcagagaacaccagtagatgcatgagtcatggacagaaggtggcaaggctttgtggatgaaagaaaagctatgaaatactaccacactgacctcttctatactggatggcacagtgccctggaaaaataaatcaccacacgagcatgaaatcaggattgggaaaatacacaggaaatacaagaagaatatccctatcagatccttttaaagatctgcctaaccggacagttcagtgctgatgtgagtaactcctttcaagtttacaatatactagctgaaagtttttagaaccagggttccaaatacattaataaagatttgtacaggtgtgtagggaagttaataataaattaacagtgaacttcacactgaaataataacttctttgcagtaaatagctacacatattaaaaaattaaaactgatgaaaaataaaattagagttcctctctcctccctttctcactatctctcaaagtgacaggccatacaattaaaggctgtttctttgcaaagtccatgctttgcagttctaatcactcgagtgatttatagaggaaatgatgttttgcaggtactctaaaacagagctgcactttgtccagtgtgcaaggccatgcttaatgaaaaactttaaatttggaaggaaaaaaactgcagtaaaaagagaagaattatgaaattttagtatttacttgatttattaatgtttccttgtgcatttctttttataatttgtgtcctggctaaggcaggaaggcaaaacaaatgtccttttgtttatggctttaaaaaggtcataagaataacaaaaggatacataaatactgatgactatatctttccctatttcactgtacattaatttaacagtctgctactgaaatactgctgttggttaagcacagagttaactatttaaaaatattcttgtctttttaacccaatttctttcaaggatataattaatccagttaagaccgttcttaaaatatgtgcaggtcatgatagaaatgtcacttgtcaactctctgatgcatttcagatctgctctgccactatagagttccagacagacaggaaacattgtaaatcactgaagaaacatacaagttaagaactgtgattttgttacttaaaattactgaaaaatagacaaaattcaagcatatatcaggagcgtaaatgtagaaatctgtaagcatttacccagaaaggtgcagatcattaaactaataaagctaactcatattcagtgcccaaggatatatcaaattttgtaaaaacaactttaagtcaccggaggcaaggagagctccaagttagcacaaagaatgttgatttcaccggggtgtggtgactggggataggcacacctggcaaaactccattctgtgggctactaaatctctgtatttgttaggttgtgctatattgtgtatttcggttctgccacccaaagaaggtatccaaaataacttgtggtgggcgtggaggaatcacatattaaaagtcccaaagtctgtgcctccttcatgcttgtgcagctgtcttccagtgtcactgccttgtagactgcacaatcatggtgtgattctagatagctcagctccaccacagaaataaaggggataaaatgaacagttggcgagatactgagactgcagtttgaacctctataggactaatgcttttaggttgttctttattttgttgctttgctttcttttgccaacagcagcgggggcttagctcttattcaaccatatactttttaaaatctctactcagtggtactgatagaaaacattttcaagattccactgaaaaagaccagagctttgtaagggtagtggagttctctaggtggaaaaataacttcctcgcctaatagggattggacaccaccacccacatcttggtctcaatagcaccaaactttaaattgccaatctagccaggcccttatgctaaggccgaagtgagtcttaccttcagtgtagaagctgaaaagcaggtaggtgtctctgattcagtctagcctgaccacatgcactttttggtctaatcttaaaatacttaaatgtctaacaactacttctgtttcccagctattctctcctaatatttatgatatatcttggctatttgacagtagatttgagtcatatagttaagtcatatagttaagtcaactatttgagtcatatagttaagctatcaactttctatagacatagtttgccttatactataacatacattcttcaaccttacactatacagcaaagtatttattattgtttctatcaaaataatatcttacattcctgtaatttcttatagttgctaagtactctttagatgttttttcccatttatatctcacaacatcctggtgaggtagctgatattatcctcatttttccggatcagaaaattgaagaaagcataaatcccttgttcaaggtcatagagctagttagagaacttggcagaatatgaaaccaatttgtttaattctaattacagtgttatgtccacaatacctctccctcaatcaaaataaaaacgtttcaaccaaaataagatgccacagcagttttttaaagaaattaataaatttatataaaaacccatatacagtttagcacaaaataatatttcaaatttaagtatcttcaattatccttgcaataatccactatcaaaagccattgcttaaactaatcccccctttaagtatactaaacaacgtgctactgtgtgtatttgtgtatccgtgagtgagtgtgtgcatgcttgcctgagctcatttaaagggatacctttatcctgaggtttaaaaacagtgaggtctgaattttcattgttaaaagcagatcatggagcaatcaatcagctaataaccatctattaatatctgatgtactatgcaacatgacagagtaaatgaaaataagaataagatgcatttcctacatttgagtttctataatctagcgagaggacaaggaaacaacacatctaccacatcatcatcatcatcatcatcatcatcatcatattagcaatgacattaatgccgacattcattcactacatacttctcacattttaggccagcactggccaacagaaatataatgtgagccacatatgtaatttttaattttccagtagccaaattaaaaaaggtaaaaagaaacagataaagatgaattttatttaacacatatatctagaatgttttatgcacatgttaataaaaaattatccagatattttacatactttttcatattaaagtctccaaaatccaacgcagtcaatgaattacataacaacggggaaacattctgagaaatgtaccattgcatgaacattacagtatacttgcacaaacctaggtagtagagccaactacatacctaggatatatgatatagtcttatggtgcctaggttgcaacctgtacagcatgttactgtactgaatactgtaggcaactgtcgcactattgtaagtatttgtgtatctacacagaaaaggtacagtgaaaatatggtatcttatgggactaccattgtgtatggtcccttgctgacccacatgtcattatgcagcacatgactatattttacacttatggcatatcacaattcaaatgtaaattttcatcagaaatacttgatctgttttagatttcataaaactgatcattgaaaaagtaaattcatgtacccaacctgtaccaaatatacttaaaagttttctcataacgaaattgagtatccaaaaaatcattttcctttaattttcacaagtacattgacaaaactggttcacttttgtttaaaagaactgatttgggccaggcgtggtggctccttcctataattccagcactttgggaagccaaaccaaagccaaagtatggcttgaggccaagagctcaaggcctccctgggcaacatagtgagaccccatctctacaaaagatttttaaaataatatttttttaattagctgggtgtgtcccagctgctcaggaggctgacacaggaagattgcttgtagtccagaaggtcaaggctgcagtgtgccatgatcacaccactgcactcaacctgggtgacagaatgagaccatgtaccaaaaaaaacaaagaaaatgtttgttattttaaagtaaactgggcatggtgaggcaggcctgtagtcctagctacttggaaagctgggacaggagaattgcctgagcccaagagttcaagactgcagtgaactatgaccaggccactacattctagcctgggtgacagagtgagacttcatttcaaacaaaaaaaaaaaaaaaaaagaaagaaaaactgatttgactttgaagtataagcatatcagtttcaaatccatatcggttcaagttaagtaagctaattaactcttgtgtcaagtcagtattaacactggattcaaaggaatatttgcataaattggaaaacaactctaaatttatcagtatcaacaaagagctcttcaaattctagtttttgtagccaatatatataatggtatttataattaaaatcttctgcacattaatcattactattgacttatattatgaaaaccttcaatttcaacatgaattctaatatctgcctagctagttgacaaattaccttgtcctttcctgagactttcaaattagttcattcaaaagtagtgtgatctgagtcagaaaacataaaccatactgctatattcccttttttttttttttttttggatggagttttgctcttgttgcccaggctggagtgcaatggcacgatcttggctcactgcaacctctgcctccccggttcaagtgattctcctgcctcagcctcccgagtagctgggattacaggcatgcgtcaccatacccggctaattttgtattttttagtagagacagggtttctccatgttggtcaggctggtctcaaactcccgacctcaggtgatccacccactttggcttcccaaagtgctgggattgcaggtgtgagccaccgcgcccggcccatattccctttttaagtactgaatacttgggcaagtgcccctttttgtttcaacaaaagatcatctttggttggagtaaatattatgctatagaaatctgtgtaaaactcgtccaggactccaccaacaagtgctgctaaagatcacaaggtcactgccttcactgtcttccatttctttctgcaggtccataaaccagcaatgatctatgaatttacacttatagactggataattttaactactagtatgtgtcacactttttgccaagttaactactgtattgtactctgtccagcttcagaatacagtcgaatgaagcaataagagaaataccagcctcttgaaaaattccaataaatacagaattcggtctaagagagctgggtcaactgtaatagaaattaattttttcatatccatctgaaattctttgaaacagtcaaatgtttgaattgaatgttcttaaaacattcaaaaatatctctgccacaaatctgttatttttggcaaaaaaaattacaacatttatttataaatcttaaagtctgtattaatcggacaatggatcatcatactgtataacttacacaaagctaaaggaaagtaattgaaatgtttcaaatttcaaatgggtcatgtagtctataggcaactgtttagtgaaaaatatctttaagtttttgtgaaatatatttttgtctcttctcataattttctaataaaattttggtacctgcaataattccttctgccatctctccatcttaaactggcttcctctatagtgcatgaatccaagacactgtataggtggccaaagttacaggctcatactctgttaaaatttttaaacttaatgaacatttgatatagtttagatttctgtccctccaaatctcatgttgaaatgtgatcctcaatgttgaaggtgcggtctagtgggaggtgtttgagacagggggacagatccctcatgaatgagtgttactgccatgctaacatctgcagaactgagagccaaataagcctcttttctttataagttacacggtctcaggtattcctttacagtaatgcaaaacggactaataaaacactaaattctgctttcaggcaattacttccatcaattcttcattgacctttgagaaaaaacttctcatcaaatctaccacagatttcttgaaaatgtcttaatattgcccatttcattttctttacattttttatacaattgcaaatgagattcatcatgaagtccctagtctctttgtgttcccactgctttgatcatactactaatttctgtatctgtactcactccgcaacagtagtatgccttcacttcaaatttaaaaactgtccatatttatttactaacaagtgatgtagttaccttaattttatatatcacttaaacatttctgggggatgagggataaaaatctacatgtcaggtaccatgtacactacttgggtgacaggtacactgaaatctcagattttaccaccatacaattcacccacgtaaccaagaacttcttgtaccccaaaagctattgaaataaaaaatttaaaacaaacatttcaatttaattactaatgataatgtacttgcatcactataagctgcactgtctgcacaaaatatttaataaatactataaagtgagaacacagaaaaagtatatactgaataaattatttgacaccagcaagattggtagtgtgtttatgtatgctaatgtagtcttaccaaaacaagaaaactgtgtttaacagaaatatatcgtgcactgcttccatcttaaaaatccagttcctcgggtacgctagtcacactgaactgctcgacagacacatgtggcttatagctattgttcctgatcatacgatgagaggctgtgttcatggcagtctgtatttattaattgtggtaattctcacaaggaagagaagtctttactctaattatccccacattacagacaatggaatttaggcaaaagtaattaagtgacttacccaaagtcacaaagctattaactggggaactgggatttcaacccagacagtctgactccagagactcttatccactattccacaccgccagaagttcaacaacagcacagggtttcatgagagatgaggcaagagatgcagagtgtgttaaaaatatatatataaaccaaactactttgcaatgaaaagaaggaagccagaactcacaggaagacgtcgtgaaagagggagaaagacttgagctgcgtagtccaagataaatgctgcagataaacagcccaggcagctgagcgcaggaggagtaggtgtgcgaagcgcgagcaaagtgtgtttagccatgaacaggtaaagtgagtcagctgtggagttaatgcagcaggctaaaaaatggcccccaaaagacacagccacatcctcaccactgaaatctgtgactgatacctcatattagaaaatcatctttgcagatgtgatgaagttaaggaccttgcgttggggagactggagattatcgtggattatctgggtgaactctgagcataatcgcgagagtccttataagaaacaggcagtgggagatttcacccagtcagaagacgaggccacgagaccacagaagcagagattagggccatgtgccccaagtcaagggattccagcagccactagaagttagaagaagaaagcaaggaattctcctcttgaagcctccaaagggaacatggcctttctgacatacaccttgattttggacatccagaactgtgagaagacagctgtgttgtttaggccactcagtctgtttcaaaagccataggaaactaatacagcttagaacctctcaaaacctgcaacatgcaaagcgaccttgtgaatcagcaagaggtcaatctagcaagcagtcgttcccagtctatttaatgagagaatacccatttcccagaaagagagagctggtggtgaaagcatgcaccttttagcatctggcatacctaacattcctctaacaaagtttgggaattcctaacccaagtcacattctggaaggcaatttaatcaagtaagtctgaactttattcaaacaatgcaaaaacgatcgaaggtttttaagaaatgttgcaagaagtcaaccatttggggtgaggaaatccaggaccctgtgaccctggattcagggtagcttcaaagtagcagaatgcattgctttggaagataaaacatgtcagcagctgagccagccctcccagctgacagcagtgaactctgccctgatggaaccacctcctctgggaagtgctcctgtcatgagggatgctgacaaactaaagtggcttcacagtgtgacgagtgagaaatgacataaaagaatgaaagaagtgttgtgctagagagcaatattcaaatgggaaacaaaatagcagtaccttcaagtaaacgaaaggctaaaatatattgttaataacaaaaaatgagctacaaacggttcaataaaagtcaaaggtgaaaccatcaaggggagtgggatcaggtcaacaggaagctgcccatgggcatctgcagtaagaagcacctggccagtatggatcttcctgtggagacaagttatcaggctgccacaggagaagaaaacccacactgcataggaagctggacctcaaaactgaccagcttccacaagtctaagatttcatgacctaaactggacacaggcctgtttatcatacgcacatgtagagctggaataaaaactgaatttcaaaaatattgtgtgaaactaggggtgaaattcaaaatattgaataacctgcgtagcacaggcactgacccaccagaacgtatcccagcttatgtgcctacaggtaggtgcccacctcctgaatttcagccttcataaaaccgtgaacgctgacggagagttggaaacagattctgaacaggcagggatgaagaggggaggggaagaaactactgccgtttaaaaacttcacttgaactgacagcaggtcccccattttgggaagccacaggatgtcaaggaaaggtgaccaggtaggctggaagccacattctaaatacagcatctctgaccacaaacggccggcagccacacactgtggccctgccatctccaaggccactgactcagcacggctgcgacctaacgacacactgggaagtctgggtttggttttggttgtgcgtgctctctctctctctctctctctctcttctctttcttctcccccacaacactcctcctcccacctacactcccccttctctccgaccccgctcctatagcatacattttggttccactggttgccggcttatccatttggcggtaactgtctggtaggttaatgcccaacaataggcacttgtattttcttatacgggggaggtaaattatggcacttgaacaaagaccttactatttaagttttactgcacgtttactacaagccagtttcaattttacgtttttgtccctaggccataagagaaaaaagagcaggttcctgttcatattcgaaggagctgtttaaataacaataacaacaatacctggcaaaagcgggatctgttataggtcgaattctgtccccctgaaaatgtatatgctgaagccctaacctccaggacctgggaatgggatgttagttggagatacggttggtgcagatgtaattagttaagattaggtcatactaaagtaggtggcccctaatccaatatgagtggtgtccttatttaaaaaaaaagaaagaaaagaaaatctggacacaggcaacacccagcaagaatgtcacaggatgatgaagtggaatggtgtttctacaagccaaggaacaccaaatattgccagaaaaccaccagcggcaaggtaaggggcctggaacagatccttccctcacagccctcagaaggaaccaaccctgacaacaccttgatcatggacttccagcctccagagctatgagacaataagtttcagttgcttgaaccacccagtctgtggtactttgttatggcagccctagtggactaacacaagaccaaaagaatcaggagagtggcaactgaaaggtcaggcaaggtggccgggcaagtttggaggaaagagtttccactctttgcacctctagttaactgtcaggaagcccccagactcgcctgcctgtcacactggctttctctggggtccatcatccatcgctcctgagcttggcataagctgctggtccttcctcaactcttccagctgcccctgtccctcacacactcattcagtggaactcacaattctaaatgccgattcaaccaccactttctcagaaatgcatcctgatccctccagcctgcatcagaccccactgtttcccactggtctgtagggtctacaaggacaggaccatgactgcattgctcaacatgatgttgctggttggctggaatacatatttgctccataaattaaaattcattgtccttgggttactaatctcacaggtcctatggctccagcagacacgccaatgccctgatgatgtctacaacttttatagcaaacctgtatcaccagcttggcctctttgtcttaaaacatgagatacccctgggctctggtctcccacattgtcaattgaggggcactactgaccctttctctgcagagccacacgggctctcctttcccctacagaacttctcagacttaaccactgccatccactcccatccccatcatctgggcagtgtccatggtcttcctgccccagcatccaggtgggagcacccacacaccaggataaactgactgtgctactctttacttaaaaatcagcttgatttccattgcctattctaaagtaattttttttaaaagcagaaatcaaatctatgcaagggattaccacagaactgtctggtttctgggtggggaagctgtgaatggctgtgggagaggcaaggcgcctcccaagcagtggcctcccactaccctttgtgtcacactcccaccccacctcttagcaaatcttgaggcattccaggtaactcagggctcctcacaacagtgtagaaatcacaggtccctctggttaaatccagcctttttagtaaaggaatcaaggctcttcatttaactatcacctccattgtcaaaagcataaccaaataaaaacaaacatcttcacgtgaacattccatatcttggctccaattcttccctcccatattcattcattcattcattcatcagaaatctgctgttttaggaagtggtccaaggttacagagatgccttgccttcaaaaaacagcaatgcagtaaataagacagttgtgtccattgacatatgtaaaaacagtaataataaaaataacaggcaatatttaccacaggcagcactggaagtattctatgtgcattagccttctgaacaaccctttagggagggtcccataattatcccaattttaaggatgaggaaataaagagtcttgaggaggtcaggtcaggtcaccagctagaaagagggcaaaggaagattacaaaccatacgttctatgctattttaggtgatcccagtcaggtgtggtcacaagaggccacacagtagaggctcaggaatcagctgattgtcctcagtgatcctagagacaggaggcccgccatgcaggccacactggaacgcctcaggctggtgagaggcagagtgggcaggaggaggagagaactaggccacagtctttaatggacttccaggaaaaacaaggcggggcagggtgaacaggttaggagtggctaagttgaataatttcagcaggctttgggctacagaggtggtctctagttgcctggcacctagccttgaatgatgtaagcaagggaatactgcttcctgaagtgtaagggccagatagaggaggtctgggtatggactagttggtttgtatctcaaaggcatgctcctggctaggccctggctccctctcagaactggctagacctgcaagggcagcctcttcccaaccacaatggtttctaagatgtcaaaacatcataatatatagaaaataaaaaccgtaaataatacaccagactacctgacttcaagccttcagcaactgtgcctgctacatccccagcatagtgactgcacaaagtaaggccaggtaggagacacaatgaaggcctctggaaggtgagaaaaagatccacaaaggcagcactcaaagcacatcaacaataaaggaaacatagaagcttccacgaggataagaataaaagaaggactttccaagcaaagggactgggcaataaaaaggcaacctggccagtccagttggctgctgtgccttgatgtctctggggccagggtcctgggacagcactaaagatgaggatggagacgcaggcctgggcaagaatccctaattttcaattaggtgtatgataacaggtagtatgaatagatttcaagggtttattaagcactaagtatagtgtaagctcacatataacagaaacatttagtacccaaaacaccaaacgtatctaagaagccttaaatatcaaatttttagaccgggcacggtggctcatgcctgtaatcccagcactttgggaggctgaggcaggtggattacctgaggtcaggagttcgagaccatcctggccaacagggtgaaaccccatctctactaaaaaaaatataaaaattagccgggcgtggtggtggatgcctgtaatcccagctactcgggaagctgaggcaggagaattgcttgaacccaggagatggaggttgcagtgagctggcacggtgccactatactccaacctgggcgacagagtgagactctgtctcaaaataaataaataaataaataaataaataaaataaagagacaacccaatggaaacacagatggcccgctgcatccacggattaaaccaacgtcagatggaaaatattcagaaaacaaacaataaaaaaacagcaatgccacatttaaaaatatagtataacaactatttatacagtgtttacactgtattatataagtaatctagagatgatttaaagtatacggaggactgcagtcccagctacttaggaggctgagacaagaggatgccttgggcccagagttcaggaccagcctggctacatagcgacatctatctcaaaaataaagtatacaggaggatgtacgtaagttatatgcaaataccacaccatctcatatacgggactaagcacccatgagggttcctggaaccaatcgctcatgcatactgagagacaactatgctggcaagtgcatgggcaggtatgtcatagaagacaaaacataagtcaccagtaatcacatgaaagatcctgagttttcattagcaatcatggaaatgcaagttaaaaccacagcgaaataacgtttcacacctagcagattagccaaagtttgataaactaccaaaatcaattattaatgaagatatgttaggaagacatgttcttgtgcactgttggtaggactgtaaattggtaaaaccactttacaagatcaacagtcatttattttccaatgttgaagttgctcataccgcaagatgtaggatataccttgaagacatatgaaggtggttaagttcctaaataagggtagtgatatgaacacataaaggatgggcaaagtcaacagttacagggcaagaggaaggaagacagtcgagttaactgaagaatggtaaaaatgggtgggctggtttggtgggaaaagattatacttcgttttgggcattttgagtctccggcattaacaaaatactcacagacaggaattatgttatattacatgatctctaatgactcttgtagccctaaagctttgtgatcttatgatactatcagaaagggccaaattccacggctcactcaagtattttgctataattaacttcttttgtactctgtattcttgcacactcaaacaagctttttaacaacacgcccctctcaaaatgtctttatagtagggatgtttgatttttttcttggttcttcagctagacaatcagttcctgaaggggtatgaaagtgttgatcttctttcctcagagtgccttctactacaatacacaaagtaatttttccccctaaatggaacaaaggaagagttaactgttaagtacaatctaacagcaaagtcttcctaaagataaattttcagccagccttttggagatggaaaggaacttacttagcagagaagaggaaagtgatattattcttggtagaaagaacggtgcatcccaagggtatgaagactggaaagaggatattgctgatagatctggtacaccattaactggcactgcaggaccaaaggtgaaggaaaataggagtcctatttgacttatacttacccagttgattcttaaactcaagatgtttattttcttttactattgtagagtcaaaggcagtatactgggatgaagagaaaaacagtactattcagaaagctgtttggttttgatgaaaccttaaaaaagttaccggttggccaaaatgcaagagcgatggtctgaaacaaatcatgaagataatcaaaatggtaaccatttaaacctctgacacagcagactctgccaagagtagaaaaccaatactagcttgcccccactcacatacacgtttagcgtccctaatttcagcagtacgtgacattggttgctagcccagaagagatgcataagactctgaacctaaagtttccagtgatttggtccaaaaggatattttgataaaattccaaatggggaaggaaagacctagacatcggactcctataattttgaaaccttagcattaattatctccagtctggcgttaagacattggaaacctctgcatcattcccagatcatcactctagagtcccctacatttatcaatttatccctcccctctccacatacatgccaccaccatccatcaagtgagaagagcaacaagcttgtatttctcacagggattcatttcttaatgagatgcttacaaagcagatcatgctacaaaacacagacctttttctttaagagactcaaaaaaatgtaaagatgtatccaagcctagtacatgctttaaatttagagcaagtcccctgagcatactagataattccacaacgtagaaactaaaagtagttgcattttatgcataatgacacagatgtgttgctgacaagttgtcttaacaaaatatttatatattgactcacatttgaaatacgttaggagtagaatcttgggtaaaagcctctaaaaaggttgttgtatattagacattctcaaagtgcggcacccataccatagaattaaactccctgtttcagtcctgtgttttgaaacacatttttactattcctggaaacactttcacatttttgtcagacgttgagtgagcaacagggtaaataacttttcaaaagcatttttagagtagtaaaaccttaagttccttgctagaagggctgatccaaaataaattaaatgctggtatgactaagccaagtgtggcaaattctgatttgcagtgtggacacctccagttaatagatctattcagtgattcaacatgcacctccaagtcgtaagc

SEQ ID NO: 55 - DNA, 22189 bp, Homo sapiens
cctgcctaggttcaatccttgttacagaaaactctttagttgtaaagataatgtcccaatatgacccttttaagtttaattttacacgtgggctattaagggtatctattttatattaaatgccatactattttgagcaatcaccatggctttaacattttcaagacacagaaatattttcctttttttttttttttgagacagaatttcactcttgttgcccaggctggagtgcgatagtgcaatctcggctcactgcaacctccatctcacaggttccagtgattctcctgcctgagcctcctgagtaactcagattacaggtgcccaccaccacacccagctaattttttgtatttttagtagagacaggtttcaccatgttggccaggctgttctcaaacccctgacctcaggtgatccacctgcctcagcctctcaaagtgctgggattataggtgtgagccacccatcctactctcgcaagaactaagctaggaaggtgggcagatatttggcatctcgggtaactgaggcacaggggggttagccaacttttctaatatcacactagttacagacaaagccaggactagaatcctagccacccactgttttgaagtagaaaataatctccttcctcccactcctctacctggcaccaaaacatgtcaaaacccaacaaaataataagagaccataaaagatacattttcaaaccaagttgatgtagtcattttccattacagggtattttatggatgaaacagtgcttccagttctaatcaagtgacccaaatgcagagaagtcatgtaattttagaacactccagagctcagaggagggagaaaggatacagcacctgagattttcccggtctgggtttttgggggactggcactgcccatgcagttgttcagtgttgtttggaggtggatttagattgctggtggttgtaggtccagctttggggccaaagggcagggcaccagggtcccatggggccaggtttcagtgttcctgacgcctatcctgttcttccgaggggatggaccctcacttttcatgaagtactcagaaatgttccagacagagttatgtaaaaattaaagaccaattccagaaattcacagaatcatgttttgactacagtatgacaactacctaaaattccacaactatgaaaagctgaaagaaacacagaaagtttctgtgtttctcaatgaccacagatggctaaaaaaaagactgatctcacatccacacatcccccacacacaccccatcccaacacctatgtacgagggcaagccatcctcccgcaacacaggaagactagcatttttctcctctcttccaatacagatgaataagtagcccagacagacaaacgaaaagggaactttcttacatgcaatgtgagaacctggcccctctgaactgcatgctaaatcatactgtatgtttctacttaagcaccctgtggcggcttctttgaacaggatacggtcatggtactgggctaaagaaaccacaccactaataaaacgaatctctttgtttagatcatctcaggcatcaggaaatagaataaccccttctgcaagaagagaaagcactcgtttgcactgcctttttatgttctttaactccatgttgtctaattactcctaaggcatcttcccagctaatcggaattacaatatcaaggtaatctgtgcctccaataagcaaaacacaaacacttcaatgattaacaaatgatgctgttttgaatgagaatgaaaacttccaatgatttaaccactgctgtgaagaatacggagacagaatataatagaaaggtgtttatacctaggtcatgtttgtaacacaaatcattggacaaaatctctgtcagactcacaaaattcaaaagaccatggggattaattaatccaaccctctcattttacagatcaggaaatggagattcaaagcaggtaaatgtttattgtacagtcacagttaggaagtagcagaacctgcaaccaaaaaataaaaatgaaaaccaggtctctggactcccagacctcagaattttgcactaaaaaataccggggaaatatctaaaatgaagaggctggactaatgactacaattgagaacccggtaaaacagacaaatggaattaccaaagtgaagaacaaaaatagagccaataattatcaatagagcaataattaactaattagtagaaaggaaatgaggataccatcaatatttaaaacacagaaataactcccatctcctatagtcttcaaaggtgaaaaatatttccccataaaagctgctgtcaccaaagaaccaactttcccttcctttgatttacctcctgatacagagaagcactgcaatccagcaacatgatcaataacctctgaataatgaagaatcgtttatgtccagcagctaagatactctttacatagccaccccttccctcctttcaagggcaatagcctcgcaaacaggtgctcagtggttgcacatacacctcaaacctatcaagaaaagagagccgctctgtggccagacacaataccttctagtattgggtgatgagtgtaaggctaaccaagtatcagcatttcagaaagaggccagaggctttcaatcatccttgatattggtctaccatggcacagaattctctcccccaaaacacactcagtttcagtacattgcaatgttatgttatgtccatgattagtttgataagaaaaaaaagatttacatataaaaaatatcaaacagggaagaaatgccctaaaagattaatttaaaaaaaaatactttccccaatgtgataggtttttaaaaaatggtacagacgtgttttttcattttttgactggtagtaacactacagagtttttggtgtttgtggccttaatttttttttcagggaattatatatacactttacctatttttctagtaggctgtgttttaccaattggtttgttcttggaagtatcaagaacatgtacaaaattgactaattttcacctccaataaaagccactcaaaaactgatattttgaagcaggctagcaaatcttcagtctcttttatattgcaaatgattattgtaaacccttagtataatattagagcaaggaagaacgcaaatacaatgtgaactcaggaattcacatctttgcacaacccaacatgtgtaataatactactttcaacatactaaaataattttctataatttaggcaaactctataagaaaaatgagactaaagggtttaaaacaagcaggtacaaaggaagcaactgttggtaaggtatagaaagattaatttttaattaaatgattaggagaaaaacagcacacacacacacagatactccaataaatacagtcccagaaatgctggagaagcctcaaagggacaaccagtccccaacttacgatggatccacctacaattcttcaactctatgatggtatgaaaacggtacacattcagtacactcctcaacttacaatggagtccaagataaacccataatacattgaagatactgtaaatcaaaaatgtacttttgatattttcaacatacgaaggatttatagggacagacccccactgtaagttaaagaacatctgtaaatccaaaggcatctattaacagcctacgtgtgtgctaggtggtacataatatatagatacagcaagggtgagtccacctgctcatcactacgtgaatacaagcatgcccaaggcatacagtatctcactggttttccttttttttttttttcttaacgtaagctccttttatttgaacctctattttcctctccctccctccatcccattcttgccactcatactgaagttttcatccatcagagaaaaaaaaatcttcatatggcctactatcactacaaatgatgacagcagtactaagaaggatagtgagcacttgtacagcacttggtatatgcccagtatgcactaagtgctctgcattcagtatctttttaactcttcataataaccccatgtcattggtactgttttcatctcgattttacagatgaggaatctgaggtgaattgagaggtaatagctcagggtctaatagttagtaggtagaacaaggatttaaactatgtctacttgtaatacattatttatatggcaatttgcttcactaataggatcgatccctctataatggatcctattagaatggaaaatgatgggcctagagatattttcacataaaatatggcttctatagaatgtattaataatgactatcaaacacccatttggaccataggtgttatgggatggaggaggacaggaaggaaataagaaatttagtccctgccctattgctctgagaagtatctgggaagccaggcatttcctggtctagataggattatgtttcaacattggctaggacctccagatttcacacacatccacccacatgtggacagcatgagaataataaccaggtaacctgtacagctaatcaaaatgttcttgctatcagagaacaccagtagatgcatgagtcatggacagaaggtggcaaggctttgtggatgaaagaaaagctatgaaatactaccacactgacctcttctatactggatggcacagtgccctggaaaaataaatcaccacacgagcatgaaatcaggattgggaaaatacacaggaaatacaagaagaatatccctatcagatccttttaaagatctgcctaaccggacagttcagtgctgatgtgagtaactcctttcaagtttacaatatactagctgaaagtttttagaaccagggttccaaatacattaataaagatttgtacaggtgtgtagggaagttaataataaattaacagtgaacttcacactgaaataataacttctttgcagtaaatagctacacatattaaaaaattaaaactgatgaaaaataaaattagagttcctctctcctccctttctcactatctctcaaagtgacaggccatacaattaaaggctgtttctttgcaaagtccatgctttgcagttctaatcactcgagtgatttatagaggaaatgatgttttgcaggtactctaaaacagagctgcactttgtccagtgtgcaaggccatgcttaatgaaaaactttaaatttggaaggaaaaaaactgcagtaaaaagagaagaattatgaaattttagtatttacttgatttattaatgtttccttgtgcatttctttttataatttgtgtcctggctaaggcaggaaggcaaaacaaatgtccttttgtttatggctttaaaaaggtcataagaataacaaaaggatacataaatactgatgactatatctttccctatttcactgtacattaatttaacagtctgctactgaaatactgctgttggttaagcacagagttaactatttaaaaatattcttgtctttttaacccaatttctttcaaggatataattaatccagttaagaccgttcttaaaatatgtgcaggtcatgatagaaatgtcacttgtcaactctctgatgcatttcagatctgctctgccactatagagttccagacagacaggaaacattgtaaatcactgaagaaacatacaagttaagaactgtgattttgttacttaaaattactgaaaaatagacaaaattcaagcatatatcaggagcgtaaatgtagaaatctgtaagcatttacccagaaaggtgcagatcattaaactaataaagctaactcatattcagtgcccaaggatatatcaaattttgtaaaaacaactttaagtcaccggaggcaaggagagctccaagttagcacaaagaatgttgatttcaccggggtgtggtgactggggataggcacacctggcaaaactccattctgtgggctactaaatctctgtatttgttaggttgtgctatattgtgtatttcggttctgccacccaaagaaggtatccaaaataacttgtggtgggcgtggaggaatcacatattaaaagtcccaaagtctgtgcctccttcatgcttgtgcagctgtcttccagtgtcactgccttgtagactgcacaatcatggtgtgattctagatagctcagctccaccacagaaataaaggggataaaatgaacagttggcgagatactgagactgcagtttgaacctctataggactaatgcttttaggttgttctttattttgttgctttgctttcttttgccaacagcagcgggggcttagctcttattcaaccatatactttttaaaatctctactcagtggtactgatagaaaacattttcaagattccactgaaaaagaccagagctttgtaagggtagtggagttctctaggtggaaaaataacttcctcgcctaatagggattggacaccaccacccacatcttggtctcaatagcaccaaactttaaattgccaatctagccaggcccttatgctaaggccgaagtgagtcttaccttcagtgtagaagctgaaaagcaggtaggtgtctctgattcagtctagcctgaccacatgcactttttggtctaatcttaaaatacttaaatgtctaacaactacttctgtttcccagctattctctcctaatatttatgatatatcttggctatttgacagtagatttgagtcatatagttaagtcatatagttaagtcaactatttgagtcatatagttaagctatcaactttctatagacatagtttgccttatactataacatacattcttcaaccttacactatacagcaaagtatttattattgtttctatcaaaataatatcttacattcctgtaatttcttatagttgctaagtactctttagatgttttttcccatttatatctcacaacatcctggtgaggtagctgatattatcctcatttttccggatcagaaaattgaagaaagcataaatcccttgttcaaggtcatagagctagttagagaacttggcagaatatgaaaccaatttgtttaattctaattacagtgttatgtccacaatacctctccctcaatcaaaataaaaacgtttcaaccaaaataagatgccacagcagttttttaaagaaattaataaatttatataaaaacccatatacagtttagcacaaaataatatttcaaatttaagtatcttcaattatccttgcaataatccactatcaaaagccattgcttaaactaatcccccctttaagtatactaaacaacgtgctactgtgtgtatttgtgtatccgtgagtgagtgtgtgcatgcttgcctgagctcatttaaagggatacctttatcctgaggtttaaaaacagtgaggtctgaattttcattgttaaaagcagatcatggagcaatcaatcagctaataaccatctattaatatctgatgtactatgcaacatgacagagtaaatgaaaataagaataagatgcatttcctacatttgagtttctataatctagcgagaggacaaggaaacaacacatctaccacatcatcatcatcatcatcatcatcatcatcatattagcaatgacattaatgccgacattcattcactacatacttctcacattttaggccagcactggccaacagaaatataatgtgagccacatatgtaatttttaattttccagtagccaaattaaaaaaggtaaaaagaaacagataaagatgaattttatttaacacatatatctagaatgttttatgcacatgttaataaaaaattatccagatattttacatactttttcatattaaagtctccaaaatccaacgcagtcaatgaattacataacaacggggaaacattctgagaaatgtaccattgcatgaacattacagtatacttgcacaaacctaggtagtagagccaactacatacctaggatatatgatatagtcttatggtgcctaggttgcaacctgtacagcatgttactgtactgaatactgtaggcaactgtcgcactattgtaagtatttgtgtatctacacagaaaaggtacagtgaaaatatggtatcttatgggactaccattgtgtatggtcccttgctgacccacatgtcattatgcagcacatgactatattttacacttatggcatatcacaattcaaatgtaaattttcatcagaaatacttgatctgttttagatttcataaaactgatcattgaaaaagtaaattcatgtacccaacctgtaccaaatatacttaaaagttttctcataacgaaattgagtatccaaaaaatcattttcctttaattttcacaagtacattgacaaaactggttcacttttgtttaaaagaactgatttgggccaggcgtggtggctccttcctataattccagcactttgggaagccaaaccaaagccaaagtatggcttgaggccaagagctcaaggcctccctgggcaacatagtgagaccccatctctacaaaagatttttaaaataatatttttttaattagctgggtgtgtcccagctgctcaggaggctgacacaggaagattgcttgtagtccagaaggtcaaggctgcagtgtgccatgatcacaccactgcactcaacctgggtgacagaatgagaccatgtaccaaaaaaaacaaagaaaatgtttgttattttaaagtaaactgggcatggtgaggcaggcctgtagtcctagctacttggaaagctgggacaggagaattgcctgagcccaagagttcaagactgcagtgaactatgaccaggccactacattctagcctgggtgacagagtgagacttcatttcaaacaaaaaaaaaaaaaaaaaagaaagaaaaactgatttgactttgaagtataagcatatcagtttcaaatccatatcggttcaagttaagtaagctaattaactcttgtgtcaagtcagtattaacactggattcaaaggaatatttgcataaattggaaaacaactctaaatttatcagtatcaacaaagagctcttcaaattctagtttttgtagccaatatatataatggtatttataattaaaatcttctgcacattaatcattactattgacttatattatgaaaaccttcaatttcaacatgaattctaatatctgcctagctagttgacaaattaccttgtcctttcctgagactttcaaattagttcattcaaaagtagtgtgatctgagtcagaaaacataaaccatactgctatattcccttttttttttttttttttggatggagttttgctcttgttgcccaggctggagtgcaatggcacgatcttggctcactgcaacctctgcctccccggttcaagtgattctcctgcctcagcctcccgagtagctgggattacaggcatgcgtcaccatacccggctaattttgtattttttagtagagacagggtttctccatgttggtcaggctggtctcaaactcccgacctcaggtgatccacccactttggcttcccaaagtgctgggattgcaggtgtgagccaccgcgcccggcccatattccctttttaagtactgaatacttgggcaagtgcccctttttgtttcaacaaaagatcatctttggttggagtaaatattatgctatagaaatctgtgtaaaactcgtccaggactccaccaacaagtgctgctaaagatcacaaggtcactgccttcactgtcttccatttctttctgcaggtccataaaccagcaatgatctatgaatttacacttatagactggataattttaactactagtatgtgtcacactttttgccaagttaactactgtattgtactctgtccagcttcagaatacagtcgaatgaagcaataagagaaataccagcctcttgaaaaattccaataaatacagaattcggtctaagagagctgggtcaactgtaatagaaattaattttttcatatccatctgaaattctttgaaacagtcaaatgtttgaattgaatgttcttaaaacattcaaaaatatctctgccacaaatctgttatttttggcaaaaaaaattacaacatttatttataaatcttaaagtctgtattaatcggacaatggatcatcatactgtataacttacacaaagctaaaggaaagtaattgaaatgtttcaaatttcaaatgggtcatgtagtctataggcaactgtttagtgaaaaatatctttaagtttttgtgaaatatatttttgtctcttctcataattttctaataaaattttggtacctgcaataattccttctgccatctctccatcttaaactggcttcctctatagtgcatgaatccaagacactgtataggtggccaaagttacaggctcatactctgttaaaatttttaaacttaatgaacatttgatatagtttagatttctgtccctccaaatctcatgttgaaatgtgatcctcaatgttgaaggtgcggtctagtgggaggtgtttgagacagggggacagatccctcatgaatgagtgttactgccatgctaacatctgcagaactgagagccaaataagcctcttttctttataagttacacggtctcaggtattcctttacagtaatgcaaaacggactaataaaacactaaattctgctttcaggcaattacttccatcaattcttcattgacctttgagaaaaaacttctcatcaaatctaccacagatttcttgaaaatgtcttaatattgcccatttcattttctttacattttttatacaattgcaaatgagattcatcatgaagtccctagtctctttgtgttcccactgctttgatcatactactaatttctgtatctgtactcactccgcaacagtagtatgccttcacttcaaatttaaaaactgtccatatttatttactaacaagtgatgtagttaccttaattttatatatcacttaaacatttctgggggatgagggataaaaatctacatgtcaggtaccatgtacactacttgggtgacaggtacactgaaatctcagattttaccaccatacaattcacccacgtaaccaagaacttcttgtaccccaaaagctattgaaataaaaaatttaaaacaaacatttcaatttaattactaatgataatgtacttgcatcactataagctgcactgtctgcacaaaatatttaataaatactataaagtgagaacacagaaaaagtatatactgaataaattatttgacaccagcaagattggtagtgtgtttatgtatgctaatgtagtcttaccaaaacaagaaaactgtgtttaacagaaatatatcgtgcactgcttccatcttaaaaatccagttcctcgggtacgctagtcacactgaactgctcgacagacacatgtggcttatagctattgttcctgatcatacgatgagaggctgtgttcatggcagtctgtatttattaattgtggtaattctcacaaggaagagaagtctttactctaattatccccacattacagacaatggaatttaggcaaaagtaattaagtgacttacccaaagtcacaaagctattaactggggaactgggatttcaacccagacagtctgactccagagactcttatccactattccacaccgccagaagttcaacaacagcacagggtttcatgagagatgaggcaagagatgcagagtgtgttaaaaatatatatataaaccaaactactttgcaatgaaaagaaggaagccagaactcacaggaagacgtcgtgaaagagggagaaagacttgagctgcgtagtccaagataaatgctgcagataaacagcccaggcagctgagcgcaggaggagtaggtgtgcgaagcgcgagcaaagtgtgtttagccatgaacaggtaaagtgagtcagctgtggagttaatgcagcaggctaaaaaatggcccccaaaagacacagccacatcctcaccactgaaatctgtgactgatacctcatattagaaaatcatctttgcagatgtgatgaagttaaggaccttgcgttggggagactggagattatcgtggattatctgggtgaactctgagcataatcgcgagagtccttataagaaacaggcagtgggagatttcacccagtcagaagacgaggccacgagaccacagaagcagagattagggccatgtgccccaagtcaagggattccagcagccactagaagttagaagaagaaagcaaggaattctcctcttgaagcctccaaagggaacatggcctttctgacatacaccttgattttggacatccagaactgtgagaagacagctgtgttgtttaggccactcagtctgtttcaaaagccataggaaactaatacagcttagaacctctcaaaacctgcaacatgcaaagcgaccttgtgaatcagcaagaggtcaatctagcaagcagtcgttcccagtctatttaatgagagaatacccatttcccagaaagagagagctggtggtgaaagcatgcaccttttagcatctggcatacctaacattcctctaacaaagtttgggaattcctaacccaagtcacattctggaaggcaatttaatcaagtaagtctgaactttattcaaacaatgcaaaaacgatcgaaggtttttaagaaatgttgcaagaagtcaaccatttggggtgaggaaatccaggaccctgtgaccctggattcagggtagcttcaaagtagcagaatgcattgctttggaagataaaacatgtcagcagctgagccagccctcccagctgacagcagtgaactctgccctgatggaaccacctcctctgggaagtgctcctgtcatgagggatgctgacaaactaaagtggcttcacagtgtgacgagtgagaaatgacataaaagaatgaaagaagtgttgtgctagagagcaatattcaaatgggaaacaaaatagcagtaccttcaagtaaacgaaaggctaaaatatattgttaataacaaaaaatgagctacaaacggttcaataaaagtcaaaggtgaaaccatcaaggggagtgggatcaggtcaacaggaagctgcccatgggcatctgcagtaagaagcacctggccagtatggatcttcctgtggagacaagttatcaggctgccacaggagaagaaaacccacactgcataggaagctggacctcaaaactgaccagcttccacaagtctaagatttcatgacctaaactggacacaggcctgtttatcatacgcacatgtagagctggaataaaaactgaatttcaaaaatattgtgtgaaactaggggtgaaattcaaaatattgaataacctgcgtagcacaggcactgacccaccagaacgtatcccagcttatgtgcctacaggtaggtgcccacctcctgaatttcagccttcataaaaccgtgaacgctgacggagagttggaaacagattctgaacaggcagggatgaagaggggaggggaagaaactactgccgtttaaaaacttcacttgaactgacagcaggtcccccattttgggaagccacaggatgtcaaggaaaggtgaccaggtaggctggaagccacattctaaatacagcatctctgaccacaaacggccggcagccacacactgtggccctgccatctccaaggccactgactcagcacggctgcgacctaacgacacactgggaagtctgggtttggttttggttgtgcgtgctctctctctctctctctctctctcttctctttcttctcccccacaacactcctcctcccacctacactcccccttctctccgaccccgctcctatagcatacattttggttccactggttgccggcttatccatttggcggtaactgtctggtaggttaatgcccaacaataggcacttgtattttcttatacgggggaggtaaattatggcacttgaacaaagaccttactatttaagttttactgcacgtttactacaagccagtttcaattttacgtttttgtccctaggccataagagaaaaaagagcaggttcctgttcatattcgaaggagctgtttaaataacaataacaacaatacctggcaaaagcgggatctgttataggtcgaattctgtccccctgaaaatgtatatgctgaagccctaacctccaggacctgggaatgggatgttagttggagatacggttggtgcagatgtaattagttaagattaggtcatactaaagtaggtggcccctaatccaatatgagtggtgtccttatttaaaaaaaaagaaagaaaagaaaatctggacacaggcaacacccagcaagaatgtcacaggatgatgaagtggaatggtgtttctacaagccaaggaacaccaaatattgccagaaaaccaccagcggcaaggtaaggggcctggaacagatccttccctcacagccctcagaaggaaccaaccctgacaacaccttgatcatggacttccagcctccagagctatgagacaataagtttcagttgcttgaaccacccagtctgtggtactttgttatggcagccctagtggactaacacaagaccaaaagaatcaggagagtggcaactgaaaggtcaggcaaggtggccgggcaagtttggaggaaagagtttccactctttgcacctctagttaactgtcaggaagcccccagactcgcctgcctgtcacactggctttctctggggtccatcatccatcgctcctgagcttggcataagctgctggtccttcctcaactcttccagctgcccctgtccctcacacactcattcagtggaactcacaattctaaatgccgattcaaccaccactttctcagaaatgcatcctgatccctccagcctgcatcagaccccactgtttcccactggtctgtagggtctacaaggacaggaccatgactgcattgctcaacatgatgttgctggttggctggaatacatatttgctccataaattaaaattcattgtccttgggttactaatctcacaggtcctatggctccagcagacacgccaatgccctgatgatgtctacaacttttatagcaaacctgtatcaccagcttggcctctttgtcttaaaacatgagatacccctgggctctggtctcccacattgtcaattgaggggcactactgaccctttctctgcagagccacacgggctctcctttcccctacagaacttctcagacttaaccactgccatccactcccatccccatcatctgggcagtgtccatggtcttcctgccccagcatccaggtgggagcacccacacaccaggataaactgactgtgctactctttacttaaaaatcagcttgatttccattgcctattctaaagtaattttttttaaaagcagaaatcaaatctatgcaagggattaccacagaactgtctggtttctgggtggggaagctgtgaatggctgtgggagaggcaaggcgcctcccaagcagtggcctcccactaccctttgtgtcacactcccaccccacctcttagcaaatcttgaggcattccaggtaactcagggctcctcacaacagtgtagaaatcacaggtccctctggttaaatccagcctttttagtaaaggaatcaaggctcttcatttaactatcacctccattgtcaaaagcataaccaaataaaaacaaacatcttcacgtgaacattccatatcttggctccaattcttccctcccatattcattcattcattcattcatcagaaatctgctgttttaggaagtggtccaaggttacagagatgccttgccttcaaaaaacagcaatgcagtaaataagacagttgtgtccattgacatatgtaaaaacagtaataataaaaataacaggcaatatttaccacaggcagcactggaagtattctatgtgcattagccttctgaacaaccctttagggagggtcccataattatcccaattttaaggatgaggaaataaagagtcttgaggaggtcaggtcaggtcaccagctagaaagagggcaaaggaagattacaaaccatacgttctatgctattttaggtgatcccagtcaggtgtggtcacaagaggccacacagtagaggctcaggaatcagctgattgtcctcagtgatcctagagacaggaggcccgccatgcaggccacactggaacgcctcaggctggtgagaggcagagtgggcaggaggaggagagaactaggccacagtctttaatggacttccaggaaaaacaaggcggggcagggtgaacaggttaggagtggctaagttgaataatttcagcaggctttgggctacagaggtggtctctagttgcctggcacctagccttgaatgatgtaagcaagggaatactgcttcctgaagtgtaagggccagatagaggaggtctgggtatggactagttggtttgtatctcaaaggcatgctcctggctaggccctggctccctctcagaactggctagacctgcaagggcagcctcttcccaaccacaatggtttctaagatgtcaaaacatcataatatatagaaaataaaaaccgtaaataatacaccagactacctgacttcaagccttcagcaactgtgcctgctacatccccagcatagtgactgcacaaagtaaggccaggtaggagacacaatgaaggcctctggaaggtgagaaaaagatccacaaaggcagcactcaaagcacatcaacaataaaggaaacatagaagcttccacgaggataagaataaaagaaggactttccaagcaaagggactgggcaataaaaaggcaacctggccagtccagttggctgctgtgccttgatgtctctggggccagggtcctgggacagcactaaagatgaggatggagacgcaggcctgggcaagaatccctaattttcaattaggtgtatgataacaggtagtatgaatagatttcaagggtttattaagcactaagtatagtgtaagctcacatataacagaaacatttagtacccaaaacaccaaacgtatctaagaagccttaaatatcaaatttttagaccgggcacggtggctcatgcctgtaatcccagcactttgggaggctgaggcaggtggattacctgaggtcaggagttcgagaccatcctggccaacagggtgaaaccccatctctactaaaaaaaatataaaaattagccgggcgtggtggtggatgcctgtaatcccagctactcgggaagctgaggcaggagaattgcttgaacccaggagatggaggttgcagtgagctggcacggtgccactatactccaacctgggcgacagagtgagactctgtctcaaaataaataaataaataaataaataaataaaataaagagacaacccaatggaaacacagatggcccgctgcatccacggattaaaccaacgtcagatggaaaatattcagaaaacaaacaataaaaaaacagcaatgccacatttaaaaatatagtataacaactatttatacagtgtttacactgtattatataagtaatctagagatgatttaaagtatacggaggactgcagtcccagctacttaggaggctgagacaagaggatgccttgggcccagagttcaggaccagcctggctacatagcgacatctatctcaaaaataaagtatacaggaggatgtacgtaagttatatgcaaataccacaccatctcatatacgggactaagcacccatgagggttcctggaaccaatcgctcatgcatactgagagacaactatgctggcaagtgcatgggcaggtatgtcatagaagacaaaacataagtcaccagtaatcacatgaaagatcctgagttttcattagcaatcatggaaatgcaagttaaaaccacagcgaaataacgtttcacacctagcagattagccaaagtttgataaactaccaaaatcaattattaatgaagatatgttaggaagacatgttcttgtgcactgttggtaggactgtaaattggtaaaaccactttacaagatcaacagtcatttattttccaatgttgaagttgctcataccgcaagatgtaggatataccttgaagacatatgaaggtggttaagttcctaaataagggtagtgatatgaacacataaaggatgggcaaagtcaacagttacagggcaagaggaaggaagacagtcgagttaactgaagaatggtaaaaatgggtgggctggtttggtgggaaaagattatacttcgttttgggcattttgagtctccggcattaacaaaatactcacagacaggaattatgttatattacatgatctctaatgactcttgtagccctaaagctttgtgatcttatgatactatcagaaagggccaaattccacggctcactcaagtattttgctataattaacttcttttgtactctgtattcttgcacactcaaacaagctttttaacaacacgcccctctcaaaatgtctttatagtagggatgtttgatttttttcttggttcttcagctagacaatcagttcctgaaggggtatgaaagtgttgatcttctttcctcagagtgccttctactacaatacacaaagtaatttttccccctaaatggaacaaaggaagagttaactgttaagtacaatctaacagcaaagtcttcctaaagataaattttcagccagccttttggagatggaaaggaacttacttagcagagaagaggaaagtgatattattcttggtagaaagaacggtgcatcccaagggtatgaagactggaaagaggatattgctgatagatctggtacaccattaactggcactgcaggaccaaaggtgaaggaaaataggagtcctatttgacttatacttacccagttgattcttaaactcaagatgtttattttcttttactattgtagagtcaaaggcagtatactgggatgaagagaaaaacagtactattcagaaagctgtttggttttgatgaaaccttaaaaaagttaccggttggccaaaatgcaagagcgatggtctgaaacaaatcatgaagataatcaaaatggtaaccatttaaacctctgacacagcagactctgccaagagtagaaaaccaatactagcttgcccccactcacatacacgtttagcgtccctaatttcagcagtacgtgacattggttgctagcccagaagagatgcataagactctgaacctaaagtttccagtgatttggtccaaaaggatattttgataaaattccaaatggggaaggaaagacctagacatcggactcctataattttgaaaccttagcattaattatctccagtctggcgttaagacattggaaacctctgcatcattcccagatcatcactctagagtcccctacatttatcaatttatccctcccctctccacatacatgccaccaccatccatcaagtgagaagagcaacaagcttgtatttctcacagggattcatttcttaatgagatgcttacaaagcagatcatgctacaaaacacagacctttttctttaagagactcaaaaaaatgtaaagatgtatccaagcctagtacatgctttaaatttagagcaagtcccctgagcatactagataattccacaacgtagaaactaaaagtagttgcattttatgcataatgacacagatgtgttgctgacaagttgtcttaacaaaatatttatatattgactcacatttgaaatacgttaggagtagaatcttgggtaaaagcctctaaaaaggttgttgtatattagacattctcaaagtgcggcacccataccatagaattaaactccctgtttcagtcctgtgttttgaaacacatttttactattcctggaaacactttcacatttttgtcagacgttgagtgagcaacagggtaaataacttttcaaaagcatttttagagtagtaaaaccttaagttccttgctagaagggctgatccaaaataaattaaatgctggtatgactaagccaagtgtggcaaattctgatttgcagtgtggacacctccagttaatagatctattcagtgattcaacatgcacctccaagtcgtaagccgggcagcaaagtataaatatgagacttacaagcattctctgatctctgagtttgtattcacatctatcaagtttttgtttgtttgtttgtttttgttttttttgagatggagtttacctcttgtcgcccaggctggagtgcaatggtgtgatctctgctcactgaaaccttcacgtcctgggttcaagctattctcctgcctcagcctctcaagtagctgggattacaggcatgcaccaccacgcctggctaattttgtattattagtagagcaggtgtttcaccatgttggccaggctggtctccaactcctgacctcaggtgatccgcccgccttggcctcccaaagtgctgggattacaggcatgaaccaccacgtccggcctgaagttagtcttgatggaaggttctcaaagacctattattacatcctgtgtattatatcagctttgtcaaagaggtgaagtttaggaagctgtgtttcataaaaaccccaaatctgagtaagtctatgggagcaccattcacggacatgcagcaatacggtagaacacgtgagaaactgctcatctggactgcactgtaacacaagcaccctaccctagaggtacaacatgcaggtaccgctgatacagcaggcttccacagcatggttacgaatcatcacatcagacatggagagcacctgagggatcacctaatataactgcttcaccaatgaggaaagcaagaccttgatgacataaaatacggaaaagaataaaaatagacgcacataacatttcttctgcttgctcaaagttatccccgacaatttaagatgattaagggctttatcttggaatgcttagctcacagaaaaaaaaggtaggcaactatatattcttattaattggaaaaatcattgaacagccagtggtttgatttgaagagagcatcagttttgttgatttcattaaaatgaatgtaaagagaacaaggtgtattgactttttatttttttagccacaccaccagcaaatactgcatcacttacatgtgtgtttccttctgtctggaaatcctgggtggacaatttaactgccacagaactcccatgaacaggcacacacaataaacacgcacataaggattatgtgaggcgtctaccacagaatggctttttcagccacctgaacctaggtccattaaaagaaactaggcagcgtggagcagagcagctgtcccaacacaggcagtaatggagctgacaatattcccacgccagttctgaatccagtctattttatgctcttgcgtggattcaaggaaacagaactactatttaaaagtgcatttacaaagagggctttaaaaagcgttagaataaattactttgaagtgtatttctacaacacgcctccagctttcccttcttttcctatttgctcgtccccagaacccaacggtgactatatttaactgactttacaagctgtggggagactgagtacacacagcagattccagccaggattgtgtgcattaactaagtcccaaggttttttgcttgggagctttctctttctttttttcatcttcttcacatgtcttaaaattaccttatatcctggaaataacagaaaaattttaaaagaccctctattttggtttgctgtataggttgagtcctgatatttttaatcatattaacaatatgctcaaggcaaacactgccacgacccagtattcttacagtttgtaagtattttattatttccttgaaaaaacactcattccatctagtacgtattgtgagagaagatcaagtacttgtaaaataattttcatttaggaacaggtatataca

SEQ ID NO: 56 - DNA, 25851 bp, Homo sapiens
gcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttgaatgctggtcaggtatcctagtcatctttcacaatgtcgatcatatgggaaaatatgtttctagttctgacaactgaattacatgtacacctttggaacataatctgtttttaggttgagaactacctgtgtattcatcaagtactgaagttcccagtgttcaagaaatgccctatgctattaacagagaattaacaggtttctctaaagaacaaaactaagcttagtatggcctggtattaatccctgtctagaagtttcacaatcaaaagggcaaaatgtggaaaagcaaagataaataagtaaaattggaaaatacgcaaagccgttagagatgtaccagtggctcagaagtaggtaataatgagaaatgcacccaacctctgtgactgtgaaacatgccacccaagctttgggtttttgaaatctgtctctggcacttgaatctccttgtcagtggcaaactggagagctttccatacttctgtgcaaaggaaagcataccccagagcaaaaacaaaataaaatgctacttaatattcaatgtggtgtcctttgaatttaaaagttgtagtgatactattatagcagaattaacattattgtcatattagcattggaactttcccatttatttttggcttggtgaatttgaaagtgttgtttaacagaaaagattttaaaaggttagatgcaatagcatttattttgcacagtttgatggattgccagcagcagggaaaactacaactcagatcgtttcaacaactttctgttcttggatttttcctttctcaccaatttttctttcagagcaataatcattttactgtatatgaaagagatacctaaatatcaggtatctagttaggtgctaatgaactcctcctgcccattttttaattgtttgctttatcatagctctaagtagtcgtgctaatcttttagggggagggttaaggaaagattttacttaattttgggatttactttgtcttttacagagcttgatatgtggcttaacagtaagtaggattatagcaagttgttattttagagaaagtaaacgttatctcattatattcttttttaacataatgagaatctttatggaagaatttgcgacagctcaagaacattttttaaaatttaattttaagttccaggatacatgggcagggtgtgcagagtcgttacatagataaacatgtaccatggtggtttgctgcaccgattaacccatcaccaagtattaaaccccacatgcattagctatttatcctgatgctctctgtccttccacacctccctgataggccccagtgtgtgttgttcccctccctgtgtccatgtaagaacagttctttttaaaggttagtacttggattgttttattgttgtactgtttaagcagctttgttgagaaagagtaaattaaagcttttatcaatttttttttttttaacagcaaatctgtactctccttttttttttttttggtggcccaggctggagtgcagtggcgtgatcttgtctcactgcaacatttgcctcctgggttcaagtgattctcctgcctgagcctcctgagtagctgggactgcaagtgtgtgccaccacgcccagctaatttttgtaattttaatagagacagggtttcaccatgttggccaagctggtcttgaattcctgatctccagtgacccgcctgccctcctcggcctcccaaagtgctgggattacaggtgcaagccaccgagcctggcctgcactctcacttctagttatcaatgttaaatttatcatttgtcactaaataattatgatattcataattaccaaagccttttaaaactgcatttttataatttttgctacttgctgatagaagaccttttgacttaaatatctaagttttagattgacattagttttgatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctttctgtagctctgagtttatatgcatatctaatgaaatgattgaaaaccctactctggcaacacaggagttgggctggcgataaaaggtgggggaaaagcaggagtacttaggatgtgggagaggaaatgatacaaatatgatagactgttaattcctgggaaaaataccagaaacagctgatctgattttcagaagtaatcataaaaatagatagcatttattgaatgttgcaaggcctttgctaagtacttaatattgttacctcattttaccctgtatatcagagatattaatgagctggctaatttatatacctgtagaatgtgtaatgaacactcattagcattatagatatgttagttttaaagtgtatctgtgtccttttaaaatatttccttttaactcttaaattgaaaagtctagggaataatcctaatcaagaaggagttgcaggaaactattgtaaatccaggttgtaaagagaaaataaattggttggtgagaactgtcaccttttccataagataatttaagcacaaatgattacaacaatttacgttttttattgtggccaatatagttgacttggtttaaatcagacaggagaaaagaggaaaatttttattgattaaccaggccctgaattttctgtcttaggaggaggaaattatgtagttaaattgtatgattcctgtcaaaagaacaatgaacttttgagcagattggctgagcagagagaatacaaagcagggctaatgattgtcttcatcaaagagaacttcttgggataagcagatttctatgcttttataagatagatttttttgggggcagtgagaatataaaaacaaattcgggaatgagaggttaatcgataaagaacctgagttgtgttttagtcatggaaacagtggcttttttttttttcagttttgtttttgataaaaagtatcctaaatataaaggaggtatatttccaggtaggactgtgctatgtaactcagtagtctctaaactgattttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactctatctctacaaaaaataaaaaaactagccaggcatggtggcgtgcacctgtagtcctagctgcttgggagactgaggcatgaggatcccttgagcccaggaagtcaaggctgcagtgagctatgatagcactactgcactccagccttggtgacagagcaagaccctgtctcaaaaaacaaatatttttcatccttggaaaaataaaacctaaaataagaagagcagcacaatatttttcttttttttgaagtagcagggctgaccaaagccatttctagccaaataaattatttattaatcaatatcgttaccacattctctatgtggaaaaagtattcaaatcttgaggcctatgttttttcaaacttgagagtcatacagttgccagcttttttttttttttttaagtagtagacaaattgtaagaactacaaaactgaaaattaccttctgtttttcttccccataagctgctgttgaagtgaagtgagctcagggagacaggcctgttgttatcttcctatggcactgatttacacttttacagaagggaaatttatggcccttatctgttgaggacttttatgaatgactggtataaatcaagaattgaatgaatatttttccctttaagcataaatctgtgattgggagattgatttctgagtaactctttggtaacccatttaaattgtcatcttccaattttctgtattttggcataaactgaataactaaaatataacttaataccagcatgatagatttgtttttcttctgttagatactttagaattcatctagacttctcacagacctcgataaataactcagcagtcagaatggaaaacaaatttatatagtggaaatctcattaatgggaatgaacaatacaactgtattcaaggtttaggcaggagaaggaaaatgatagaaatgtatttgtttaattttaaagattcttatgataaaatgatcattaattagggaagataagtagaaaaagacagtcctttctgggacatttgaagactaacagccttttattgaaagtcctggaaaagtatgtgtaaaaagccagccatgatgatcttttacctacacttccttaggagactttccctcagcaagatgtgtctttctaaaaacaaaagataagagacaataggagcccacataggatggaaagctagaaatcaggtgggttaaaaataatttcatctacactatcttccccttctcaaaagatttttaatctgtaaatggcaacttatacatggaaggattataaaatacataaaattactttttatttgtcttctcagatatatggcgtgttctttatcttccccttgttccaagtaattttgttaagcagtaaacaacgtggaagacaggttggtcaggagataagcagttgattccgtgttttttgaagagaacttttatgatagtaggaagaggagggcagtgctggtcctgtagtgcagtcgtgtagtactgtttgctgtgggacaagaggaaggaacagactggcaggaagggactgcagcatggaagggtgctaagtgcgtcactgagtgataagggtgctaagtgcaggaaggcccactggatgggcagggtgagagtgggttcaggttgtaggtgtggagttggacaggctggccttgttctagcagcaccatttactagctgtgccaccctaggcaagtcaccttctctgctcctcatttcccttctctctaaatggtgataataagagaagctaccctctgaagttgttaggattaactgagctgatacatagatgtaaaacccataggacagtacctagcacgttgcatccaacaagtgtcagcaaaatattagcctagccagtcacctgtggccattatcaacatctgtctccagttagtcaccacctttggtcaattctgcatttgaatatttcttaaagatgatttatcttctctgccctcatggccatagccttagtgtacagactttttaactctcaaataaattaattccgtttattcttttagtcaaattttactaaaatccattgtgcagaaaatgacctgttaattttctaaaatgcagatcttgccctgccactctgcttaaatccctgtcatggttttctgtcatccttaaggaatttataattaactttcagcattaaaggcatgcagagttcttcaaaagttagctcttgcttgccttccaacctcatctctcatcagatactttatgaacatcatatattctaattcttactatacctttccaaaaggcagtcctcattttgcacagtgatgcaggactgtaacagtgatggttcaagctgaactacacacaacaatcttaataacagtgggagcaactccagtattcccatgacctttgaatgtttttgttaaaacattaaaaattctctgtcagtgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgttagtgtctcttagatgtcgttagtgtctcttagatgtcgttagtgtctcttagatgtcattcccatagtcagctatttcttctctaaacgtcgtttatgtttgattcagatttcactttgagtttaccagtgtttcagtgctgtactttcatctttgctgcccaattccctctttggattacccatttttgtaaaatgtcaagtgggttaatcactgtgagacatggtggcagcacaactatatgcttttctgtctgtgtaccaactcagatgcacagtgaccaatcactgacaggctttgaaagaagtgacgtgattggtcatggatcatgatacagatctgttatttactcagtgattggtgcactgaatagctagtggtgaagtttcttttatgtaattattattgattaatttatcatagtaactgacatttgagtcttattattggcagaatgatgttaattaaactgtggtaactgaaatttatgcatctcagaactgtgcaaagcaaggactgcgagtatgttataaccatttcacaaagtcttaaaggttaaatggctacatacagcacatggccaaaaagtggcagaattacattaacataacttttcaaatatctttgatatttatgttataaggaggcacaatctgtctcttaatgcttctgtcaaattaaatactcatggagttcaaatacaaatggattgtcttcagaaaaaaattattagcatgtgtatttaggtccatagccctataggaactctgtctgtgcttagcttgggctaaccatgtaagactgccaagatttgcataaaaatccaattattgtaaagagctactcaaagctagcaacatacctgaccttatctgaggttattttttggaatgaatcaagagtccccagccttggagtgatgaaaagaccatcatttttatttgttttattctggaacaaataaaaaatccctggaaaggaaaggaacatcccgtagtcaagtggagaaaactggtctaaatagttagcagtggagatattgagatactctgcttaggatgagagatcagcagcagtgggtagggatgttaatgactggaccttaagcttcagggattcagaaataagttcagttagttctcttaggaataagttaaatagtgtctgctcaattcatctggccggctggtagtcagagtccacagtaagtagtcaaatttgaaagttgtaagatacaatccagcttctgcaataatgagaaggctcagtttggagcatctaaaattgttcagggtacaagagaactgagatacacagatggactaaaataatactcagttgtggatagatgaaggctgagaaaaaatatgataaaaggctttttttaagtgcctctaaaatgccaggtcttctagattacttttacttatttgtaatgtaattcttataaacatcttgttagcaggtgttatagttgttatttagaacttttctgagattatagagctagtaagtaatagagttgggttttttgttgtttttaat

SEQ ID NO: 57 - DNA, 57143 bp, Homo sapiens
acccacaattgctttacttcaaaaattgctctttcttgggtgaataacgtgaatttcatcatacatcctattggcaacaaaaacttttttttttttaaaactaaacctcatttggcctgtgaattgtcccaaatcagccagtgaggaaacattgggagtcctaacccactctgactttttccttactttagggagcaagctgggttggctagagtcctccatccctatctgtgttcgtcaacagcaggtgaccttcacaaatgatgaggacctgaatgcttctggtggctttcacagtggctgatgtggcacatgagaagactacaatgttagtattaaaaaggatgtttagaagtagctctaattgacatggaaggatttctgaatatattaggtgaaaaatgaggttagagttctttgtagagtgtactagcttgtttttacggagtgcttttcttggcatcaggcattgtgctaaggccttcaagttatacagtatcatacatccttacaaccctattttatagttgaggaaattgaggtccagagaagttaaggtcactcacttcataagtggtggaactgatctttgagtgcacccctgtctctggagcccctgttcctagtcctctccacatgaacagcccttcctgggagtctccaagtaccagctttctctgacatagggtcacgcatgcacatgcaagtagaaaagggtgtggaagtcgcatattataaaacaggtaagaaattactgttttataatatgatgcagtgagtatgattaagaaatagaccagcctacttaatgtgcttatctctgttatagggatttctctttttttcctgaatgttctaagttttcaaacattcagcatttataactttttaaaaattatgaaagcaattagaattatttaccataatgtattattactggattttaggaagaatatggtactaaagttgtttagtggttcagactgagagtgcattaatgggaacctgggattttgtttgtttgtttcctatttgagggaacttgaattattgttttgggccttattttgttcatctgttggaaaaaagcatgccatattttaagttacaggctcattataagaataaaaaactcctttgaaagatggattgataaacacatttgtaccatcgatttctggttagtgctgtttaatctttatgattctagtgtcaaattctccccacaactctaatatagagtcaattcatacattcaagttaatggtagatggtagatagtatgcataaaaaatttgaggcatgaagttgtaaatgaaaattaggactaaatttaaatttaaatatacataaattttgtatttaaaactttcagtacagccatgtaccctataatgacattttggtaagtgacagactgcatatataagggtcctgaaagattataattctgtatgtttatggtaccttgtctcagttcagatttgtttagacacataaatacttgtggtatagttggctcctgtgttcagtacagtaacatgctgcacaggtttgtagcctgggagcaataggctatatatcatataacctaggtgtgtaggaggccataacatctaggtttgtgtaagtgatgtctgtgatgttcgcacaatgacagaattgcctaatagtgcatttcttagagcttatccccatcattaagtgatgcatgacctgtatattcaatataatataaatgtaaattggagcattatgtatatatgctgtagtgtagtaggcaacaattgggtagtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgggcaacatggcaataccctgtctctacacaacgtacaaaaacttagctgagtgtggtggtgtgcacttgtcgtcccagctacttgaggggctgaggtgggagaatcacttgagcctgggaggtcaagtctgcagtgagccatgaccgcaccactgcattccaacctgggcaacagagtgagactctgtctcaaaaaaaaaaaaaaaaaaaaaaaaaaaaggctatcatgggagtgcttaataaacattgctagcaatttcgaatcctattttacataaaagattatagtaatttttaaagtaaggtttttaaggcaagcaaaggaacatgtattgatttctgagtatattgcacatttaattacaacaaatgaaactggtcatcttgtgtttttatttttgttttcatctatctgctttccagactaattggggagcaagaattccttttcctttccctgtttcctttagatgattctgccccttcatcttcgctcctcatttctgtagcttgactttgttctgtagctgtgtgctgttccctgggtgcctgccaggagggcgcttccttctgcctattcctctctccattcattgactatctttaagtggcgttttttccttccctacctgtattaagattttctacttgcagactcttctcccatgttcacaggagctggtttttccttgttgtgcatggaagcacctttggttcatgtttaggatatgagcattgttgacaggcactgttaacaggtgaaaacatctcaaaaggatgcttgattaaaataagtattttgttgttcataagcctctttatttggctttggtaaactaggagcctaaggtaacctttcattccagttttttaagtttttgtggttatattatgcagtttttattatgcagtgcttatttcttatgacaaaatatgagtaggttaaattcataccatatcaaaatgtagtagtgaaagtctctacttttctgatcctcagccccctagttccccctgcttgaggctatcactgtttccagtttcatgagtatttgttcgctgatattttatgcatatacaactatatatgtctttccttgcaaccctttgacattatacagatggtagcatactcttagcttggaggctagtcccagcgcatttttcgcctatattgtgtcttagagatcatttcatattagcacacatgggtataccttgttacaaacatgcacacacagaaaataagctttaaagccgtctgctgtagtgcattggcattataacatagtgtcatgagtcgtagagctggattcaaatcctgaccctgccatttaagagcttgtgaccttgggcaagttgaatcacttgtctgtgtttcaggtgctcatttgtaaagcagagttaatctctctctcacaaggtttttgtaaggattagaggagataatgtatgtaaagtatttagcacagtgtcttgcttaataaatcatagctattattgtactcattaatttatcagatcaaatgaacccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaaga

SEQ ID NO: 58 - DNA, 101090 bp, Homo sapiens
acccctaatgtgtttctccttctcaactgaaatacacagaaggcattacttattacttgtttcgtgaccttttgtcttaccttggttgtccttttcttccaattccatagtttatcttctctcctacttacctcctgaacttatccccaacaaatgttacatatttcttttactttttgagttttcttggcctgttgatgaatatattgacctagcatagcccttgccattgcattaggtaccatcattgttggttttagtactagaaaaactcaacaaagaaggaatattttcttggtgatgctccagagtgaatttaatattgacaatcaaatttattcaagtcactagacaggatgattccttttgtgattgggatttcagctgggatagaactgagatttggatacagatggtacctggcagacgggaataaatgtggggctgaaatgccacagaagcagttagcagtgtgggcctatctgggggtggcctgaggaaggacattcatgaggggggagtaggtggggatgggaaggacaaaaaaccgcattgttaaattaattggcatgacaactctggcagtggggcctcacggagaatgaatgatatgcagggtgtggtgtatgtatgtgtggaaaatagaaaaatgtggtgtgtagaaactggaagaactgtctccctgggttattttaacgttctgcttcagagtacaagcagtttagctgtgggaagcccccacccttttccacaggagagggatggctctcatttgacacaagctgtcatgcttgtaggagtcaggattgttgcacccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaagtatatgtttttatattctatggagtaagaactcatgttactatagtaacatgctgctctgtagcagtcagaattgtgtatttcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcacttatttggttgatactgagtcgctataaaaatcattgacatgaatgacaagttgtgtttttttccccaacagttaaagacattttacatacagtatgtgaagttactttccaaagaaacattcttcatgttttcgcaagtttttttttaaacctaatatttaatgcaatgaatgtgggttggtttctcttcttccttcttccttctcctcctcctcctccccctccctctcccctctccctcccatcccctcccccctccttcccctccctcccttccttccttccttctccttccttccttccttccttccttccttccttccttccttccttccttcctccttttctctctctctctctctctttctctctttgtttccattgtaaacatatttgcaggattcagaggtgaaactgtagcggaatgtatacacagaagctctgcttatacctttgttcccccagcctgtttgccctctccctctacaggtcatcatttttattagcttctttctaaagttttttttttttttcacttaggtgccacacagcatcgagtgaactattttaaagtgaacagttgagtagtgttgaatacatccagagtgctgtgtgatcaccacctctagttccgggacagtttcatcccccaccaaaggaagtcccatacgtattaagcagcccctaatgaccatccacccgtgttctgcttctatggatttatctattctgaatattttatatacaggaataagactttgtgtctggctgcttttgcctggtgtgatgtttgaggttcatctgggttgtgttttgtcattacatcatatctttttatgactgaataatattccattgtatgtatgtgccacagtttgtttatccattcatctgttaatggatatctgtgttgtttccaccttttggctattgtgaatagtgttgctgtgaacatgtatgtgtgtttgaacacctgttttctcttctttttggtatatgcctagaagttgcattactgggtcatatggcaatcctgtgtttcacttttcaaggaaccaccaaactctctcccacagtggaaatggaacaatttccaccaacaatgtagaagaattccagttggtcagattgttgcctacacttactttccttttttaaaaaaaattcagtggcattcagggatcttcataatctgagctttgttttcctttgcagtgtaatctcttcctggtttcacatgccactttcagaatactggattatggtaattgcactcttttgctcccttctcttcacctaatgtgttgtccccacctgcccttttcccccacccataagaccttgtctctgtctctgtcgcccaggctggggtgtggtggtgtgatcacagctcactacagcgtctacctcccaggttcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagctattagttatgtttctctggaactgcatttatcatcactgttaccaaaagcatcctaggttccttgggaagaagatcttaaagttctctaccaaaccactttttttttttggtgatgcttcagtctcacaggtgatgcttaaaacacagattctgatgtggagatttgagatcttacaaccatagaccatatgttaaacattgactacacaaggattcgtgatctgagcattaatagcctgtttttttcctaattgcatgttttatagtaatcctaacctttaatatataagatcctaacctttatatttaacgtcttaacctattgctctgtatttctttaatgccatggattattgcttacagttataaatgaaataagtaattttactttatattttcattgatattcaacgaataccaatttaaggagagaaacatagatatacttttaaagaatttaagcgtggcacttaagattctttttattataataagcatgtgaagaagctctttttctgtaatcctagttcccaggggccaaaatgatgattaattacagacaataggtttataaaagtaaccgtttccatcatagaagtgtcataaaagattaaagggtgtatcaacaaaatgaaccagcttcctgtgtaaaattattaatattgctaaataatgtagccttatatctgttacaaaagtaccagaaaaattgctggataatgtgttacaaattttttacaaattacatagataatcctcagttctgttgaatttctctgacattctgctcaactagtttttcctgtgcagaaaaatcttaacaggttgatgttacaggaaaagtggcatgcttttagaaaccatgactaggctgcctgaatcaaacatcctcccctttgagaggcctaggaaagaaccatctcgcttggttgtatccagggtacactctcatagggataaagagccaaccaaataaaagggcagacatatacttagctgtacctatctatcctaatgtgtgtatatatagtgaagctattgtacaatatttcttaatgtaacttaataaggtagttagttttttagcctcctaatggcttagtgtttataaaaatgatactcgttcactgcaaattgtagagtatataaaagtgtagagaaagtagaaatcaacagaaatccttttccctcgagataaccgttgtgaacattttggtgaacatgtttctagaaatctctatggttatatacatatgtaaaagtgtacatatctaatgggatcaaattatatgctgttttgtattctctcagtccacaacttgccagttttcaaatctgtaaatgtagatatatattattttcaatggatgtatgctcttccactgtgagtcatagtttagtttactctgatatcactagacattgaagttgttttagttcttcattataaactatgctatgatgaatacagttgtctggtaattctgttagtttagggtaaatactttgaagtaggattgctggctcatacagtatgtcttgtttcccgccacagagctgccctttggaaaggtagtgttagtttacacatccactgagtcctcattgctacatcttctcaccaacactgctttctaaattaattatttcaattcatttattttttatttaattttttatcatggaaaatgtaaatacatgcaatggtagagtatgcatctatcactcagtttaagtaatttcaactcatggctaattttggttcatctacatcccacctgttttccttcttttcattttgtgaagcaagaggcttctcaggctgtcatttaacctgtgatacctcacttttatttacatctgtttattactgaaatgagtattttttaaatatacttactgggtacaaagtggttataaactttaatagtgagttaattgattttcttcctgtgggtttacaccaattgcaaaagtgtaatttagctcttaggttgaataatcttaagctgatttaatcttaagtcagatgtaaagataatgttcagttccagaaaggtaaccagactctgagctggttaggtagcagctgcagcgtttggtcctgggtgtgacatcttaagaagaatattgacaaatgagcatttccagaagagagtgaccagcatggtgatattagagaatagtgtcacacagggaatggttgaaggaaccaggtggggatcttcagtttagagaagacagaaatttgagggaagaggctgatgaatggagacagctatctgcagatttgtcatgtggaaggtttcagggataacaaggaagaagctgctaattaagtagcaataaattttatctcctctctggctgcttagcttttattgattttatttatatacagctgctggaagcaagcgactggttttgtgattaaaatgatgcttttgggtttctaggaaaccctgagatgatctttgtcaggttttacttcacatacccatctctccaaacagggatttagcgttgagatttaaagcggttttgccatataagaaaatatttttcagtagagaaaaataatattccaactgaaagctgtccagtataggcccagaatcccatatctgtagttccaaaataaaaaaaaaatcctgacagcagaatgtttcctaactcatttagaagcaaaacttgacctgaatgactgtgtctttatttatcctacttgatgtgaatattcatacatttctttgcagaaatagtaatgtgtttgattacggtatgcttttccataccccaggaatattatgtaatgctgtaattacccatcgaaaactcatgtctgaattcttaacacttctggcacagagggtgtgtatacctatagttgtcgttctgtcgtatgttgaattatatgcggtgtattttgataccctatcactatgcatgtgtaaaaagggaatgatagtgcttttcctgtttgtccctctggaggctgtgaaaattagattactatgtggagcatattcagaatagaactgcctaaaaataacgtgttactggtatggtattcttattctgtgtgtgtttaactttctgcccgaagataattgggaagaataatgtggaaatctgtagttgaaatattataactgttgaacaaagagatgtcttccagaggcaaaatgacaaatgatatttaaaaaatattttcactttatccaatctgattagtatattgtggtgttattttgaattatttgaaatgaagtaatatatcataaaacagaattaggcttattttaaggtctacacttatgagctcttacaatttgcttttagatatatatattgaagttacttgtaaatgatgatgatgatttcattttagatcatgctaacattctagttcagatgatctgggttgcttgtattagtgtggcaagacccaaacttcacacagaaaggaaaggcagtatgatttctaaaatatttacttatatatataaaaaaacttggttaaaatcaaacagcagaaaaatgtattacataaaagtctccttcccctaatccttgtactcaaagataactggtatgattttttttgtgtatttttttcataaaatctttttatgttagtatatatttcaaaaattcatacaaataggatgatgcgctctccatttcatccctcttttacttatgtgccttagaaatctttccatgaccacacacatagatctattctccttttagtgactgaagtattccacatggactatacagttcagttagttcaggtcatgggctgttaggttgtttggttgtcttttttgtttgttttaaagtaagtagaagtgatcatgcagtgaacaactttgtgcagtttgacatatttttctaagaaaatcaaaaggtagattcctagcatggaaatgtaaggaatcatttaaatatactgataatgctggattacccaaaccaaaggtctcatcaatgtagtcttttacgatgttcaccgatgccgtttatcccctctcttgctactgctagacattatttaagtaggtacgtctttaaatgcatttttcatttaaattaatttatattttgttaatgacaaattaaatttgaagaaaaggttatatatgtatgaggcatatcattttacattttgcagataatggttggtactcatttaagctcccaaaactcttggttctaaaccacgtccatgaggcactctttgatgactctggggaaaagcagattctttcctctcttctcattttgatctccttgggaggaaacaagctcctttttcacatacttttttgaaaacagctttattcaagatacaattcacctaccatataattcatctattgaaagtgtacaattcaatagtttttaggatatttagagttcagagttgtgcaactctcagtagtcaatttcagagtattttcttctccctaaaagaagcctcacccttcttagctataatcacgccacatcttcacaccctaccctaggggaaccattaatctactttgcgtctctatagatttgccttttctggacatttcatataagtagaatcatccgggatgtcatttttgactggctgctttaacttggtgtgctgttttccacactcatccattttgtggtatgtattactacagttggttctctgcattggtgcattctacatctggtgttcaaccacagattaagaatacttaaaaaactgcatctgtactgaacatatgcacacttatttttgtcattattccctaaccaatgcagtataacaactacttatatagcatttatactttattaggtattataagtaatctagcgatgacttaatatatgagagggtgtgcatagcttatatgcaaatactatgctgttttatatcagctacttgagcattcatggattttggtatgcataggaggtcctggaaccaatccgctatggataccaagtagatgtctatacttcattcctttttatggctaaatagtatttcattgtatgtatatgtcaccttttttttcccatttaccagttgattaacagatatttgggttattttcactttctggtgtctgtgaataatgctggcacatactgatttcatgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaaaaaaaaaaaaaaaaaaaccaggtgtggtggtgtacctgtagtcctatctacttggaaggctgagttgggaggattgcttgagtccaggaggctgcagtaaactttgatcctgtcattgcactccagcctggatgacagagtaagaccctgtctcttaaaaaacataaaaatagggctggttgcagtggctcacgtctgtaatcctgcactttgggaggccaaggcaggtggatcacgaggtcaggagtttgagactagtctggccaacatggtgaaaccccgtctctactaaaaatacaaaaattagctgggtgtggtggtgtgcgcctgtaatcctagctacttgggaggctgaggcaggagaatcacttgaatctgggaggcagagattgcagtgagccgagattgcaccactgcactccagtctggcaacaaagcgagactctgtctgaaaaaaagaaaacaaaaaacaaaacacccagtctatggtgttctgttacagcaacagaatatagacaagtgcatgatcctaataagtgtgaagtggtattttgtggtttttacttgtacttcctcaatggctaataatgttgagcatcttttcatgtgcgtattgtccatttgcatatcttctttggggaaatacatatcagatcctttgcccgttttttacattagttgtcttactgagttgtaataattctttttatattagatataagtgctttatcaggtatgattttcaatctgtgggtcctcttttcactttcttgatggcattcattgaagtgcaaaagcgtttaattctgatgtccactttatcttttgttgtgcttttggtgtcatatctgaacacaagtctttaaaggatgaatttgcttggtgaaacacctttcctttggataccaggttcataagattggacacagtcaacatttttttttttgatctcaatcacttattccttgaagataatctcagatgcagcttattttaaggcagtcccaattagttgactttcagatgtgttatttggaaatacttttaaaggtattttgataagaaaatttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctggggaacgagcctctttgtccagaaaagggctcttagatttttccctgtcagtgtattgtaaccttttataagggcagcgccaagaaaggagaagctgctacttggggcattgtgtttgactttggtattctcacaggtatgctgtctaggaaagagttcaggtctcctgcttaagaaattgggaactaggctgcttcctgtggttctgttgctttgtcgggggagggagggtacctgatttctactgaaggccaaaatgcagagtcaatatggccggttattggcaaaaattatgatatttagaaacttttggaatgtctgcaatgttttctagacattctagggaggtcactggtgtttggaaagtacatacaaatggtgtatgaaaggagtgtgccattttctgcagaggtgttcgttacatttcataaccttatgttgccatttaatgaggtcaaagaggtttcttgactgtgactatggaatgcttatcttttgttctgtcttgatctcctcctgtctgtgtctctcattatctctgactacttgtatgttggcagtggctttatttcctttcacactcagcctggattccaggctcatctctaactcctacatcagaaccctgaactggcttgtctgttttgtaatctgccctaccatgcatacccctaacctagcacaaacgccctacccttcccttctcttgtacccatgtggctcagcacttctggataaattagaacaactttgacgatggtattggtcagggttcgattatcgaggacagactctaattcttcctactttaagcagaaagcagtttattacagggaattaaatttcttggtgaattgttgagggtacttagaaacgctcctagcaggttgtgctagagtataattcccaaggctgccctgtggaactggactgccagggtggccagcatcctagcccaggcatggggctgctgatttggctgttgctgctccactgctggccccagaaccacaccaccttggccgctgtccacaagagtaaagtggctacatcacacttagtttctctccccacttagttcagtttcattcttaacccagttggaccataccatttgtgttttgcatggttcatgtttatcatgatctgaaggaacctaaatctagagcagaaccccaatgtggtttttcagctttccagactctgcagagctagaaggtgggagtagattgaagtgagtcaatctgcagtattttccacatttatggtttccgagtatagctggctcttcaagattgttttgtagtcctttcacctttccttgataggttgacttgtttgctgatgaaagcagcagttctcattctacgctggcctctttcattctcattagatggtggagcctacgcttgagagaagaagctgtcgggtacgaactccacttaattgtcctcctgttcttccctgccgtccctttcaaatgaccacaggtagctgtcatagccccgtagagagtgtgagaaagcacaggcaggagtcagcaaggttgctgggaggactgaggctctcggaggtggatcctggaggtgagagggccaggtgtgaggacaggagcacgttccagaggccccacgacagcctcgcccagcacatggcaccattcttcacttacaatccagggcactctactttcctgtcttgctggtggcagctcattctgttcccttcgttgaatcttcccttcctatcctcaggttcagtccttattctgttcttgacttctctttgtggacaatctccttagtttatctctagcttcaacctttcccagaagtctagaggtatatttccaatggtcggtcatcttagatagctcataggcttctcacatctaatatgtttgaaaccactcttgatttttcttttttttcaaatctctctcacttagtgtctcccattttaataagtggctttatcatttacccagtaactcaggccccaaatcttggagttatccttcattttttttcttctctaatttatcaccctgaatcccattagtaaattctgttttctctgcttttaaaacataccctgaaaccagtcacttataatcagccttattgctgccattccaggccaccatcatcactaataagccttataaatggtggccctaacttttaacttctgtatccagttgccagagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctcccttcccaggcttcgagagcaggcagcatgcttcggttccccacccagaggctgaaggcatgcctgagcagagagttaatctttcatatcctgcctggcagaagcaggtggtacttcaattcccctgtcaggtggtgctgacagcgcctagtggggagctgatcttccaccctctgcctggtaggagcaggtgatgctctgacttctctgccagggtagtgtcagcaaggcccaggttagggccatatccagcccccaccagccacaatgaggtggtgctagcagggggctaattaccattacacttgacctcttccatccccatcatcccctggtggggaggtgtgagcctccacacccactggtggcaaatgaggtatggaggagcggagcatgctggcactccccacctccccgcccctcctttggtataaatagggcccccgggggtcctgaacttctgctcctggatgcagcaacaaactggcatggcttagcccttggctttcccttccctgtggtagcttggcccagagggtagctgatcttacacagaggcaacagaaatggtgagttggagccacactttggctgggaaagtgtcagtgagctgaactctcaccccatctgtctgcaacaaggcaatgtgagtcatcaccccacttttgtcagggtgatggtggggagtggggggctagtgggtaactgaatgtgcatacccactcatccctggtattaatgcctttttagcagggaagctgcccactaaaagattaaatttgatctggggtctcttaatatcaaaaacatataggatacaattcataccaatttatacaattctacagatcactcataccaagatccaggaatatcacctatgaatgagaaaggaccatcagcaggtgctaactgatttatctgacaaggatttgaaagctgctatgataaaatgtttcaacaagctattacaaattcttttgaaacaaaacattagaaattctcagccaagaaataaaaataatttattaaaaaccaaaaagaaatgatagaactgaaaaataatgatagtttaaaaatactgaatgggctcaatagagtggcaatggcaggctgagaatcagtgaacttgaagacagaaaattagaatctgcccaatgtgaaaaaaatagactggaaaaaaaaagtctcatagacctctggagtgatgataaaagagataacacttgtgttgttgcagtttcagaaggaaagaatagagtgggaccaaaaaaaaaaaatctgaagaaataatctgactataatttctcaaatttggtgaaagacagaaagctgtagatctaagaagctgagtgagccccagacaggatcaacccaaaggaatctgtgccaagacacatcctgattaaacttgtgcaaggcagatacaggaaagctactgaaagtagctggagtttaacaatgtgtaatttgtaggggaaaaccagtccaaatgagaggagccttctcatctggaatgatggtggccagaagaaaagcagcacaacatttttcaagtactgaaagaaacaaccattaaccaccaattctatatgcaacaaaaatgtctttcaggaatgaggggaaaaggaaaactttcttgcatgaaggaaaacaagttgtggttggttaccaagcatacccttaaaaactaggtaaaagttctttaaatgaatggaaacgaaaacataaggctctgaatttcagaaaggactggaatgggcaaatataggggcacatgtaatagactttttatgagttatatttggttgaagcaaaattttaatgtaatatgatgtagtaaatatatgccgcggaaatatttaagacatgcttaaaaagtggggaagggccttttggctggaaccaaccatcttctgttaatttgccaaaatgatgaacgacaaagagaaaagggagaggcacctggtatgttctctaggccttttagaaaacatggacttgttcttttggccacatacctgcaaatctataagaaagatgatattggagacatcaagggaatgggtactgttcagaaaggaagccccacaagtgttaccatggcaaaactgcaagagtctacgatgttactcagcatgctgttggcattgtaaacaaacaaggtcagggcacgactcttgccaagagaactaatgtgcgtgttgagcacattaagcactcttaagagccaagatagcttcctgaaacatgtgaaggaaaatgatcagaaaaagaaggaagccaaagagaaatgtaccagggttcagctgaagagccagcctgttcccagagaagcacactttgtgagaagcagtggagaggaacctgagctgctggggtgtctctcctatgaatccatggcatgataggtgttaaaaacaaacaaacaaacaaacaaaaaaaaacaccaaaacaagaaaatactctggactgtgtttaaagaaaaaaaaaagtggggagagtaaaggcaacttacatggaagcatggaagcctgtttttcctattttgcttgtgctggtaaaaatgttgataccggtagagtgtgataagttacatatgcttactgtagtccttagagcagccattatgaaaactggtatactcgagcactatgaataaatgaaggtggaattattaaaaaattgacataatccacaggaagaaaggagaaacagaagaaacaaaataacagaaataattaaatggcaggcttaggcttgtcatactaataattggcttaaatatagatgatctgaatacaccaattaaaggatagagattggcacagtggttaagaaaacatccaaaactgtgttgttcaagaaattctcttaaaccaatgacacaggtaggttgaaagtaaaggatggaaaaagatatgccatacaaacatgaatttaaacaagagtggccatattaacattcaaaaataatttcagaataaattaataaagacagaggcataaggatcaaataatgaacacattaggaagacatgatgatcctaaatatgtacacaccaaacagaacctcaagatacatgaagcaaaaactgagctgaaaggagaaataaatttaacaaatactatatacatataaataaatgtaataaataactgaagtcttaaacaccatattcttagcaattagtaaaactatacaccaaatcagcaagaatataggacttacacaattgaccaacagaatctgacatttagaacaatttacccgaaacaatagaataccctactttttaagtgcccatgggacatcatagacattattctgggctataaaataaaaaacgtaaaaggattgaaatcctacagaatttgttctgtggcaataatggaatcaaactaaaaatagtaaaggcaacaggaaaatttctaaataacacatttataaataattcatacgtcagtctcaaaggaaaatattaaacataaaaatgaaaatatgttattaaatatgtgggatgtagcttaaagcagtcccaagagggaaatttatagcactgttataaattaagttgaaaagtggaaaggtctcaagtcaatttaagctcctacctcaagaaactagaaaagagcaaaacaagcctaagcaagcagaacgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaagaattaacaccacttttattcagtctcttctagaaaacaggagagaagacctagaaaacaggagagaagacctacaaagtcattttgtgagtctagtattaccctgacagcaaaatcagagacagcaaaaaagaaactccacagttcagtatcgctcatgaacttaaaggcaatgatcctcaagaaaatattagcaaatcaaatagagtaattaataaaaaatatttaacatgaccaaatgagatttatgccagccatgcaagactggttcaacgttcgaaaatctatgccacccaccatatcaacagaccaaagaaaaatcagcatctatcagttgacctataaaaagcatctgacaaaatccaacattcattcatgattaaaaattcagaaaactagcaataaagaactttctcaactaaagagcatctaacaaaagccttctccagctaagaccatacttcatgatgaaagatggaatgtctttcctctcaggttgggaacaaggccaggatgttcagtcttacctttgctgtccaaaacagtagtactaaaagatatccagaccaaaaaggaggagcaaaacagtcccagtttacggattacatcattgtttatcctaagaaatctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggattagagaatacaaagtaaaaagtgaacaatgaaactccctacatgttcaattttaaaaaatgttttaaaaatggtggtaaaatatatcctaatttttcatctgaatcattaagtatacagttcagtagcatcaaatacgttcacattgtcgtgcatctagtctccacagctacttttatcttggaaagctgaagctctgtacctagctcaggatccaattttttttctcgttagttgtataagaaaattccgacttacttaagtagtggcagttattagcttttgagaacagtttctcttgcagtttcaagatgtgctttgcttatgttgatatggaagcttaaaagaagaattgtagacagtttatttccaggctgaataaaaatgtgacagttgctcttgttatcataaatagaagataccccaaaatttgcaacaaatgttaaaactgcattaccattctcagaataggtggatatcgtgttcttcttcgttgttgctggactggacgtaatggcatgctgatagcacgtttcaatcagatgggcctgagccctgtctagtgtataatttaccttttcatatatactgcaggagtgtccctggtagtaagttctgagagaatgaacgtaaaagttcagcagtcctaaattcagaaaatgatgagtggtgagcctttgtagttaatgacatgattactgccagtcttactgttgtacagtaataacaagagatgcttcatttccaggtccacacaagcacaaattgacctaccacacagggtagtgctttggggacaacttatgtaaaaatctgaatagtacccatctgattatgactgttgtgctttattacagattttaaaacatattgcaagaagttaagcgtttatagaagtctttgaagtcttgttgtagaacttcgggtctccacggaatgtggtttgatcactgctgcattgaagtacacagagggcatgttattaggaactgcattttggatttggaggattttattttcagataacttacggattttatagtgaaaatgcttatgctgatacctatttcctggtttctctgggacctgacttcttccagataaataatatcttcaaaagaatacattgaaaaaagatattgggacatgacatatgttaggaaacaaaaagagactgaactaaccttttaatataaacgtagtatgtcagcaaaccaaagtagctgtcattaagagatgagaatttcctgaaaaaaattacgtaaaatcctactcagtgatattaacacattaaatatatttaacttagacattcttacaataagcatgatttgcaatgccattttatttaaatggcagagaaaccccaccattcaataacatgagttatctttttttccaggaaattatttctgatttgaagatgggagtatagtaacatatcagggcttgtaacatgttttcagaaacccaaattccaggatggtggcacggctgaaaagactcctcagcgttatctgttttcccaggcgatgccttgccgtctctttcctgtttcagtgcttctctagagtattgcctcctcagtagtaaataatgttgttccatgaaatttgagatttttcatattgaatagcttctcgcagtaatgtttgatcctttatgatgcaggtcaccccatctagatgacacagcttgggctgccgtgacattggtagtcaggcgttcagtctgttggaattgcagtgtcatcacccactgcagttattcggttcttgttttctgtcttttaagcataataattaaaacagttcttttagaataaccccattgttagatgtttctggcacttgtactcctggataaaatgtttttgggtctaatttttaagatttagagtctcagtttttccacattgcaacttgtgatactgcatcctcttctgcttaaaatctttcagggaggttcctactgtcttaagaataaatttcagactcctgtgcatgcacaaatgctgctcataataaagctgattgtgccctgcatgtgggcaccagcgagaagaggagtcctgccagcttgtctgcagctctggggctggtttcggtgggtggggacctttccccttcactgagaggtgtcacctgggctagtggagctcctgtgagcctccgtgcaaggctgttcatctagcttcactttcttcctaggcttgtctctccttcctgccagcactacaacgtacgtatggtcctgatcgatgaagctacttcagattccacaagtgtgctgtgctttctggtgcccttgtggtaataacaatagagttaacatttatttatttttaatttttttaatagtcaaggtctcactctgtcacccaggctggagctcagtgatgtgatcatgactcaactgcagtctccaactcgtgctcaggcagtcctcctaccttagccttctgcacccccacacctggctaatttagtttctttttttttttttggtgtgtgtgtgtatgtgtgtttgtgtgtgtgtgtatatatgtatacatatatatatacacgtatatatatgtgtgtgtgtatatatgtatatatgtatacatatatatgtatgtgtgtgtgtgtgtgtatatatatatatatatatattttttttttttttttttttttttggtatagcagtgttttgctatgttgcccaggctggtctcgaactcctgggctcaagtgatcctcctgattctgcctcccaaagtgctagaattataggcatgagctactgcacccagccctgagagaattatttattctcctccttctctgctaaactaattggagagagtttcacttcatacaccaaagtctgcagttaaattcttgctgttccctgaaagactttgcatcttcgtgcttctgttggttgcccatgccattccctctgcttgctttcactgcctcttgcatccagacgttagccggttaagtggagttgtacttgatgccacttcttccaagaactcttctccaggtgcacaaaccagatttttttttatattcttttagcaattttgtagtactctgacaacacttggcacatatcttcttatactcttttgtatatggagcagtatttttataggtgaaagagtctaattttgcattattagtgtatatatgatatgttggataccagttggagatctggtgatgtcataaagctgttggtcttactatgcctttcccagaagtacctgatgaagttggaacaaaataacttttcacctattctctgattactacagtcaaggctccagaaccctagccattgggctcaaatgtgccgttgaaggtgattttctgttcctagatattttcaacctccctgtttcatttctgaccaatttttagggccagaggctaatccactagaacaatatttccctgtggcatggtttttaattttgttctgaatttagtttatattcctaagtggctttacaagttttttctccccatgccctcagaggaagttatgttcttctgaaccttctgggtaccattttagtaaattaagaattcagttcactgaatgctacccctgtggcctgaaagagttaatacaagtttcttaagtactttattaattctcagggaataatttatgcactagagcgtggcttagtatcgagccagttacaaacacattaaatatgtttttttttttttccttttgtgtagtaagtctctgaaaataagtggaggttcactttaagtgtaagtattttgcttcctaagtacttaaatatgtataattccacaatgagagaaggagtattataacagaggatgaggtggattcaggtcctagctcagccctgcacttctgtgaggccttggtgtgtttacctccctaaatgtctctcacctctaaagtggggacgatgtttacatcacagacagcaaagctcaatgatgatgcacttaggttttaatgcatagcccaggcttactgcttgggtttgattcttggcttcactacttgataactgtgtgatccgaggcaattttattaccctctctgactcagctttttccactgtaagctggaataatgctagtacctgactcacagttgttacgaaggtaagtgtgcagtaaatgtgagccattcatatacatcatggactactatgcagccataaaaaggaacaaaatcatgtcatttgtagcaaggtgggtgcagctggaggttgttagtgaattaacacaggagcagaaaaccgaaaacaacatgttctcgtaagggagaactaaacatcgagtgcatatggacataaagatgggaacagtagacacttgagactactagagcgggagggaggaagacgcagggcggtgaaaacctacctgttgggtactatgcccactacctgggctatgggctcgtctgcaccccaaacctcagcatcatttagtatccccatgtaacctgtgtatgtacccccaaatctgaaataaaagttgaaattgtttttcaaaaagtgagctgttattttttttaaatactcatttggaggactttctgagctgatcaagtgaaataaaataaaaagtgccaagtactatgcctggaacatggcagcaaacagtgaatagaggatgacttttgcttttattaactacttaaggtttatctatagcaagttccagtcttaagatgcacatgtgaaaagctgcctgtcacatgaaagagtttgatgccatgtagcttgtcatgttgtcagactctgtccctggagtgtgcccctcacgtttttgtgcatgtcactgtggcatttatgtgactggtctgcgcttctttctcctttttacccctttggctgcaggatgttgaagtgcacttcagttttgtcgttctcatttcccttctggattcttgctcctctcctacttctgctgcctccttcctcagtcccccattgccttcagctgccctgtggttgcagtttaaaaaaaaacaacaaaaaaaacacaacaaaacaaacacacaacagcctatttagatgtatacctttgactttatgagggctgtggttttgtgggaagagcagggtctcacccttattagactgtggttcataatcacttaaagagaacgtcattcttggagttactcatctgaaaaagaagcctgctcctccaactggaaggggaatggggctggggagggagggggttactgttggatggaactgtgcttggctattggacctgagtgactgaacacagtgtccatgaaggagctggctaggcatgtgttctgcggggaccagccctgtgagggcagaggactaagaagcgaaggatatgggcaaggaaactgtggaagtcatacctgcctttttgggccagagtacatgtatcttttatttttttttgagacgtagtctggctcggtcgcccaggctgcagtgcagtggtaagatctcggctcactgcaagctccacctcccgggttcacgcccttctcctgcctcagcctcccgagtggctgggcctacaggcacctgccaccacgcctggttaatttttttttgtatttttagtagagacggggtttcaccgtgttagccaggatggtctcgatctcctgacctcattatctgcccgcctcggcctcccaaagtgctgggattacaggcatgagccaccgtgcccggcctaagagtacatgtatcttaagaccacatcctggattggtagatacagaaggtttactccttgggcagtgctggactcttgatgaagtagcaggtagaggatgaagtttggggactttgtgcctctcacatttatgcctgctttttaatgtagcccaataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaagctgcagcagttctgagagcctactgttgtcatttttaatgggcagccttgtacttccatagattggttaatcttaaaggccagatggtagttgtattgtaatttcataaagattttatgtcctatgttttgctttcaactagaagcatgagaatttaggaaagttatattgagacatataaataataaaaattggtgaatcattttacctaacaatttattgatattactcaacacaaggagaaaaattagaaaatggaccttaacaccactgtctactatgaagacagtatagaggaggcaggaaaaacagaaagcacacaataacatgatagctataaattcaagtgtcagtaattacaataaatgtaaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgatagaccagctgtgcctgtagttacgtgttctttggccagacacctaaggaaatttgaggctcagacaagctgaagtagatatttctgtttccatgttgaataacagagccactcatgggctgtcacagatacactgtttggggttttaccattccttcccatttccattcctgaaggaaaaagagaagagatttttctttttttttcagattattactgtgttggtgacctagggaaaccctttttttttctcttctcttttcacaaagttctgaggagcatgaaaaaattgaggtattcacagtgtctggggaggaaatgagttctgtcctgtattttccgaagagtgggaatctaaatcggaacaggcaccaggttgaagaaataatttgtcacatcatggatgcaggaacaagctctacatgggaatactttgttgtagttagggtctgtcttgagggaaaacaagacataaagggtatgtgaaatgttttctggtgatcatatcccaccgtgtcattagttcttttaaagtactttttctatattatcccaatttagctttttttgcaccctgcagcaattctatttctattttgtttcctgttatcattgttcccttttctgagtagaggatagataggtaagtggtgtaagtaatggcatggaaagatccaagaaccattaagtagattatatccctttttactatccttttcttaaagtgcttgacttaattctgaatagccacttacaaactttgatgagtatctttcatcttgggggttattttgaaaattgatggcatttggaataaaagttgctataaccttagtgtacgtttgggtttataaaatatactgaacataggaactcacatgactcccaatttttgaagtaaccataatttctaaaaaaaattcaaatgagctgagttacatttataccactcctgggaattattagaatagcatatgttctctgtttatgctctttgtaaaattggaaaagtaatgtgtagctctttttagtagtgccctgtgtgtagtttctgtaacagttctgtaactgtaacttaccattccagtctatttctgaatggttagtggagctgcccgtcaaagccagacctattacaagggatgatatttcccctgtcatgaatagaaactattgatgactcgattaacatacaaggatgatacagttcatggttaaagggagcatgcttccttttgctggtgaaggaacattaactgtagatttcatctagaagatcactagaaaaagcagcctcccatgtttgagcgtgtcctgcatgtcagtttccatgcagatgctttctgtacgtcttcacgtcctcctcatccatgaggttggaggtgaaagttacgtaactgacttgctcagggaacacatttcatgttgcaaccgggctccatagccacatttcagaccatttttcttttctttttttttttttttgggacagactctcgctctgttgcccaggctggagtgcagtggcgagatctcggctcgctgcaagctccgcctcctgggttcacaccattcttttgcctcagcctcagcctcccaagtagctgggactgcaggcacccgccaccacacccggctaattttttgtatttttagtagtgatggggtttcactgtgttagctaggatggtcttgatctcctgacctcatgatctgcctgccttggcctcccaaagtgctgggattacagcgcctggcctgaccatttttcatttaaccagcattcagattattaagtcaaacggaaaaaaaaaacagggatataaacctattagaaaccaatgtgactgtttcatgccttacatttatgtctggaaagttgaatataaggaaaaagttgttttttgaaatagtttttcattggttccaatgattattcgagagttttccgtgaaagaagtataggtaacataataaaagttaaagttaacagtcttaacacttcaattgtaagaatattttgtggtgtcagtgtattaatagctcctgaaagaaaattgtcaaatgtaatcagtctacatttttttcatgtgtatcaaagctacccatttattaaatcacagaagttaattgtgtttcattgggaattaatattgactttataggtcttgggtagattatttaaatagccctgctagctaatatgttaacccctgcccttattacaaatacatcctgacggataagggcaaaatattattgactagattatgcttgaatatctcaaaatgaaaacagaatgaagcagctaaccaaggaaacgattggacttaaagtgtacgtacttgatcacgttaaagaggcctcactgctgtgtaacaatagatgcttaaaataatccaccagccaacactcactacatgtgaaagtggtttactttcttgtgtctgtggggaagctctaattatatgattataattaagctacagtttattttctcattttctctgattaaattgtggtgggaaatatctggccaaatctagtcttttcttagtcatgttatttgttaattccattgacacatcttattaaaatttgcagcaaggtgttttcctgttaaagtaattgaagatttcagagtatcttatatctaaaaattgtgaatattctctgaaactagacctaaagttcttaaaatataaatgcgtcattcacgtagattatggagttacttttaaaatgtagctatccactgaagaaaattgtgaaaatgtcccattaacgatttgcaaatttatttatttagagatggggtcttgctttgttgcctggggtggagtgcaatggtgcgatcgtagctcgccatggcctccaactcctgtgctcaagcagtcttcctgctgcctcagcctcccatgttgcttgcaattacaggcctgagccactgggcctggctgccatttgtaaatttaaatcttaacacttatgtggtgtttccagttagatttcttctccgttctttgcatcaccttcttagatcttccccattcttctcaatcccctgttccctccatcttcacggtacctttcatggaggaaatagaagccatcactgggaataccctcagctttccaccgacaaatctattcctgcagacacccgtcattgcaatttatattttaacaaaggcttctgatcctaatttcaggaaatagcctctaaactcatctattagtcccaaattctttacccatttaatctgctattttatgcctcctatattcttaccttcagatgttgagaggttggggcataaaactttgcagcatgtctgcagtcttccctctagagtgaacttgatcctgctgtttgttctttttattctcttcaaagttaaatcatgttccagcattcatggtatttctccagcttgtcctccacgctcaccccattgtcatgaggactgcactgaacaaatagacaccttatagtgcttataggccatagttgctgacagataacacggtttaaaaaggaagtttcacagccttgtagcttatgaattcccatgtcagcctcattagcttttacaagctattttcttagcttgtaagaatgttgctagggattcacagttaatataaatatctgtagttttggaaaattgagacagtgcttgcccttctctagtcatcctgtaccttttagatttgacctcttttttggggggtgggggttggtggtgaaatataacaaagtgcataaagcagatgtacagttcaaccaactgtaaaataaacatctgggcagttgccgtgcacatcaagaagtaggacgctgccagctctcggaagccctcgtgtttgttaccgctctttaaagattgaggcaggtgttccatgaccttatccccaagtctctgtgttataattcatacgagttgggaggctgcagtatatttggatgatctaagacctcctcctttatttttgcttaccattggattttagttttctctttccaatgtttattttctgtgtgtattctgaagataattttatctgaccaagaaagtaggtatagaactaagtgtgttgtctgtaattgtttgttacaatataatataactaaggaaactttttcaatttttgcaaacccaattttattctgctattgtttcctgataggaattttgggaattttagagatccctgcgttcttttgtacaaaaaatacatctttctgaggccaggcacggtggctcatgcctgtaatcccagcactttgggaggccgaggccagtggatcacgaggtcaggagttcaagaccagcctgaccaacatggtgaaaccccatctctactaaaaatataaaattagctgggcatggtggtgcgtgcttctaatcccagctactcaggaggctgaggcagaagaaccgcttgaacctgggaggcagaggttgcagtgagccgagatagtgccactgcactccagcctgggtgacagagcgagactctctcgaaaaaaaaaaaaaaaaaaaaaagatacttctttctgttaaacatttcctttaaaaatctaaactcatcagaaaaatacctgcttgaccacattaatttcttgaagtatctctttcttttccttttggaatcatgtgtttgtaaagtcacatgatttaatcttctagagactctggatgcttctgttgttgatgtatatgtgcacactcacagtcttaaggaatttggcattttatgtttcactgtctttttactcttgctccccttcttttagtgtttttttttttttttttttttttttttttttttttttttgaggcagggtctcactctgttgcccaggctggagtgcaatggtgcgatcacggctcactgcagcctcagtctccctgggctcaggtgatcttcccacctcagtctccctggcatctgggtttcaggtgcatgccacgatacctggcttaatttttttttttgtagagatggggtcttgttgtgttgcccaggctagccttgaacacctgtgctcaagcaatcctcctcccttggcctcccgaagtgctgggatgacaggcatgagccgcacgcccagcccactccccttcctcaccagtcttgagcctcctgttctcctttttcccctgtctaggccctcacatccctccacttttctctttttccccatgacttggtcatgacacagaaacaaagtccccagtgacagtatcttctcaaaaaccaaacagtaaactctgaactttctttgctattggattcatgatttgtgattaagcgtattttcccctttgcaggctcttagttatgtgtggtagatgtacttctaaattacatttgctttaaaaatataaaaagtatagagtaacataaatgatgtagcataataaaactttaaatcattaatgatattcatagattgacatataagctattcccagtcattttctttttttctttttttttgggggatggacagagtcttactctgtgtcccaggctggagtgcagtgacaggatctcggctcactgcaacctctgcctcctggattccagcgattctcctgcgtcagcttcctgagtagctcagactacaggcccatgccaccacccccagctaatttttgtatttttagtagaggcagggtttcaccatgttggccaggttggttttgaactcccgacctcaagtgatctgcccgtctcagcctcccaaagtgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcccccagctactgctcctcgcagagcagggctaacccataggtagtgtgcccagagtcagccatcattacattgttcacgcttacagcataagttaaggtaggactcaaaaaatttttctgtaaagacaatctcagaattaagtgctttcaggaattactatgcagctagaattttctgtaggattgaaggttctagcagctttgagcattgatactgatcttgagaatgaatccaattggcagtcatcccctggaagacttaatttgaggtctttatacgtacttgcgctacagtaaataagaatgtgtcctagatggaggcaaaatggggtgggtttcaagcatttaataaatgtgttaaacattttaactattatttcctcttttcaatttcaaatagtgttaaatgattgttatgggtaggaatagggtaaacccatttctagggcatggtttagaacattggtgcagtttttttcccaagaatatcttaatcacagccctggtttttagtctgtttttctaagaactccgggagttatgctggtttcctcagggattgtttttggcattttcctcatcatagaaccttatggcatcaccttggagacacagcgttagtttaaggaatggacatgtgatcacgcaggtcaattggagtcccatttggtgcttttctgtaggagtagcagggagagactgcctcttctggttggattgctagtggtgtgtgggctgccaagtggcccccttcctggcaccaagcagaatgcagcacacacagggagcagagcccggaggcttgagcctgatggcacttgaggaatctgggtcctggaatggtagatgtcctccatgctacccacttgcatagtgaatacattgcctttttgtctaaggttaagttttcgttgttgttgttacatgcagaattgagaaatatggccaatatcttagggaaggtggcaagttaggaactgtactagcaggctattaaaagaatcacagaggctagtagcctttagtttttaattttttgattgtctatttttgcttgtttgtgatgagtatttctacacctggccagggatgcattcagataaacattttggatacctcctctaaagtgtctgtccacaccacaggatcaccgcctggtcccttagtgctgacattccactccaggagatgctgggctcccgggtggcgcgctgtgaggatgctcgagctgtatcaattgtgaacctcactttcaggagttcagtaattgtgagacggtatcttcaggcattgtggaactctttgggggatgtgacattccagggcattctggagaaaggaataatgttcagtaataaaaccctggagacaggaattcttactgtacctgtgacccatgaagtcttagggcaaatgtagaaggctctgtttggctgaatgaatcttgaggcatccaccttgccttggagttactttatttacagcaacagacacactcacaaagaaagtttgtaagcaaaatattacaacactttgttttgcttctggttctgccattctgctgtcatctttgcaagctgcaaaatgtgagggacaggagaagagaagtttttttcctcttatgtcatggccttcagcattcttagaccagagcctgctttctttaacactctaaccacttttattagtttgcttattcagtggtagaatgtaaactccaagaggtcaggagtcacactagtcactatattcctggatagccccagccaaatacctgacacagcaggtgcttgatagacaatctgttgaattatatgcaatctgttgaatgaagctcttaagttatctagattttaggaactactggggcagattctcatcagacaggtgcaaagaatgggtattttaaagcaattagatttaacagaacatcattatgcaaatgtagctctgggatgtcccactcagatgccaggcttataatgttattgaagtgttacatgaatttgtgtgtgtttgtgggcggagtggattctcttgttaatattgggcctcaggtttattgatattttcgatagaaataacttgaaaattgctgatgaaagatacaaatgtttctttcccaggtgttttaaattttcttaggaatatatgacaagctggcgttggattgcgtgtcctaggttttgttaccttggcccagtgctgctgtcactatcccaaccacctggtctgtctgatcctggagcactgggtgagaagctgtttattctgtcagtctgactgtattagcagtcccccctccccacagaggcagagaagactccactctgttatgtaattgtgagtgctgggagatagtggggggagttataatttagggaatttccatattggagatagtactgcctatgtgtcatgatgcatttgacatcatatgggttattcatcgatgggttattcaacacgtttgaatagtaaggcctccaattgccatttatagcatatgtgctaaagaaacaaaatggtgtgttgggagttacatccatcatctttcccctttggttgaaatttaaagtgacagactgttgtactttaaaaaccgtattgatcaaatcatcttaaacacatactaaattcctagaaaaaaatctgcaattgatactgtagttttttctatattacaattatttatggccaggtgtggtggctcatgcctgtaaactcttcgggagattgaaacgggaggattgcactcgcatctggataacagagtgagaccgtgtcccttaaaaaattcattttaaaacccgaattgaaattagtcgtaaatttttaaacacttatggtgagaacatttgcatttctatcataggacctctgtgttccttgttcttctattccactttcttgtcccaccttctggtaactgtggttcttgctttttctgtttcaagttcttgcccttggcttctcttcccttcccagcatctctgcctgccttgggtttctttctactctctcaccttcgtttcccacatcttctctatttgttctccgccctgtgattcactctatatttaaatctacaattttaccctccctcgttggtttattttttaattgtttctaaatctcagtaagcaatttgaaataagagcaaggtgtggtgcctgatcaattaccctatggctgccacctctttagaactattggcttagaaatcacctttggtcacacgaaatagggcatttattgcaggtttattagtggggagaaataacaattgttccatgcacagtattggtgcgtttctattctcaatcaatcaagaataaccggtgaattttccaagatggttatttaaagtgctatactaataatactgaaagtaagccatatgcacaacctggcaattttttaaaatatcttttaagtactatatatctaagagcagattacattttcagtggcagtcctcattttctccacattgagttatgtcttggtaccacgctttattgcaaaactctcacaactaaaggatttaaagtttattattgcgattttaaagcaggatagaaaggaaaggagagaaaaataatttttctgagtgaagggacctagttcttataatagcattttgatctgaggactgtgctgtgataaataactcttactgtagaatctagatgaaattaaccctgggagaaccctatatatccctgaggcatttggtggccgactacgacagtgtgtaatctgttttcacatagtatagtacacagatgtatatgtgagctgagtgtaaatgcagacttctttcacctttttgaagactatctttttgaagacttttcttggagaggatttatctaacacctgtttgaatcttctctttttgttatcgtggtgatcttatttgagtagtattttggtgattgtgtttgatcataaatatatagcagcagaaaatttttgcagcaccaaactcataattcttggatttaccatatctaaaggaatgccaattttgcatattttttcctatatctttacaagcctcattaaaatattaaacttaaaaattttttaaagcataattgcgtttttcttttcaaacttctgaagaaatgtacaagatttaaaattaattttgataaattaatttgcatttactttgtaagccagcactttgtagtgtgaaataatattgaaaatgggaaacaatatgtattgataattaaatgaatatacaaccagttttcttcccggaagacattttcatgtaccatgtaaaaggtactttttggaattatttatacttttatagttttccatgcgtgtgtgattagacttctgagaaaaccttggataattttacgatgataaacatttatatttcatttcagtgtagttcagtcacttaaaaatatccacttaattttattttggggacaactgtagattcacaagcggttataagaaataatacagagaaatcctctgcccccttcatcagtttccccttatggtggcatcttgttaaatgtggagcaatgccacatctaggatattgactttagtacagtcaagaaacagaacgtttccatcaccacaaggatctctcatgttgcccttctgcagccacactgacctctcctatctccttccacactgctcggcaaccatgaatctgttctccatttctataaatttatcatttcaaaaatgttatataaatagaattatactttggatattgctcttttttcattcagcatagttccctgacgattcatctagattgttttctatttcagtaattcatttcttttttattaagtagtgttccatggaaactgtgtaccacagattgtttaaccattcacctattaaagacatctgggttgtttccatgtttcggtggttacaaataaagtcgctataaacatttgtctatagattttattgtgtatccatttttttctgtgataagtgcctaggaattcagttgttggcttgtatgttaattgtatgtttgttgtttaagacagcggcccccaacctttttggcaccagggaccggtttcttcaaagacagtttttccatggaccaagggtgggaggtggtgtggatggttttgggatgaaactgttccacctcacgtcatcaggcattaggttttcacaagaagcacgcagtctagatccctcacctgtgcagttcacagtagggtttgtgctcctatgagaatctaatgctgctgctgatttgcccggaggagctcaggcgggaatgctccttcgtccactgctcccctcctgctgtgcagcctggttcctaacaggtcatggactggtaacagttgttggcctgggggttggggacccctggtttaagaaaccttttttgaagtgttatactattttacgttgtcaccagaaatgtgtgaatgtgatccagtttcacatcctcatcattatttggtgttaccattatctttcattttggccattctgagatgtatgtggtgataccttattttggttttaatttgcattcccctaatgttgaacattgttttttcatgtgcttgtttgtcatctctatatcctcttcagtgaaacgtttatgtcttttatccattttctaactggatcgtttttcactgttgaattttaagagttctttatatattttagatactaggcatttgttgaacatttggcgtacaaatatattctcactctgtagactctatttccattcttttaacagggtcttttgcgtagaaaatgtttttaattttgatgaagtcagattgataagttttttcttttatgggtcatgcttttgctgtcgagactaagaattctgcctagacttggatcctgaaaattttctcgtgtgttggtttcttttaaaagttctgtagttttatgtttcacattaaagtccatggcacattttgagttaacttttgtatatggttgaggttctttttttgcttttaaacccatggatatgcaattgctcctgcaccatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcattgatttctttcatcagcatttttagttttcagtatatgagtcctgtacatgtttcggtagctttacacttaagaacttaattttctttggagcgattgtaagtagtattgtattttaaattttggtgtcagtgtgttcactgctagcatataggagtttttatcttatatcctgtgaccttgctgatttgaggccgcaacttctgcagtgtaatgtaaagccattgaacatggagagggcaaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaaagttctacatagagaagcattctctgttttcattcttcccagtatcaccctataggtaaccatttttattacttttttgttgtaaaagaaagtacttgctttttcttccttctcatacacaatgtagtagtctatggtctctggtctcctcctttctttttttttttatttcacaatatattttggagattactccattatagcacatagagatcttcctcactcctttttacagttacattaagtactgggtaattttgccatgtgtacttttattagatcctgcagaattcccctttatggggattttattttgtactttcatcaacagtgtttgtgacgttcagtttcttctgaggcttgtcacaagagcagatttttgccagataggtgagaagtgctatttcagtgtagtttttatttacatttatggggatagttgaacatctttaaaaacatttaaagacttttgtctttttgtcaactgttggttcatgtcttttgcctatttgtatattggatttttgataattattgtttttattttatttatttatttattttgagacagagtcttgctctgtcaccaggttggagtgcagtggcgtgatctcagctcactgcaacctctgcctcctgggttcaagcaattctcctgcctcagcctcccaagtaactgggattacaggcatgcaccaccatgcccagctaatttttgtatttttagtagagacagggttttaccatgttggccaggatggtctcgatctcctgacctcgtgatccacctgcctcagcctcccaaagtgctgggattacaggcgtgagctaccgcgcccggcctattgtttttatttctaaagaggaaggaagattatttatttggaagataagttgtgaaagttacttcccagtttgccattggtcttttgactttgcctacaattttattttatttatttatttatttatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatattgttgagccagttatataagtcatgttaatttctaggtgttacaaacagaagaaagtgttctcaagcttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagtgcacccaccaataatgtaaattcttactgaaacagtcatgcttgtgtaggtactgtctgtggtcacttttgttctacaatgacagagctgtgtagatgtgacagagattatacagcctgcaaaacaaaatacttagtatctggcctgttatagggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatctggaaaaccacaattaaattgactgcactgcagaagagtgtgagtaaatagcataagaaaccctgacagtcggccaaaattaacgaacagaggtttctacttagatctatcctcacaatttgaatttttaggataaaacaatcccaggagatagagcaggttgtgaagaaacacaggttaggtttgtctcaggtatcttgtctattaaatgctaggaatctgtaaggctgtggttcagtaactgtcatcagctacgttgttaacatacagtttacaggctattcagatgtaaaacaacagcatttatgttccattcaccccttaaaaagctacataaatatgagtttcatccacggaggagaccacccttagattttaggttatgtctctgactttgaagggagagagtctggagcagtgcgaagtcttacagcttcctgaccttttgggaggttgggaaatatttatgtgtgtcctgtgactggtagttagcagaaaaggctcccaagctagtccaacacaactgatcaggaagttgggtcatccaacagaaaatgtagcccacgttacagttagaaaattaaaaatccagggctaggcaaatgctttcttaaatatgatatgaaaagcacaagcaataaaaggaaaatgataaattgaacttaatcaaaatggaaaacctctgtgcttcagaacacgccctattgcctcttaccctgtgtaactaggagggagcccatctgaggacaattcaatacctcaggagggcagagcggaagagggcaagaccctgagctttgagaacgtcactgggcccccaaaatgaaccctgtaacttgctgtacctctgggttgattgttgtgtgagatggtcagtttctctgttgtgagagttggagtttgttacttgcagctgactacatccttagtgatccatgctgaaagaaaaagttaatgccagcccaggaagagagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaaacttcagtagcttttgtatatattaaccatttataatcaacaacaaagaagacctcattcacaatcacaagcccaaaaacttgaaataaacttgataagtacatgatttatatgaagaaaaccataaaactttaaagaggatctttaaaaagtttgaaaacatgaagtcatactttgttttaacataagaatagctaactttgtaaaatgccatgtttctttgctctgtaaattaaatgtcatctcagtccaaattgtggatttttcttttttttaacttgacactctgatatccacggtaattggagcaatggaagtcttggatttgctgcagtgtgttttgcatagttgaaggactggggaattgggggagagctgagtctggaatcaggaacccactgttgcctaaagtggctcactccttatgagcaataccaccccacttaactgatctgaagttttccacttgggatatgttccttttctggaagacttgtgacttctgcccccaagctgtgcacaggaggactcactgtcatcagatgctgtggttacacaaaatatttttttctacaattgattttcttcacataaatcgtgtacttgtcaagtctttggaggttgggttgccttactgtagtgtcatagccagtcacagacctggcagcagtgcattgtaactctgaaagcccttcagtggctgccaccagaaggtctctctcctgcatactcctttggccactatacaggtcttccaatttaacctacactatatttttactggccttttttccagtgctttgaataaggtacgtttttccccaccccagaacctttacatattctgttccctctgcctagaccaatttctaaccatgctctgctcctccagtccccactacacacacccacacccccacacccccggtcaactctaattcacctttcaggtctcagattcagtaatatttcttcaaagagactttttaaaatttttcagaattgattaggtccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgcaaaaaaaaaaaaaaattgtgcattgtgagaaaattttagaaaacaaacactagtggagacttgcctttacatgtcacaaacttatgctaaagctgtaattgttaaatcagtataatactgacccaggactagacagaaaatgaaataaagtctagaagtaagcccaagtacatatgggggtttagtgtgtgttcaatgtatttcattttaaagtagtgtaaaatagatggttggttatcagcctgcaagttggctcccagtgatcattgccttgtagtattcttatccgtgtatagactctccttacatgtgtagggctgacctgtgtaaccagtaggatagaatgaagaggatagtgtgtgacttccaagggtaaatcatacaagacattgtaacctctgtcttgtgctcccttgcatcatttgctcttgggggagctggctacctttcgtgaggacactcaagcaactctgtggagaagtccttgtggagaggaactgaggccttggtcaaccgccaccatcaacttgcctgccatgtgggtgagccatctgggaagtggatcctccagccccagggaagccttcagatgacggcagctctgggaggcatcttgcctgcaacctcatgtggatacagctaaaccagagccacagaactaagctgctcctgaatttctgactcacagaaatggtgtgagaaaatgctgattgctgttttaagccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatccatgttgggttcctttttcactgccacacacagggcagggggctgtgtgtgggggtgcttcctagccacgctgttccaaactatatttttattttatcatttatttattatatatttatttttggagacagagtctcactctgttgcccaggctggagtgcagtggcacgatctcggctcactgcaacctccgcctcctgggctcaagcaattctcctgcgtcagcctcccgagtagctgggattacaggtgcacgccaccatgcccagctaatttttgtattttagtaaagatgggggtttcaccatgttggccaggctggtcttgaactcctgggctcaagtgatccgcctgcctcggcttcccaaagtgctgggattacaggcatgaaccactgcgccggcccccaaactctatttttaaatcaacttcttgttgagccactcttgcctgtatttgttggctctgagcttctcttggatcccttgagaactgctctcagtcatctttcgggggctacaattaacattgttctgtcttccaagagtccctcatagttttggtctcacatattttgtgttttctaggcattccataaaatatatggtctgctgatggcactggttttttgtcttgcaggattctttaattctacttaaaaacaaaagtccttgttagttcataagaccttgggtgggacgggaggtagacatttgtgctcagatgacctgttcttttttctgtgggtgttatcacttgcgtttcttcgagcatattcactttgacattttcttctgcttactgtatcagccatgtacccaggggtcaggagtgtacacatacacatgaggaaaccttgaggtcgggcagggatttggatccaggctgtgactccaaagcctgccctcttaacctctctgctgtctcttctgtttgtgcagtggggggccctctttcatgctgtttgtttacttcaaaggcttggtgtttcttgtatttctgttcacatttgtaggtaaggatctgcaactcagcgttgcgtgaaggttctcacgcaggagctcagcttcaggtgactttgcaggggaagggcagggagcatatagcggggcagggtattcactctgctgccctgctcgctggggggccggcggggtgggcttctgctccacggagttggtcactttgtcggctctgctgtcttccttgttaggacctctcatcggagagttgcatgcatgctcaccgacctcccaccccttccccggagcagacccctgagtcagacagttcaaacgaggacttgctcagctcttccagcttctcgttaattacttggccaattatctatggcctgcttctcctggcctgtgctgcactgataatgggattatgctgagcttctgctgaggaaacttttcaactgacatgggttccttctatttctttagatttgccatcattggtcccgtcacttttctagaaatttaatctgttccacaactctttattgtgcggggcaatgtgctgggcattagaaaataatggtgaagagaagacctgtcacgatggagcttatgtatggtcttgttggggagacaggcattaaacaattaatttgcacacacgtagttcttgttctgtgaggagaagttgccctgcgctgagggggcatatgaaaaggctaacttactgggagaggggttgccatggaagtccacctggagcacgtgtgacaattgacctgagattccaaggaagaaaaggagtgactcagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgaggaattggcggttcagtttggccaactttggtgttgtaacacttgagattgtattaagctgcaagtaacaaattcagatgaacagttgcttaaccaagtaacttaaaggcacaagctttaagcttttaacgttttcaagttcaggtcatgtaggggagctatgtcattaaggagactgactctttctgtcttcttgatttactgtagagtacggcttttgacctcatcataacagagtggctgctgcccctctagaaactccatctgtgattcaggcgaaagggaagggcctgctagttggcttgtcctttttattttttatcagaaaaatagtagctttcaaagaaaccacccccattagacttccgtttatatttcagtgaccagaactgtgagaaagccgtctttagctgcaaggaaacctgagaaatcaagcttttgtggttatgtttttcaaactggagcacattgctgttcaaaacaaaatcagagttctgttaataaataaggagagaatggatattggtaggcaacttgctgtgtcagctgcaggagttatgtgcttagaggtggtaattgaagtcaagagtgtgattaacattactcagggggagtatacagagtaagaagagaatccatgaagggactgaaaggaagtttagtgttgaagagactggcagaagaataggtattctcaaagggaaccaagaacgaggggcaagtgggaggaggtggtcacctggagggtgtggaccagtggtacacaggttaggagagggggaagggcagagtttacattgcccgtatgctggcgagtgaagtccactaggaactgagacatgaacttgaggcttagcaaaagagagcgacttagagaaagagcacccgcactggtgactgtgggctgcatggtgaaggggggcaaagcagtgacagcgggagtgagcccctctcaaaaactgatgccaactacgcaggacagagagggggcggggaagggggagtgacctgagggagactggggctcaagaaaagcctttttgtgttggttgttttaaaggctggcgatactgtagcatgcttagttctaaggagaggaagggccattaaagacgtttgagaaggatcctagaaggattgtattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaattatattttgaggaaacgattagaaatattggcaaaacatagagaaaaatcattacacatctagtgtctcacaacatgaatagttttttggggcatttttcacaacatctgattcattgagtggtagtcccccaagagatacctgtgaattggtttttaattcagtagatttctgttttattgtatatttgttgacttgtgatcaacatatattctcttctatttttgaagcttattttgggtaaaaagaaagattacctttctatcttctcactttatccccaacttatgaataccataggtatcaaccagtgatattactagcaaatcacccactctcccactttactaataaaatgttgtcttgaattcttgcatttccgctaaaaaaaatcccattcaaaattatgaatttagaaatgggatgaaagctgagtgcagtggctcaggcctataatcctggcaatttgaaaggctgaggtggggggatcaattgagccaagaatgtgagaccagcctgggcaatagtgagaccctgtcactaccaaaacataacaaaaattagcctggtgtggtggcatgtgcctgtggttccagctactagggagactgagatggaaggatcacttgagccccagaggttaagattgcagtgaattatgattgtgccactgcactccagcctgggtgacagcgagaccctgtttctattaaaaaaacacatggggtgatttccctctccccagtttggaagtcttcaataaaaggataaaaagatgtgaagcggttttagccatctctttttggcctccatgtaatcagattttgtgcttatttgagacacttaaaaagtatctggctaattgtgctctctgttttgaggacctgatcttaaactggatggtcttgatattttcgtgtaacttttagttcaggtacaagaattctttaaagaggcatggacaattaattacacgactgagaaaaataatttcccccaagttaattgcacaaattactgtagccctaaaaggttaatgattatcaaacatctttgatgcatagagcctattaaatgccagtatcatttgaataatttaactagagtagtcctttcacaaatgggtctcatccaaaggacaacagtaaatagtgcctttaaaaatattttctctttagagaaacgtgttcaaacccttcagctggagtcaatcttatgggtcacaacacattcttacatttcagaatataagacattaaaacattttatattttaaatgatttagatcatttattatccttatagaactactgaggttttacttgaagcttgtaagttaaatttttgtattttatacagagttagcttaggccgtgattaggtagaaataatgggcagttatcactgtatttatttgaaatgaaacttcttttacagctattcatggaagaaaactttaatattgtattaaagcttttattttatctttaaatgccaactttattatgtatttcttaaaattgatcttccagtattttttatgtatactttttagtgctttatagttattagcaggttccacagtagtaactgaaatatactctgattttcatttttattttataaaactttgatttttaataacatatgctgaaggacactctgaagagtactaatttttttcagggatgcttttccaaaaaggattctgtggttcaataaacttgggaaagactgcgtcctatatgcttttagaagagtcacagtgtatactcacatactgaaggatttgagaaatgctagagcaaataaatctaacgttgtctaacccagtgtttcccaagcttgtctgaagacagacatttccactcttgttttacatcataccctcgaacatcgaaggacttcgctgatttgtgttctacacaaccgtcttgagatacgctgttagattagctgtagcttcccttgccacatcgcgaatttccagcattcaaatgcagcaggcatgtttatctgctgcacttacacctacgtgtacatatgtatataaatataccagtatacatcaatatgtacatttgaagcgtatatgcacacttacataggtacacacatatatgtatgcttgtatttttattttacttactgcagtacccgtagtatatagcagatagtgaaatcagaaaataattgttgagtaaatggatgagagagtttcaccagtctgtggcatacgccctgctgccttcttcaggatgcagaaaaccctgtcccctggcttaaagtgtgacattctggagaaagtagatgtgctctctctagagacacctgaaacatcaaacacaaacagtttgtcagtactgtttcaatattaagtctgtcagagggaaaagaccctgaattttgggtcaggagacctgggttcaggtatggattctaccactttccactcacgtcatcttaggcaagttatgggctttttctgagcctcagtttttctcctctatgaattgataataccttgtaagactgttgaaatatctatagaagacatcaaaaacttatttttaaccaattggaaggtacgctgtgaatgtattatcctgatacaggtgaaagctttattaaaaaacaaatgtaacttaacatttccatttcatatatataggggaagaaaattcccattttttggtgaagatactaattttcataagtaatgaacataaaaaaatatatttttttactgttagcagacaataattttttttctactgtttaaaaacttccatcctttttttctaataaaaaaactccagaatcttcctggattagcctcagacccatcgcacctgctggtctctctgcctggaatcttctttaaaacaaggtgacttgccatttctttccatcttatttcagctctcagtcaacctctcacttccctgcccaccaaaatacagcccccgtatgtatctctttatccctttacctactttattttcctttataattcttatcagacattttattgcacatatcattagtgaggtgagatggagatcatattttgtggcgattagtaagggattgtaatatctctcaataacaaaattgctttagaccaaatttttgtttgcttatatgatttttacacccattatttcagcactttaatgactctgtcagatgtataggttagttagtagtcatacttctgtaaaattctctagtagaatcaaaatacatgtgctctccctttcctctgcatggattttttttttccacatgagggaagctgtggtaaataatgttatagattttcactcgttagtaatattactcaaataaacgatgggaaaatgtttctcttgacaggattgagtaggtagacataggaattcatggaaccacttatgttaaaattgataactttaaaaaaaattggatagcagaaataagacttgttttatgtattagcatccagccaaattatcataactgattgtgtagtgtaaggttagtgatacaaagatgtgcaagatttggttttatactttatctattagaagtttgggtttggtgatacttttaataccatgcagattgcagttttagctatcatgaatttctgaatattttatgtaaaacaaagatgttgcctttaaaagagttaaagttgaagttttttaggctagaatgtgatttagctttatatagctttttgtcagactcttggaatcatttcaaaacacactcatattttgtttagagttaacagagctgtctagaagtaatttctagtttctcctaggctactcatgatgtttgaattattttccgtattctctgctgagagattcttgtggaagtagactttctgagcttctataaacattttccttctggaactatgcccagtccacctgttcaccatttacagggaaatgctgctttcctaatgaaaatcaagcccagattttccagttcagcttctgtaggtagggagtgcagctgtactgggcagcctccagtgagtcccggggacttgacttcttgcaggttttctgctgatggcagctgctatcaccatgtttatcttttgggggactggatgctgctccttcttcaacgttttggcccaagagtagacaacatatgtcataactaacacaaggctgtcatgtttaaagacatctttactgaatgctgcagaggaataaagagaggaaaacccagagagctccatgaatcatgaattcaggcattctaactttagagctatggcacattcatcttcagttagttgagatggttgcttgcatgtaagtggcttttcacatttcaaaaatggtttcccaagtgagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggagactggggttctcagttctggctctgtgactgcaccacatttgtgactgtgaccagagtagcttctctagtcttcagttattttagttataaaatgagatgggataaggttcactgttaaatttctatttataaatgctgtggatgtgtatatatttttatgtatgtaaagttctgaggttgaataagccttattttctctgtggtctaaaccatacctatggaatctcatctgtcaaacgctatgtgattgaagattaaaaaaaaaatctcatctgtcaaacgctatgtgattgaagattaaaaaaaaaaaaggaaaattttatttgaagagactgggtctcattttgttgcccagacttgagtgcagtggcaagatcatagctcattgtattctcaaactcctaggctcaagcgatccccccatcttagcttcccaaagaattgttattaaatctcatttagaaaagttgaatttctcaaatattaactttgatgatataatactcaccacataagtagtagttgtgtgtactttctagtttgaaacgtataagctgtttcgtgcattagtggagatgagatattaaaaattattccttgacatttttaagagttgataaagggagaattttataaagtatgatatatgtaactatattatattatgggatgcaattttaaatgagatttctgtcacactaagtcaacgtgtgtttatcgagtacctactgtgtcaggcacatgcttgatgctagagtatacagatgataaagagaaggtggcctgcccaaatggagtttacattccagtgggaaagctggtaatcaacaagtaaacaaatgagagaatacaattaatagcagccgtgatacctgctggaaaggaaatagcattatcctgtgatacagaatcactgatggggtcaactttttggtagcgtagtttggaaaggcctctcaggaaatgacattttaagtaaaagctgacagaaggaccacaaggaatgagtggtgggaggaataagggcagatgtaaaggagtggggggagaatagcattctagacaaatgtggaaggctaaataatgttaccccaatgatgtccaggttctaattcctagaaccagtgaatgttaccttcagtgataaaatgagactacagatatgattaagttaaagattttgagatggagagattatcctggattatctgggtgggctccaaatacaattacaagtgaccttataagagagaggaaacaggatatttaactaaagagaagacaactacgagacataaacagagcaaagcagagtcagagaaaatgctacacctctggtattgaagttggaggaatgggccatgagccaaggacaagggagtgtagctctaccatcaccttcactgtcattcctttagactcatattttggacttctggcctctaggactgtaagataataaaggtatgttattttaagccataggtctattgtagtttgttacagcagcaacagaaaactaatacaggataggtgtggtggctcaagtctgtagtccaagctactcaggaggctgaggcaggggaattgcttgagcctgggaggtagagggagcagtgagctgtgatcgtgccactgcactccacagcctgggcaacagaaataaacaaaaacaaaaaactaacgtggaagttggtacctggaggtggggtgctgtggtaacaaatatctgaaaatgtggaagcagctttagaagtggtgattgagtagaggcttgaaaaattttgaggtacatgattaaaaaaccccaggttgccttgaacagactgttcaagtgtttaatgtagatattaaagactgctggtgagggcttagaaggaaatgagcttgttattggtaagtgggggaaagtggatcattgttatatagtggcagaaactgtagctgaattgtgtcttagagctctacggaaagcagaatttgtaagtgatgaagttggctatttaggaggagatttccaagcaaattgttgaaggtactgcttggattcttcttgctgcttatagtaaaatgtgagaagaaattctaactgtggtctgcagcttcagcttcatgccggagggttccagggtgccctttctgacagcctgccctacaaactatactttgaatagcagggttgtagagaatcatatttattcatttagaatgtcaaatatatctctataaaagagtttagctttgctcatcagccttttaaatgtttaccactgacagtgacttcactgatctaattacagttatcgaagccaatattgtaagaactgtgcatcctcttattgtgcacaattgatctggaagcatctttcctataccgagttaaatagtgtcaccccagaaaagttattttcacctatgaatgtgagtttatttggaaattgggcttttgcagatgtaattaaataagatgaggtcatacaggattagaccggactataatccaatgactagtatccttatatgatgagggggctttggacatagggacacatagggagagtgccatgtgcagatagacgcagatattggagttatgctgccgaagtcaataatgccaagtattgttggaaccaccagaagctaggagagaggtggaacaaattctccctttgagccctcaggaaggaaccaaagctactgaaacttgatcttggacttctggcctccagagctgagagaataaatatctgttgttttaggacattcagtttgtggcattttgttatggtagccctaggaaatgaatatgtcttctgacaagtaaaagtaaaatagtggactctaacaaattaatttttaagcacccaacagaaaatgtcactcttccacagagccaatgtctatactatggctgttttccagttttggagttctggaagtttgttagctaccattgctctttgagtaattcttaaaccttttataccaggtcacatttagaatagaatataaaaaccttggacacaaaatcaaagttcataccagatcaagaggggacaaaaatggactagaaggaaggttacataaagtggtactatgtcttctgcaatttgtttgttttcttgtaatatttgccctgagctcaccagcgaaataatagatagactccatagaagtcaactcttaaaaatgacttttctgtcattctttacctccatcctatcaagcacacatgaccttggttccattgtgcaggacttaggaacacactttgaatgtaagcagtttcttctagcattgctggaagtaaaaggatgcctcatcttaaggaatagagttgtttctggaggtcttgcttaagcgtacatttggaagtgattttttttttcctttacgttttctgttgtagaataaaaaatttctttccacaaaggaattattatacccaaaatatgtttaaaaacaatttaaaagtatatatatgtacagtggcactggctttcagagaaaagaataaaagtatatacatgtatcctgttaactgatttttttttttttttttttgagacagggtcttgctctgtctcctgggttagagtgcagtggcatgatcatggctcactgcaacctccgcttgccaggtttaagtgatcctcctgtctcagcctcccgagtagctggtgtgtgccataatgcctggctaatttttgtatttttttgtagaggtgaggttttgctatgttgcccaggctggtctcaaactcctgagctcaagcaatgcacctgcgttgccctcccaaagtgatgggatcacaggtgtcaaccgccatgtttggccaacaactgaaatatttttaaaagtatgtatatcatgtaatatatatatatatatatatatgcatgctacctaagcttaaatgcaacaaagaccatacaaggcttttatggagacaaataaatgcacctgtgtaccacattcatgatagaaagtattagtattataaagatgcccatcatgtccacattaatccataaattcagttctaatcagtaactgaacgcttaaaacctttgcataacagacattttcaaactttacagaagtaaagagaaaagcatgatgaaccccatgtactctagcaaattccacttgtgaccaatgatttcttagaaatgtatcattattaacttatgagactttaaaatacacttgaggtatttaattcatgtcattcgtttttattgaaactcaaattgtcaaatctttgtccaattgtggtgcctttaagttggatcttgtgaccttttgacatgactccattagttttcttttatatatacttttatggtggtaaaatatatatacacacatatagcatagaatttgtcattttaaccatttaaaaagtgcagttcagtgacattcattgtattcagtgttgtatggccatcaccattatttatttccaaaacgtctttgtcatttcaaacagaaactgcaacttctaagcaataatttcccatttcttcctccctccaaccctggtaacttctaatctcctttttgtctttatgaatttgtctactctaggtatttatgtaaaatcatacaacacatatctttttttacctaacttatttaataattttattttcatgatgttttcaagattcattcatattatagcatgtaacagaacttaattccttttttggctgaataataatattccagtgtatgcgtatatcgcatttcgtgtattcattcatttgttgatggacacttgggttgttgcctccttttggctattgcaaatattgctcatgatgaacattggcttacaggtatctgtttgagtccctgttttaaatttttttttttttttttttcttttttgagatggagttttgctcttgttccccaggctgtagtacagtggcgtgatctcagctcactgcaatctccgcctcctaggttcaagcgattgtcctgtctcagtctcctgagtagctgagattacaggtgcctgccaccacgcctggctaattttttgtatttttagtagaggtggggtttcatcatgttggccagcctggtcttgaactcctgacctcaggtgatccacctacctcagcctcccacagtgctgggattacaggtataagccaccacacccggcccctattttcagttcttttggatgtatacccaggagtgaagttgttcaatcatatgataattctgtgtttagctttatgaggaaatgccaaaatgtttttcacagtggctgcaccattatactacttaacagaaatgtttgagagttccaacttttttacattcttgccaacatgttatttttaattttcctttcctatagctatgtgaagtggtatctgtacagaaatgttcattgcagcacagtcaagtgaaaaacaactcaagggaatatcgggaaagagtagataaaactggattattcgcagatcagaatactacgtagcagttaaaatgaatgggctacaagttaaaatgaatgtgattctgttgcattcttcagtacttcagttacatttttcaactccagaatttctgcttgattctttttaattatttcaatctctgttaaatttatctgatagtattctgaattttttctctgtgttttcttgaatttgagtttcttcaaaacagctattttgagttcttgaaaggtcatgtatatctgtttcttaaggattgttcactgttgtcttatttagttcagtttgtgaggtcgtgttttcccggatggtcttgatgcttgtggatgtttgtcagtatctgagctttaaagagttaggcatttattatagtgttcatcatttgggcttatttgtacccatccttcttgggaaggctttccagatattcaaaaggagttgggtaagccatatctgcattagggggcaccctaaggccagtaacactggttcttgcagacttctataggtactgtcttggtagtcttggataagatccagaagaactctctggattaccagacagagatattgttctcctccttttctcccaaacacatggagtcagtctctcctctacttctcccccgaccctcattttgagttaactttgtgtagggtctaagatcatctttttgcatgtggatatccaattgttctggttttatttggtgaacgtattatctattccctagtgtattgccttggcatgtttgttaaaaatcagtggataataaatataagaatttattgctggattcgtaattatgtgccattgatcaatgatttttattagtactataatgctttgatcactgtacctttatataagatttgaaatttagaaaagacctccagttttttttcaaaattgttttgattattctaaatgttttgcattttcatttgcattttaggacctgcttatcaatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttttctttgacccgtatttagaaataactgcattattgttggtaaatatactttatacgattttaatccttttaaatctgctaatgctttctttgtggtccagcatatgacttatcttgggttctatggcagcttgaaaagaatgattattttgctgctgttgtgtggagtgtgctttagatgtgtgttaaggtaagttgattggcagtgttataagtcttctgtatttttgttgatcttctgtctacttgttctattcattattgaaaattgaaatgttcaactattgtttctctttaattttgtcagttttagttttatgtattttggacccctgttactgcatacatatttataaattgttatctttacctgctgaattaccctcttattataaaatttccttttctttctagtaacaatttttgtctttaaattcattttgtctgatattaatatagctgtcctctgattactgttttcatgatatatcttttcccatccttttgttttcaactgatctgtatctttgtatctaatgtgaatctcttccagacagcatatggttgtcaagtttatttttctcagtctatactgttaatctgcaccttttgattagatggtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttctggtttgataattacataatctctgccatatatgagtctgattctgatgcttgctttgccccttcagattgtgtgttttcttgcctttcagcatgccttgtaattttttgtggaaagccaggcatgatgtactgagtagcaggaactgaagtagtaaataggtcttcagtgtgaggttttgtttatctggcttgtaggtttaacgttttctataactgtaggtttaacgttttctgtaactgtaggttttctgtagctgtaggtttttctgtaactgtaggtttcacaggctttagtttcccgtagtatccttgcttttttctcctttattttctttgggcttccctagaaataccgccttaagtagagtctgtaccttgcagctattttagttgtaatccactgttgttctattagagccctgttgatgtagtgataaggtgttgcggagaggaaacattctataatcttgtgataaacctcagatttgtttagtaggcctgagtccctgggctgtgaccttcagaagagtttcttagcatttttttttctcctcttctgtgagacagggatgctagaggggactgagttgtataatcaccttcccctaggtcacataaagttctgacaaagtagtttcccttgggagaaggcctttattatatagaacagaaggctccgggcatatttcaaaatacttttccccagatgcattttggcatgcttacttttccccttgcccttgctgagcacatgatttatttattattttatttttatttttatttatttatttttttaacctccagtcttcaccaggagaacatagtgggacttctgggggtaaaacttatgaaagtgtatgggtcccctaagactgagcccccagtagtttttttttttttttttcctcaagctagtttatactcagcctccagcaaatagtgagttaccacttaagtgttcctacagttatttcctctagtagcgctcctcctagtaagctgtgattttgtgtctccagttttcagtgcaactatttgccctgagacctcagttctctggtgtatctaagaattgtccatgttcaagttttccactatttttcatgttgggagagtgggacttccgagctctttacatgttgcaacagaaaccagcagtattatctcttcagttattctttctctcttcttttaggaccccagttatgtgtaacttcatgcacttggggatgtcccagaggtgccagagattcttttcatttttttttcataatttattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagcctactgtgaatggagcttaggagagagggatggagtagaccaagttaaaatgccatgaaccaagcctttctagccaagattcagcagctttcctaagataatgctttagattgttgtacagctttggttaattttcagaattttcaaaaaagttgattttgaaaattgtggcagcattttcattgtttttatgcatgggagcgtttccacagatcttcactccaccattctgagagtgcccccaacttcgaatggatgaatttttataacaagtgaaaaagtaagtccctgaaggttacatacagcctttacccattttatcaacttagaaacaatgaaaagaacgtatgtacttataaatacataaaaatatacacagtatttgtattacacaaaaatagataaacataaaactataaaaagtaaagtacaggattctggatagtggttacctcagatggtggcagaccaaaggatgggagtgggggttacctagaaatatatgtgtcataattaaggtccagttttattttgtagttggtgggttcatggattcttatggcgtaattaaaaatatatacacaggcaaaaacattttatggttgtgtttgccttcatgttaacacatgagatgaggaatctattatgcaacagagctttataaaggagcttcaacctcagttttcaaagccattcttacggccagaggaattgcttatggagcttatctctacccagtctcgtgtaggtctgcctcagctggccgaactccagtgtcaggacaggacagtgatgatgagaagggaagggacagcagccagtgccagttcgagatgagtagtcatctaatactgcctctgcgtgggtccctgctgccatccgcagcctcatagccctcagctccgtaatgtgtcctgatggatttagaagatacatagggagctgtcattgtgagtctgaaaaatatacagatcacgcttcacttactaaaatccatacttgatgatgtcagccacttacacgagcattcaagaggtcttctagaataatcacatgacaagatttgggggaatacacagaattccaatcaagatgagttgagcataatatcatggaggcaggatcagaatggaaaggtaactgataacttggaagtttaaacaattacaattttcctgtttactgtgtgacaagagcattatggggccttgaaaatggcagtgtcaccactgggtaatatattttattcaaagactttttgagagagagcatctgtagagtcaaatggtacttgccaaactattccatgtatggaacccataggacttcataattttatggtttgctgggggaaaataacaagaccactcatggcccaggtgagtcttgaagaggctgtggccacaatatactgagccagccgtagttcactggatgggaagacccaagtttgacttccagatttacttcttacttgcactttgggcagttacattacttctctgagccttattttttttttttattatggagataatgctactgatgtgtaataattttgtatctactagtattagaatgtatgaattaccccttaatttttcaaatacttaaactgttaacatctgaatcttggccaaaatgagcacaaatggcatttgtataaatgcctagttattaaatgttatcactatttaactatctggatttgaagaccagtgcatggcgtttgctaggagtttatatcatgttcttacgtatgtgtgtagctgtctttactgcatctgtcgattaggaggtaagaacacctgctgaatatgtaccttgagctagctattgtgggagatataaaagaagcacaaaactggatcctgtcctcatggaactcaatctggtttctgaggtttagcttttatgtgactcacagatagagcaatgtcacagaaaataatatgcggaaaataaatgcaaaaagaacttgagaaagcttcatgtggctcagtatcctgcactcagtaggatatgtggaggatatatataaaatctaattgagattcttaggaaaggctttaatgaagactggagaatgaatgatatctgttataaaggatggtgaagcttggctattcagagagtaatggaggaggtacttcagtagtttttattgtgtctgcccaagaaattcactcggaagcacaatgtttatttctgaagaggcaaagaccaagttttagaaaataaagttctcctaaatactattataaagtttgagtatttctattatgattttatgacttcccatctgtggtaggtgttttattgaaattatttgaatgttatcaagctgtgacaacaatgctttaaaggtcatacacaaagcacaattaaatttcccaagtgaaataagaatgtgcattgtgaaaggcagagaatttcaagtagttcagttttgttgttgctttttttcatctgggccatttttgaggtgtttaaatcaaaaagttgtttttcttcttgattgcagttttcccttagttatttgtgtagcttaaaaatggaaaccaatgtgtttaagttgcaatatttttgagtctattagttaatataaactttattctacactcaacagtagattgcattatagctatgtggaatgtaaagattattttgcacttatataaatgtgatagcttctgattgatacagatttaattatgcaaactttggcttattatgaattagatgaaacatttctattcctctgtttctttctttctttctttttttgagacagagtttcactctggagtgcagtggtgctatctcggctcactgcaacctctgcctcccgggttcaagtgattctcctgcctcagccttcccagtagctgggattacagctgcatgccaccacacccagctaattttgtatttttagtagaaacagggtttctccgtgttgatcaggctggtcttgaactcctgacctcaggtgatctgcccgccttagcctcccaaagtgttgggattacaggtgtgagtcaccatgcctgacctatacttctgtttcttatgagcttacttattagaagatctctaagattcctgtaatttaaaattttgtaatttcatttcattttacccatttacatcattaaagtgatgaatggttgcttctttcaaatggtgggaaatgaattttggagaattgttagttattattgctcatttaaggttatttgaacgttttgactatttgatggtgttttttgtttgatttgtgatgctgactcataaataccatgaaaaacaggtctttttgttctaaccgaaagagggattatttagcagcttaatgactttggtaaataaaagtttatttgcacctatgagaaagatgacaggtaatatctagatatctgagtaaagagtaaagagagcacaaatacaataagatatggagactcagtatcctatcagctttttgatgtaaaatggtacagtagttactacctaagagaatagtctatttccatgctggttgctcacttgtgtgctcttctgaaagagtgagggcactgtgcgtctgactggatactggggtactctgtttccaagctgcattacagggatttgaaatatcttacatatatatatatatatatatatatatatatatatatatatatataatatatatatttatttatattatatatatatttatttattccatatacaggcataccttggagatattgcaggttagggtccagaccattgcaataaagtgaatcacacaaattttgtggtttcccagtgcatataaaagttgtgtttatgctattttgtagtctgttaagtgagcaatagcattatggctaacaagagtacataccttaattaaacattttctaaaaaatgcctgcacagagacgtgaagtgagctgatgctattggaaaaatggcatcaatagacttgctggacatgggctgccacaaacctccaaaatttgtaattttacaaattaaagccctcaatttgaaaaacataatatctgtgaagcacaagaaagctaagtgcagtaagacaaggtgtgcctatatatgtttctgtgtatatttaaataacttatattaatagctgcaaacagtagatttcttccggtgtatggctttgtcattgttatcactgatttgtaataatttacctcttttttgtatgttttattattttctgccatggttgataaacaagttaatttactctcagaacagagaatctgcagtattattattaatagtgactgttgacttcttttgtcatctaaacaacttgttagtctgcccttaggcttgacattatttttgttgtgaaagaatattcagtaaaaagttttgacatgtttaaaatcattaaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggagcattttcaaaggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgtaaaaaaaaaccaaaaaaaaaaacaaaaacaaaaacaaaaaacactttccttaatcttggaatgcttttcacaagaactaagtgtggcatattggtggctgtatgagtactctggtattataggagttgaagtgtgaggtggagagtaagagtaactgggggtaaaacttagacccaatgtgtccagaagattcagagccttatcactgcacaaaggagcacagattttaaacactgaagtgcccaagttgcatgcaaacaggctgtgggctgaccaccggtttttgtatttattctgaatatagtatgccacaaaatttgaatgtatatgcttttacagatctctgtgctctctctagctcccccaaaatctctgcctgtctttagtttcatgctagactgttttatctgtttgttgcctttgaaagcttttgggtttaccccatgctggagtaacatgtagatctagaaggattttgagcaggaggtagtgttatcagatatggttataaggaaagctcactttagcaatagagctgacacagtagtagcaggtagtgaattctgcaagagaattaatggacactagtcatcttgattgtacttagttatttactgcttcagtgtagttctgttgtgcttaattttcttttcttttctttctttcttttttttttttttttttgagagagtcttgctttgtcgcccaggctatagtgcagtggcatgttctcagctcactgcaacctctgcctcccaggttcaagtgattcttctgcatcagcctcctgagtaggtgggattacaggcatacctcactatgcccagctaatttttgtatttttagtggagacagggtttcgccatattgctcaggctggtctcaaactcctgacctcaagtgatccacctgccttggcctcccaaagtgctgggattacaggcgtgagccaccgctcctcgtctgttgtgcttaattttctaaacaaactctagaacaagttaagtggttaatccacgtgatttttgttctcatttaaaatcctatgcattcaaaatgtgaactccattaccatctctctgatccgcccttggcatagaatttggatgtgtatattacactggactcttggctttaaaaaccgtctatctgtatctgtgggaaagcttttcagatagcccagacaatataaatagccctagatttacccttaagtaacaaatgtgtttctttctgtggagttactcgttgtgtctgagggatcctccctgggttatttttttcctctccaatggactggcttggcatatgattgtcaagaacaggcactctggtcggacagaccttgtttaaatcttctctctctctccaactgtgggccagttcgttaatctacttgagctttggttagttattctatagatcgttttgtggattaagtgaaacatcatactgaaaacacttagttttatcatccagaccagggcactaaacgagaataaaccaacctcctagtttttggatgtgtttgacacgaggggatgtttaggggaaaataatatttgaccatcagactttttgaatgctggagaaagcatgcacaatgtccatgtaggaacatacccatatatacaggagacttaaacatgtgcgtgtatacatccatatacacaaaatgaatttaggaagttaattgaatcgaggagtttctattttataagataaatgtgaacagtacatttgtaatgtaagcagtctacttttttactcaaacaagcagaaaatatccttttttagttttaaactctttgtagacaagattgaataaactagagtggatgaggcacagagaattggttgccaatgggatcaagaatgctagaggaaagggcagagattatcctttcacccagaattgctctgtctctcccttactaggtaggaaaacaaacaaataacagagacaagggctactgctctgcactaatgatgcgtggggtgaaagaagtccttgcacactggctcctctttcctgcttcgttcacaacctattcagcactttctggaactttgcgtgaaaaatttcatagatcccagcaggaattttgtaaaacacataatctttgctcatagccattacccaatgttgtgttccttcaggggctgattgaaaacagagctttcacaaggtctcttgcatgatgctagccttcatggcatttgcatcctgccaagtgatacttctggtgaccatcctgccaagtgacacttttggtgacagtgccttggttgactggtctcagcaacctgctttaatctctgcaattaaaaggtatgaatgagtgaaccagtaaaatgaaggaaaaaatcaacatagtggcgggatacttacatccagaaatatgttatctaagggtgtgatactgggcagccagctttcatttaagaaattagacgtatttttaggaaaccagctttctgctagtgacctacattataaaatattataaactcccaagctggatactataaattgaagatgaagttctttcattttgcagttacacaatggaatattatgtgtcaggtactgttctaggcattgggtatacaaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcacccttattcactaatgtttgataataatgcattataaaatagcagtgctacttctttatcaaaggcttgcagtatttatttagcatttgcagtttcgaaataattaaacaatgctgatgtacagttcttattgcatttcaaaaacctaaccagttaattagcttaagtggttctctcagccctattgacagttggagacacatagtgctggcttgtcaggctgctaaaatgaaacataagaatggcataactgtggttagcttcttttccccctcacccttgagatatgagttggctttcttttgtgtgagataaaaacaaaaccagatcatatgaactgacacttctgcttcagattaacatgagccttgttattcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctccctattaatgcagcaatttctcttattcatactaattctcatttttttttctgcatcctttgtgtctagtctctccacaattgaaaagctgttttgaccaccacttaagagcaatagactataaattctggagtttaatttgtttaatgtctgtgagggcttgatggggttgggactttgttcactaggtatgaacccattgcctagaaatctgaagaagggtatattgcaggttcttacgggtattcctaggaagaagaaatgatttccaaacagaattagcatgtagaggagaaacgcacaaagaaaaggagatttgatttccacaatgtaaggaaatgtaaaatttcattagaagaaagggaaagaggacattgccagcaaagatggagagaaagaaggcgtgtttaaataagctggtttccaatttagctgaaacatttgaaagtaaacagaagtagagctagatttaggggtgtaagatgtgggcaattaatacatttatatggctcaaaatttgaagagttggaaagcatctacagtgaaaagccccttttcctgccccatttcctcagccactcaggctattccccagagtcactgtgcataattacatatataatacaaacatgtatactatttctcttccctcttttatttttccaaaatggtatcaaactgtatatattcttctgcaccttgccttttttctcactcaacatgtttcttggagctgactctcaagcagtttgtgactatgtaattaggacataggcagctcctgctttttttgttaaatggcactgcaaaatgttcctttatgtgtttataccataatttatttaaccagtctcttgttcatggacattataaccttttgctcttacgcagagtgctgcaaagtgagcagtcttttccacgtgtcatttcacacatgtgcaagtaaagctgtaggataaattcctagaatggctggattaaaaggcaggggcagttacgattttgaaagatgtagccaggtggccttctccataggttgcgagtgtatgaaagacttacttccaagccagtctcttctatgctgcctgctataactaccaattaggaatttatttgggctaataagtaacccatgcctggaagatttaaggaatgtgaccttcctaatgcatattatttttaatcactgtgctttcaacctaatgaccagttgagattaagccacgtggtacatatttattgcaaacctactatttggttctagggaatcagcaaggagcaaggtgttacttctctcttggagtttatattctggtaaataaacaagattattccagagagtgataaatactgtgaaaataatacacatgacaatataattgtaacttggcagggggcaggctaattagaaggagtatactggttatggaaggccccctgaggaagtgatatttcagctaaacctggatgatgtaaaggagccagaaatgtggaaatcttgggtggcagtagcaggaacaacaactgcgaagatcttgagccaagagtaggcctagtggttctagaaacaaacagtagggtagaatagcaaagggactatcatgagcagaggggagcagggcatagcctgaagctaaagaggggcaggggtcagaccaagtagatcctcactgtggtaaggagttgcaagatttcaaatatggatgtgatgttgagatttacttgttaaaaagataacttggagccaggtgcagtggctcacatctgtaatcccagcactttgggaggccaaggcaagtggatcacttgaggtcaagagtttgagaccagcctggccaacatagtgaaactccgtctctactaaaggcatgaaaattaggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgagagataatttgtctactataaaatttatttaaaattgcacaattgtgatttttcacataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgcccagttggttagaacctagaaagtgataaaagtgagccatgcagccgggcacggtggctcatgcctgtaatcccagcactttgggaggatgaggtggatggatcacctgaggtcaggagttcaagaccagtctggccaacatggtgaaacactgtctctactaaaaaatacaaaaattagctgggcatgatggcatgcgactgtaatcctagctaccgggaaggctgaggcaggagaatcccctgaacccaggaggtggaggttgcagggagccgagactgcgccactgcactcaagcctgggcaacaagagctaaactctgtataaaaacaaaaaataacaaaaaaactagcgagccctacagctgcaggctgaggttctagttttggcaataagctaaagtgtaaataattttacatttaaaactatggaacaaatagaggtgggacatgggctgcccctgcccacctctccagccagttccccgactcttcgtcttctttctgctgcatgtggtctgaccatcttagttctcaagtttgccaaactttttttcagccatgtgtcctttgcctatgctgttttctctgctaactttctcttttttttctctctcttacttgctgcttttatggtcaagttctaactcttcaagcgtacacttaaatagtaccttctctgaccccgtaggctaggttgattgcttcagtgtactaaggcaaaaataccctgagtatctgtgctcattaacctctgtgtttcccttttgtaagatttatcacaattgtaatcaaatatttatgctatgatatatttgttgcctttctagattttctaacagtcttctttgcattgttacataaagtgtttagtgcagagctgggcactcatatttggtgcctgagggagatttgttgagtgaataaaatagcagtgtccagcagcgacatagactgctgagatatggcatgtcagagtctgaaaggcttctgtccagttggcaagtggaattcattggatgttttacaaagaatagttttagtaaggtggtggggacggaagtgagtttgcaaagtatcttataaaaagctagacttaattactcatttacgcaacattggaacccttacaagtgatttctctactgagagcaacttttcttgagttttactaactcagtagacactgtcagaatctgccagattacaacaaaggggtaaaaattcctgatcacttgaggtcaggaattcaagaccagcctgggcaacaaggtgaaacccgatctctactaaaaatgaaaaaaaaaaaaaaaaaaaaaaatagctgagctgggtggtgcgtgcctgtaatcccagctacatgggaggctgaggcaggagaattgcttgagcccgggaggcggaggttgcagtgagccgagattgcgccattgcactccagcctgggcgacagagcgagactccatctcagaaacaaacaactcccaaggcattatactatgactcttttctcaatgggtagtgaacagaatggaatattcacttcactgcaaagagtcactggcaggtggtgcagagcactgtgctccagaaagagcaaagagcctagaggtttctgatctctgcttatcactcagccaaaagtacagtcatttgcttaaaaaaagacaggtggcataaaaaaaaaagtattctttaatctctctgctctacaggacttgaaacatagccttaaatgactaagtcttcacgtgagcatgacataacctggaaatcttcctataatggaactggccttgtgaaggtatttattgttaagactttccagggtatattttgggaggtgccatgggcagatacatcggcgatactgttacatagtccaggatgttctacttttgaaaattaacaataattacactcaagaccttaggcaagttgactattctcagcactttatatatacagtcgtccctcattgtacaccgggatctcccctacccctcgcctatggtcaaatctgcacgtactcagtcttacagtcagccctgaagaactcgtatatgtaaaaagagggtatctctaggcagtgaggtagctttctgttagctcttgtagggaccatgttcttgtggacttgacaaagaatgttatatcaaaagtcgtaactcctttttcctgatttaaagatgacatttacatggtttttgtgtcccatgaatacggtatttttgatctgcatttgattgaaatgcatttgagctgctcagttgaaacctgtgttgttcaagggtcagactgtattaacctatttaatctttgcagcaaatcctgtaaggaatcagtccttttacagaggaggaacctgaagctcacagagcttaaggactttgcccgaagtggcagaattggcatttgaacctaggcatcctggcttcagaatccatgttcttcccttttaggttatactgcgtctctgtggccacttgatgataaagtcagtaattaggatccactgttgttccctcttgtgcctctgcccttttgctcatgttctcctccctgacactagagcacctgctcccccttcacctgcagtgagtgtctcggggaaacatcagcacagaggctctgctttctcccacccggcaggtccgcagggggttgctgtttcgaaagtattgagtgctctggacaccatgatctgttctgtaggattcttctgtagcaggagctttgtcatggactcagttgccttttga
